United States Patent 10,167,482 (GENES AND USES FOR PLANT ENHANCEMENT) - sequence listing, part 7

SEQ ID NO: 25897 - protein, 820 aa, Zea mays
  misc_feature (213)..(213): Xaa can be any naturally occurring amino acid
  misc_feature (278)..(278): Xaa can be any naturally occurring amino acid
  misc_feature (353)..(353): Xaa can be any naturally occurring amino acid
  misc_feature (727)..(727): Xaa can be any naturally occurring amino acid
  unsure (1)..(820): unsure at all Xaa locations
MARLTPTKSKSSRKPKPSSSSAMGAGAEPDAMSTRRPKRGKSVGGVSKKSKSGGFESMGLCEEVYRGVRHKGYRVPTPIQRKTMPLILAGVDVAAMARTGSGKTAAFLVPMLQRLRRRDPSAGVRALILSPTRDLAMQTLKFSNQLGKFTDLRTSIIVGGDSMESQFEDLSECPDIIIATPGRLMHHLNDVKDMTLRSVEYVVVDEATSSSSXGTREATRSISRAIGRRSIPNANVPSEIRNHEQMQKGRQQKAMEITRLKNKSAKDGKFQNKFQKSXSSLIGTVRGGVVGKGPEKGLAKGLVEEEGKVRARAGDTTFASRSFVYLLQWRDHSVSFLFATRLVFNYTRLDNLXSINFVVVHRVGRVARQGRSGTAYTFVTSEDMPYLLDLHLFLSRPLRPAPTEEELLKDMDGITMKIDEAIANGESVYGRFPQTVLDLASDGLKEVITGCTELIALEKPCANAFRLYLKTRPMPSKESIKRVKDLPREGLNPIFRDVLRSDELSALAFSERLKSFRPKQTILEAEGEAAKARNSKGSNQWLDVMKKKREVHEGIINLVHQKSSEDPRPEVEEVVDISNWEKKEVCGKKRKLQSFRDEDYYISSVPQNHHLEAGLSVRDNEGFVENRLDAAVLDLVDDEASGMQAQKTRYHWMKNKFVKLNAGDRVTATGKIKTEGGAKIKASATGIYKRWQQKTHKSINIGGKSGNFADEGTSSSGGYQRGNKKHXSRGHGRRSIPNANVPSEIRNHEQMQKGRQQKAMEITRLKNKSAKDGKFQNKFQKSRQQPDRHGKGRGSGKGTGKGFSKGAGGRGGKGKGKGGR

SEQ ID NO: 25898 - protein, 301 aa, Prochlorococcus marinus str. AS9601
MTVQRILIVSGTHGNEINPVWAVKQFNREENSLKHGIEYEYIIGNPVAYEKGCRYIDVDLNRSFKESENCDQQKNSFYETNRANFLLDEFGIDGSKPCQIVIDLHTTTANMGTSIVLYGRRFKDFCLAALLQNKFGLPIYLHEKDKAQTGFLVEAWPCGLVIEIGAVAQNFYDPKIIDRFSLIISSLREEIDKLKNNLIELPKELVVYVHQGSIDYPRDKKGVIDGLIHPERINQDWKMIKKGDPLFLDSQGIVHKYDGDQLIWPVFIGEVAYKEKNIAMSYTKKEVICSKKQWVQDFESL

SEQ ID NO: 25899 - protein, 272 aa, Pseudomonas putida KT2440
MSGFEQLFPGTLPRLVMFDLDGTLIDSVPDLAAAVDRMLLELGRPPAGLEAVRHWVGNGAQVLVRRALAGGIDHADVDDALAEQALALFMDAYAESHELTVVYPGVRDTLRWLRKQGVEMALITNKPERFVGPLLDQMKIGNFFRWIIGGDTLPQKKPDPAALLFVMQMAGVTPQQSLFVGDSRSDVQAAKAAGVQCVGLTYGYNHGRPIDAESPSLVIDDLRALLPGCADPATGITLADLQASQDRESTVAVTGKFWMKVIKALARWRWRA

SEQ ID NO: 25900 - protein, 205 aa, Crocosphaera watsonii WH 8501
MLRNPHRLEFFGNLLDAGKATLCGEESFGTGSNHIREKDGLWAVLFWLNILAVKGESVEKIVRDHWQVYGRNFYSRHDYEEVESGPANELMERLRSQVGEMKGKTYGNYEVDYADDFAYTDPVDGSVSQKQGIRIGFTDGSRIVFRLSGTGTKGATLRVYIESYEPDANKHGVETQEALSPLIQLAEEIAQIKQFTGRDKPTVIT

SEQ ID NO: 25901 - protein, 439 aa, Burkholderia sp. 383
MNETPTVPPAPPRIRRGQRIALALLMVSGIVNYLDRGTLAVASSAIRGDLGLSLAQMGLLLSAFSWSYALCQFPVGGLVDRIGPRRLLGIGLIVWSFAQAAGGIVSTFGWFIVARIVLGIGEAPQFPSAARVVSNWFPLRARGTPTGIFNAASPLGTALAPLLLSILVASFDWRWAFIATGALGLVVAVVWFALYRDPVRAQLTATERSYLDADAQSAVAAPKLTFAEWRSLFSHGTTWGMLIGFFGSVYLNWVYLTWLPGYLTMERHMSLIRTGFAASVPFLCGFVGSLLAGWLSDLVTRRSRSPVVSRRNAVVVAMLGMVAFTIPAALVRSNTVALACISVVIFLANAASACSWALATAAAPPSRIASLGAIQNFGGFIGGALAPILTGIIAQKWSFVPALLTAAAIAFAGAMAYLLLVRKPIPEQAANAAPGPLPA

SEQ ID NO: 25902 - protein, 142 aa, Streptococcus thermophilus LMG 18311
MKVGNMQKTFFIIKPDAVKRHLIGQVLDRIERRGFVIERMEMLMLDEERLKEHYAQLADKPFFPSISEFMMSGPAVIGIMSGPGVIKSWRDMMGATNPGDAAPGTIRGDFATAPDGDMIPNIVHGSDSEESAAREIKIWFGE

SEQ ID NO: 25903 - protein, 308 aa, Burkholderia sp. 383
MSYTYPPRIAVVGSVNIDLVTRAPRLPVPGETLLGTDFQTAHGGKGANQAVAAARLGASVAMIGCVGDDAFGARLHDALSAEGIDVTHLDRIGGTATGVATITVDAGGANSIVVVPGANARLDADRIDAARDAIAGAAMLVCQLEVPVATVARAIACASAHHTPVLLNPAPAQPLFDALLARVDYLVVNETEAESLTGIAVGDDASAVRAADALCAKGVGNVLVTLGARGVCWRGGAGNGRLPAMPVVAVDTTAAGDTFVGGFAAARAGGASMDDAIGFGQRAAAISVTRYGAQTSIPTRDEVARLEP

SEQ ID NO: 25904 - protein, 336 aa, Zea mays
MKGLFKTKPRTPVDIVRQTRECLVHLDLHSGSRSGDAKRDEKMTELSKNIRDMKSILYGNGESEPVTEACVQLTQEFFRENTLRLLIIHLPKLNLETRKDATQVVANLQRQQVSSKIVASEYLESNKDLLDILILGYENMDIALHYGAMLRECIRHQSIARYVLESEHMKKFFDYIQLPNFDIASDASATFKELLTRHKATVAEFLSNNYDWFFEEFNSRLLSSTNYITKRQAIKLLGDMLLDRSNVAVMMRYVSSKDNLMILMNLLRDSSKNIQIEAFHVFKLFAANKNKPPEVVNILVTNRNKLLRFFAGFKIDKEDEQFEADKEHVIKEISAL

SEQ ID NO: 25905 - protein, 427 aa, Chlorobium tepidum TLS [sequence omitted]

SEQ ID NO: 25906 - protein, 521 aa, Yarrowia lipolytica CLIB122
MLLPLLFAGCVFFFLHQRLNYYRRKQRAYEKWLASGKFGAGQKVADIQVQNNFLRNPFGLVQFVEFLNRTKGAFFVDFVNQNFQKYGYILPTRTLGKVNIITCDPELIKTVLATNFKDWSIGIRRKAMFPVLGNAIFSVEGDQWTHSRAMLRPQFARDSIANVADLERHVTRLINVFRGYGVQSFDCQKYFFQFTLDSASDFLFGESTNSLSVQDDKSESEDTGESFNVLTQQGENAESFAQAFKVAFTFTAIRLRLQQFYWLLRPSNKKYRDSIDTVHRLVDGYVERALENKEDTDRYIISNQLVKVCDDKKYIRDQLLGILLAGRNTTAAVLAWIMYESARRPEIWNKMRQEVTDTFSDGPVTSDELRKCVYVRSVINEALRVYPSVPMNQRVAVRDTFLPTGGGPDGSLPLYCPRGTKVAYSVFALHMREDFYGSDSHIFRPERWNEGVGKGWQYLPFNGGPRICLGQQFALMEASYTLVRLVQEFDTVELDMEVVDPPPKMSSFSMVHRDGVRIRVK

SEQ ID NO: 25907 - protein, 581 aa, Mycoplasma gallisepticum R
MLIMKKYEGIGASNGVAIAKAYVLKAPVFNFDNNKIKPTEVEETITKIKQAFDKSSEQLRELRTIALKNLGEEIAVVFDGHINIVNDPMLFDQISQEVKDHLANAPTAVSKIYDQTKAMFEGIEDAYLKERASDIGDVKKRILSNLLNVALPDLLAINHEVIIIADDLTPSETSLLNKQYVKGFATNIGGRTSHSAIMARTLEIPAVLSLKTITETLKHDQLICIDGSKGVVYSDLSEADITTLKQDQQRYNESQAKLKKYLPPKAVTLDGHETIVAVNIGKPIDLLKGNDYGAKGVGLFRTEFLYMDSANWPDEETQFNAYKQALDYANNETVIIRTLDIGGDKKLNYYQFPEEMNPFLGFRAIRFTNQNPDIFKAQLRALLRAAKFGSLGIMFPMIANLEELFKAKEILEEAKKELDQRKVEYGKPLVGIMIEIPSAAVMSDVLAKYVDFFSIGTNDMIQYSFAVDRMSKDVNYLYQPLNPALLRIVKMTIDGGLKHNVWTGMCGEMAGEPLAIPILLGMGLKEFSMSASSMLKAKELINNLKYSDCKELVNRVINLESQEEVVKKVKEFLAKNNLSVA

SEQ ID NO: 25908 - protein, 770 aa, Rhizobium leguminosarum bv. viciae 3841
MDHPEKSKTEKNLTSGDFDEQALFFHRYPRPGKLEIQATKPLGNQRDLALAYSPGVAAPCLAIRDNPEMAAEYTSRANLVAVISNGTAVLGLGNIGPLASKPVMEGKAVLFKKFAGIDVFDIEIDAPGVDQMVSTIASLEPTFGGINLEDIKAPECFEVERRLREKMKIPVFHDDQHGTAIIVAAAILNGLELAGKNIADIKIVASGAGAAALACLNLLVILGAKRENIWVHDLEGLVYEGRVELMDEWKSIYAQKSETRTLAENIGGADVFLGLSAAGVLKPELLAQMADKPLIMALANPTPEIMPDLARAARPDAMICTGRSDFANQVNNVLCFPYIFRGALDCGAETINEEMKMAAVRAIAALAREEPSDVAARAYSGETPVFGPDYLIPSPFDPRLILRIAPAVAKAAEQSGVARRPIQDFDAYLDQLNRFVFRSGFVMKPIFTAAKAAERKRVIFSEGEDERVLRAAQVLLEEGLAEPILIGRPQVIETRLKRYGLRIRPLQDFEVINPEDDPRFREYVDLYFSLVGRRGVIPEAARTIVRTNTTVIGALALRRGEADALICGLEGRYEKHLRDVRQIIGKRKNVRDFSALSLMISQRGATFFTDTYVTFNPTAEEVAEATVLAAEEIRRFGLTPRAALVSHSNFGSRESESATKMRNALQLVRDAAPDLEVDGEMHGESAITEALRKRVMPDTTLHDEANLLVFPNLDAANITLGVVKSMTDGLHVGPILLGTALPAHILAPSVTSRGVVNMAALAVVEASQPA

SEQ ID NO: 25909 - protein, 205 aa, Oryza sativa (indica cultivar-group)
MGAEAVRVLVVDDSPVDRRVVELLLRAHCGGGGGAAAGEAAPFHVTAVDSGKKAMELLGRRRGDRDHLTPSSPAAAAAANDQAIDIVLTDYCMPEMTGYDLLKAIKALGSPNPIPVVVMSSENEPQRISRCLTAGAEDFILKPLKMNDVQRLRKCSGATRPKSAVAGDDDRCCNTAKKAAAAAAATPEQQQQQQRSPHLAGLAMA

SEQ ID NO: 25910 - protein, 134 aa, Brassica napus
MLCLFKRKKKNKEEKIHFQKNGGLLLEELIASSGGIYNPIRTFSSHQILQATNNFDWNSIISEDRFVWYRGMIQNRPVLIKKYQDCSLFDADNFYRDIAVSSLMSSHKNVLKILGCCLEFQHPVLVCEYSQNGA

SEQ ID NO: 25911 - protein, 182 aa, Yarrowia lipolytica CLIB122
FTAKQLNRQANKAAKEEESEKAKVKKAIQQGNQDIAALYAQNAVRKRSERLNLLKLASRVESVASRVQTATTMRSVTGNMAQVVKGMDRAMESMNLEKISMVMEKFEQQFEDMDASASYMESATMAADSQARPQEEVDLLLQKVADEAGLELQHNMEAAPREIQAEAQVEDSLNERLRALRG

SEQ ID NO: 25912 - protein, 409 aa, Zea diploperennis
MQFALALDTNSGPHQIRSCEGDGIDRLEQLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKDAFISDGCLLRECNI

SEQ ID NO: 25913 - protein, 196 aa, Fucus distichus
MQNIKCVVVGDGAVGKTCLLISYTTNAFPGEYIPTVFDNYSANVMVDGKPINLGLWDTAGQEDYDRLRPLSYPQTDVFLVCFSVVDPTSFHNVKLKWIPELQHHAPGIPFILVGTKLDLRDDQDAIKRLAERRQTPISFSEAQGLSSDLEAYRYLECSALTQHGLKQVFDGAIRCVLEQNQRKMKKKKGKKGCVIS

SEQ ID NO: 25914 - protein, 454 aa, Pyrococcus horikoshii OT3
MELKPNVKEIPGPKARKVIEEHHKYMATTTNDPNEYFLVIERAEGVYWIDVDGNVLLDFSSGIGVMNVGLRNPKVIEAIKKQLDLVLHAAGTDYYNPYQVELAKKLVEIAPGDIERKVFLSNSGTEANEAALKIAKWSTNRKMFIAFIGAFHGRTHGTMSLTASKPVQRSRMFPTMPGVVHVPYPNPYRNPWGIDGYENPDELINRVIDYIEEYLFEHYVPAEEVAGIFFEPIQGEGGYVVPPKNFFKELKKLADKHGILLIDDEVQMGMGRTGRMWAIEHFDIVPDIVTVAKALGGGIPIGATIFRADLDFGVSGVHSNTFGGNTVAAAAALAVIEELQNGLIENAQKLEPLFRERLEEMKEKYEIIGDVRGLGLAWGVEFVKDRKTKEYATKERGEIVVEALKRGLALLGCGKSAIRLIPPLIISEEEAKMGLDIFEEAIKVVSERHGYKIH

SEQ ID NO: 25915 - protein, 180 aa, Oryza sativa (japonica cultivar-group)
MAWTAAAATVTRAAATPAAELRLPLAAGLGRASFAVTGRLRRAVSASLSTAAAAVKKEAVQTEKAPAALGPYSQAIKANNMVFVSGVLGLNPETGKFVSESVEEQTEQVMKNMGEILKASGASYSSVVKTTIMLADLQDFKKVNEIYAKYFPAPAPARSTYQVAALPLNARIEIECIAAL

SEQ ID NO: 25916 - protein, 223 aa, Bradyrhizobium sp. BTAi1
MRQRALLFDIDGTLADTDALHIQAFNAVFGRYGHIFDRARAARELLGRSNASIGAEFLPDEPPERRAEIMAQKEAVFRSLAAGEVQPLPGLMTLLDHAEAAAIPVVAVTNAPRANAEMILHGLGIAARFRAVIIGDELPHGKPHPLPYLEGMRAVGAAPDRSLAFEDSRAGITAANAAGLVTVGMRSNLGHDDLIAAGAALTAAAFDEPEVLALVTMRLGAGA

SEQ ID NO: 25917 - protein, 472 aa, Haemophilus influenzae Rd KW20
MPNANAIANVFKLIEENNVKFVLLRFTDIKGKEHGVSIPVSLVDEDMFEDGKMFDGSSVEGWKTINKADMLLMPMAETAIVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKHVVQNVALEHGKTACFMPKPITGDNGSGMHCNMSLSKDGKNIFQGDKYAGLSETALYYIGGIIKHAKALNAFTNPSTNSYKRLVPGYEAPVLLAYSASNRSASIRIPAVTNPKAIRVEARFPDPLANPYLAFAALLMAGLDGVVNKIHPGDAMDKNLYDLPPEELKDIPAVASSLEEALNSLEKDYEFLTQGGVFAKDFIDAFISIKRKEVERLNMAPHPVEFEMYYA

SEQ ID NO: 25918 - protein, 279 aa, Prochlorococcus marinus str. AS9601
MTFNLSSQNFTATLIMRIRSFLAFVISLCITFAFVPVKTFAFSERGNAQFTDVVNTGKANDCPTLDSSLVGSISLGNGDSLKGICMHPTEVYVKVPGTKRKAAEFVSTKIISPRNNTTVTEVYGDIDSGTFTEKGGIDFQLITVLTPGGLEVPFAFSAKDLTADLPSSIEPGTEVSGSTFTPNYRTGDFLDPKARAKNTGVEYAQGLVALGGDDEELAKENIKVDVNGTGVITLSINNVDSDTDEFAGTFEAIQPSDTDMGSKDPLDVKIIGELYGRKA

SEQ ID NO: 25919 - protein, 112 aa, Pseudomonas putida KT2440
MDDLFLKIINREIPADIIYEDDQILAFKDIAPAAPVHFLVIPKKHIRTLNDLTEEDKALAGHILFTAQRLAVEQGCEEGFRVVMNCNPKGGQTVYHIHMHVLGQRQMNWPPG

SEQ ID NO: 25920 - protein, 296 aa, Xanthomonas campestris pv. vesicatoria str. 85-10
MPHADMHCRAMTHTDIPTPLADWIVAQAVAGHPPEQALQPLLDQGWNEQDAIDAVEALVRAHIQQHAQANGLPMPVRVPALQQDADASLLALGDRDVRVLVSLLLPRVVVLGGFLSDEECDALIALARPRLARSRTVDNANGEHVVHAARTSDSMCLRLGQDALCQRIEARIARLLDWPVDHGEGLQVLRYATGAEYRPHYDYFDPDAAGTPVLVQAGGQRVASLVMYLNTPERGGATRFPDAHLDVAAVKGNAVFFSYDRPHPMTRSLHAGAPVLAGDKWVATKWLRERAVRMPG

SEQ ID NO: 25921 - protein, 365 aa, Arabidopsis thaliana
MTKMSKLPNDLLEEILSRSPLYSMRAIRLTCKKWNTLAKEESFTKKQLVQTKAAKEFMVIMMMDSKFCLMNINLNKEEDVEPSIKCNGKIINPIGMCRVYHCGGLVCITKSFSNTRDVVWNPYLGQTRWIKPRSHHAYIYAIGYETKKSCRSYKILSSEHNYINIDDERVDYEIYELDSNSWRALDVNSNWATAFYKMDVSVKGNSYTYTDYRGDFLISFDFTTERFGPTLPLPFHSRCGDIVALSSVREEKLAVLLHRCNISRMEIWITNKIEPNNVSWGKLFLTVDMKPLIIDDGIFFIDEEKKVVVVFDKDKEMRNRITAYIIGENGYFRKVDLGDSESFPVRCSYVPSSVEIKQLAKGKSN

SEQ ID NO: 25922 - protein, 77 aa, Hordeum vulgare subsp. vulgare
MGCDDKCGCAVPCPGGTGCRCTSARSGAEHTTCACGEHCGCNPCACGREGTPSGRENRRSNCSCGAACNCASCGSTA

SEQ ID NO: 25923 - protein, 117 aa, Rhodopirellula baltica SH 1
MNNAIMDMVDKANQKENAPQFDIGDTVDVHSKILEGNKERIQVFTGVVIGRSGKGAQEMFTVRRIVAGEGVERKFPVHSPRIEKVEVKRSGVTRRAKLYFLRDRVGKAVRLKERRRV

SEQ ID NO: 25924 - protein, 625 aa, Ashbya gossypii ATCC 10895
MGSSMNFPSGYVNKHTLQRTKSSGPKIFQKESVAAKSAGSTKSKLSLALQTQGQRQGEDEAAGPEDQQGDGEEDEDYSSCDEKNEESAGDYRPGGYHPAYKGEIYKDGRYTLVRKLGWGHFSTVWLARDNVTGSHVAMKIVRSDRVYTERLERVKLLHKVRSTNLAEQACGGATESAEGPARPVSRSGAHYILNLLDDFVHKGDNGEHIVMVFEVLGENLLALIKKYEHRGIPIVYVKQIAKQLLLGLDYMHRKCGIIHTDIKPENVLMEIGDVEGIVRMMEQLDKQKRELRKLQRRASRSVFDSPPVRENTSCTGSISNSITETSTSRRARRHTLITGSQPLPSPLSSNNFMELKTQLMGQPMGTISRQPSMSGRSFSLQTLGGATTTLGSSVQKPAESDHDISNSFSSMEIEDHGNSSGNTEVGQVIQIKIADLGNACWYDEHFTNAIQTREYRSPEVLLGCPWGCSADIWSTACLIFELLTGDFLFEPNQGHSYTKDDDHIAQIIELLGNIPSYLFDHGKYVKNFFFSDGKLRNIKKLRFWPLKDVLIEKYGFETSAAEEVSGFLLPMLEMDPRKRADAGGMVNHPWLSDTVGMETVTASDRVLYASGADIPGWFKEDSRHG

SEQ ID NO: 25925 - protein, 181 aa, Mesorhizobium loti MAFF303099
MDIIRQLEAEQAAKIEAKRKLPEFQPGDTVRVQVRVTEGTRTRVQAYEGVVIARAGSGFQENFTVRKISYGEGVERVFPVFSPMVEGVEIVRRGKVRRAKLYYLRDRRGKSARISENTGVRARKLNDEERDALNAEKARIEAEKVAAAQALAAETAAKEAAEKKAAAEAEAAKAAEATPAE

SEQ ID NO: 25926 - protein, 525 aa, Ashbya gossypii ATCC 10895
MAAVEQVSSVFDTILVLDFGSQYSHLITRRLREFNVYAEMLPCTQKISELGWKPKGVILSGGPYSVYAADAPHVDRAVFELGVPILGICYGLQELAWIAGAEVGRGEKREYGRATLHVEDSACPLFNNVDSSTVWMSHGDKLHALPADFHVTATTENSPFCGIAHDSKPIFGIQFHPEVTHSSQGKTLLKNFAVEICQAAQTWTMENFIDTEIQRIRTLVGPTAEVIGAVSGGVDSTVAAKLMTEAIGDRFHAILVDNGVLRLNEAANVKKILGEGLGINLTVVDASEEFLTKLKGVTDPEKKRKIIGNTFIHVFEREAARIQPKNGEEIEFLLQGTLYPDVIESISFKGPSQTIKTHHNVGGLLDNMKLKLIEPLRELFKDEVRHLGELLGISHELVWRHPFPGPGIAIRVLGEVTKEQVEIARKADHIYIEEIRKAGLYNKISQAFACLLPVKSVGVMGDQRTYDQVIALRAIETTDFMTADWYPFEHEFLKHVASRIVNEVEGVARVTYDITSKPPATVEWE

SEQ ID NO: 25927 - protein, 371 aa, Candida albicans SC5314
MPIPASMKAIVFYAPYDVRTEERPTPKIKDPKDVIVKVRYSGLCGTDLHSYRGHIKGPVGTIIGHEFVGTVVATGDNITKFSIGDDVISNFSIECGECWYCKHGYSGQCNVTNTFGKVGLDGGQAEYVRVPYAETTLTKKPSTTNSNDDVDDSVYVLMADIFTTGYYGVKKIKDFLSISAAEGIKPQSFEETTILQLGAGPVGLCALRILKYFGFGKVVVVDNVPSRLEEAKRLGATEVINFETEPDGIKKYITEETDGVGFDAVLEVVGSAAAHKTSFDAVRRNGFISSIGMGHEPFPFNGLDVYLKNINMSFGRCHSWSLFPESLAIFEEMKGDLASFIDYKAKLEDSKEAFDMFDKHKVKKIVFDLTS

SEQ ID NO: 25928 - protein, 279 aa, Arthrobacter ilicis
MTMTYAGTTALITGASSGLGAEFAGQFAARGSNLVLVARRGDRLEELAQELRSRHGVTVTVLPKDLGLAGVGRELFDELAGRGISVDTLINNAGFGTHGPLIEEDPETIASEISLNVAALVDITRAFLPELLASGKGALVNVASTAAFQPIPGMAVYGATKAFVLSFTEAVAHETKKSGLTSWPFAPVQQEQNSSMCSAVTPQQWARCRPLHRLWALLSRPSTARTHPAAWSRAGLTALRPDSRSVCPGPSPSPSLHALYRTGRTGRKGSSVPRLRNSG

SEQ ID NO: 25929 - protein, 1219 aa, Oryza sativa
MEPRRDDVRSAAQSTIHGSSSSAPTSSPVPDYPISGSVKPVLNYSIQTGEEFALEFMRDRAIPKKHLVSGMSHDQNVASGAGLKDPRGLLGAHRTGAESRFDAAIFLTTDIQQTEGIERKSFAENENRSRHVSTSSVPRIPSRSGSSQRLSHGYASSESSDSSRRIKILCSFGGKILPRPSDGKLRYVGGETHIIRISRNISWQELKQKTTAIYNQPHVIKYQLPGEDLDALISVSNDEDLRNMMEECGFLDNGEGSQKLRIFLVSSIDFDDMSFSLGSMDSDSGIQYVVAINGMDVGTTKPSSGHGLGNTSINELDQFINLNNDSNQPNSSRDGSNLYSMSASTAVPPALISVPLPVTLSSDSTANLYPYHSHGMQHVQGSDYSLPASSERFYDIEGQTSIPLSVPSGYRYTSQCTPYSGTTSLQSFDQQSYHDSMMEGSMKEEKQPSVRVPLQKNDLDYFQSLENMSVPVIHHDSSSTNYMNSDVPVTTSIQEGLKSSLQPSDSAKSLETYTASKAMSAAQDSECNEDDRHSSGAFASGCSDFQVDMMDHSNKNPPPHSGRVFHSERIPREQAGSLNRLSKSDDSLNSQFLILQSQSGVAKESIAEASDPAIEGTEKSNLDARAINLNDPATVDSVTPEKECANTVQQTSTFSEQLLGEKRSSTDMSTRNVEKNMHAAENAVAKCNLNDATSDGTKIVNQQADHSAVPHHVSWDTPNPAIPTDVGCDPFVPSTSSLDDSHKEPIIPKKDNKDIVGGMSERTSPDILSDFFANTAAQSLSPFNEPVLSLNMHNYEPQRWSFFRNLAQNEFEHKNKEQDLAKIEEGVYPLVHAEHDAVNVKNVAPQNDVHLETYPVSSGINLDSSILPPGFISSQDNPPMTKNVEGFQVDNPYTNMHEMMPSVPEFEEPKFEEGKAVGPVMDASFKDNNFEYLQIIKNEDLEELRELGSGTFGTVYRGKWRGSDVAIKRIKKSCFTGRSSELERLANEFWREAEILSKLHHPNVVAFYGVVKDGPGGTLATVTEFMVNGSLRHVLQRKDKYLDRRKRLIIAMDAAFGLEYLHSKNIVHFDLKCDNLLVNLKDQSRPICKVGDFGLSKIKRNTLVSGGVRGTLPWMAPELLNGSSNKVSEKVDVFPFGIVMWEILTGEEPYANMHYGAIIGGIVNNTLRPPVPASCDPEWRRLMDQCWAPDPSQRPAFTEIAGRLRAMSVAANQAKAASK

SEQ ID NO: 25930 - protein, 469 aa, Pseudomonas syringae pv. phaseolicola 1448A
MSETTAPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPDIPSWVSAAAFFILINAINLTNVKVFGETEFWFAIIKVVAIIGMIALGSYMLVSGSGGPQASVSNLWEHGGFFPNGVGGLVMALAIIMFSFGGLEMLGFTAAEAEQPKTVIPKAINQVIYRILIFYIGALVVLLSLTPWDSLLASLNASGDSYSGSPFVQVFSMLGSDAAAHILNFVVLTAALSVYNSGTYCNSRMLVGMAEQGDAPRALAQVDRRGVPVKAIFASAAVTVVAVLLNYFVPQQALELLMSLVVATLVINWAMISYSHLKFRQHMNRTAQVPLFKALWYPYGNYVCLAFVLFILGIMLMIPGIQISVYAIPVWLAVMWVCYRAKNRRSVVMNAETGK

SEQ ID NO: 25931 - protein, 393 aa, delta proteobacterium MLMS-1
MKNIRDIDIRGKRVLIRVDFNVPIDEQGNITDDIRIRGVLPTINHALDENAAVIICSHMGRPKGERRPEFSLAPAARRLSRLLDKEVKLAPDCVGPEVAEMAAALAPGEVLLLENLRFHPEEQANDEKFSRELAALAEVYINDAFAVAHRAHASVVGIPRFAPAKGAGFLLQKEMDYFHRSVGNPMRPLAAIIGGSKVSSKLGALTNLMDRVDKMLIGGAMANTFLRSQGLDVGRSKVEDDLLETARELIAKAHERGVKLYLPVDCIVAPELDAKAETKRVTCQEIPATWMALDIGPATTMLFTEALDDAKTIIWNGPMGVFEVDAFSRGTMAMVQTLTRSHALTIVGGGDTDVAVHRAGESANISYISTGGGAFLMLMEGKTLPGVAILEEG

SEQ ID NO: 25932 - protein, 178 aa, Archaeoglobus fulgidus DSM 4304
MAAMRILIFGDTHIPERADEIPREFTDYLVDFDMVVITGDLTSERVLRFAERVAESVIAVRGNMDDLPLPHSAKFRVEGLSFGVVHGHQVYPRGNREQLEQIALEMDVDVLISGHTHLPDVYRGAKILLNPGSMTGVWGGGAYSTYPSFMVLEVKKGSFRGSLYRLLDEEVTVEQFSF

SEQ ID NO: 25933 - protein, 250 aa, delta proteobacterium MLMS-1
MRTPLLAGNWKMHLDQAAAAELAAAVANVAAACPEREVMIAPPFTALAAAGQAAGQQVILAAQNVCWEAQGAFTGEIAPPMLRELGCGMALVGHSERRQLFHEDNAMINRRLGGALAHGLVPVLCIGETLAEREADRTMEVLASQLREGLAGISLDDPRRLVVAYEPVWAIGTGKTAGPEQAQQVHRFVRGLLAELYQKNIADGVRILYGGSVNAANVDSIMAQPDVDGALVGGASLDIASFERIIRFQV

SEQ ID NO: 25934 - protein, 318 aa, Haemophilus somnus 2336
MMSKTLTVLGSINADHVISVPHFAKPGETLSGKQYHIAYGGKGANQAVAAARLADFSQGATVNFVGCIGSDDIGRAMKKAFAQDGINVATITEIPNEMTGIAMIQVADSGENSIVISAGANAYLTPEIVDKFATEIERADYLLMQLETPLNAILEAAKLAKKHGATVVLNPAPANQLPDELLSLLDMITPNETETEILTGVKVTDEQSAAKAASVLHQKGVATVLITLGSKGVYVSRKSSTQELGQNKVIAGFRVNAVDTTAAGDTFNGAFLTALLENKSLDEAIRFAHAAAAISVTRQGAQPSIPTRRETLDFLAQH

SEQ ID NO: 25935 - protein, 419 aa, Archaeoglobus fulgidus DSM 4304
MFSTSDGILTVEGVKVTEIVRETGTPVYVTSRALLERNLEAYKKAFSNEGLLYAVKANNNLALMRIIASHGFGADVFSDGELYLASLAGFRKDMVLFNGNSKSRKEIEMGVTAGVKFSVDSLDELRTISKIAKEVGKEVEIAFRVNPDVDPKTHPKIATGLRESKFGIPHEMVREAYEMALKLDGVVPVGIHCHIGSQILDLSPFVHALNKVMDIAVDIEKLGVELSFVDMGGGLGIDYEGKGAPTPKDLASAILPEFEGRKADLTSDPQLWLEPGRSIVGNTTVLITRVNAVKKGYKNFVAVDAGFNVLIRPAMYGSYHRVAVANKMDAEPEEVYTVVGPICESGDVLARDRKLPKVEVGDLIAVFDAGAYGFVMSSQYNGRPRCAEVLVSGDRWDVIREKESYGDLIEKQRLPEWLL

SEQ ID NO: 25936 - protein, 590 aa, Bradyrhizobium sp. BTAi1
MCGICGEVRYSSPPLLHALSRMNDAMQARGPDAAGLYVQGGVALGHRRLSILDLSAAAQQPMIDAAFGLGIVFNGCIYNFRELRTELQAKGYRFFSDGDTEVILKSYHAWGKGCVQRFKGMFAFALWERDSGRVVLARDRLGIKPLYYAEGAGFFRFASSMPALLAAGDVDTSLDPTALHHFFSFHAAVPAPRTILNGVKKLAPATLLTIDPDGTQHRERYWSFNVGEQRPTDRAMSQEEWSDALLDEMTVAVDRRRVADVPVGVLLSGGLDSSLLVALLSKLGHQDIRTFSIGFDAVDEHSGDEFRYSDIIARTFGTDHEQIRIGGDRALEALPNAIAAMSEPMVSHDSVAFYLLSSEVAKRVKVVQSGQGADEVFGGYSWYPGFLAANDAVHQYQNAYFDWQHGDLRRLLAPDLLGDDVSLELVERFFADHAGVSAVDKVLQIDTEIMMVDDPVKRVDNMTMAFGLEARVPFLDHEVVELAARMPAELKVTHGGKHILKEAARRCVPAEVIDRPKGYFPVPSLRYLRGPFLAYVRDVLSDEKARSRGLYQRDFIDHMLQNPEAEMSPKGHSRLWQAGLLEAWLQTHGL

SEQ ID NO: 25937 - protein, 372 aa, Leptospira interrogans serovar Lai str. 56601
MSERSYYDILGVSKSANDEEIKSAYRKLAIKYHPDKNKGNKESEEKFKEATEAYEILRDPKKRQAYDQFGKAGVSGGAGGFGQGAYTDFSDIFGDFGDIFGDFFGGGRSSGFGGGRRSGPQRGSDLRYNLEVSLEDAALGREYKIEIPRLESCVDCNGSGASKGSSPATCPDCGGSGQIRRTQGFFSVATTCPTCRGKGTIISNPCRSCGGQGLQEKRRTINIKIPPGVETGSRLKVSGEGEAGPNGGPHGDLYVVTHIKKHELFERQGNDLILVRKISLAQAILGAEIEVPTIDGKKAKMKIPEGTESGQVFRLKGHGMPYLGAYGKGDQHVIVKIEIPKKITRRQRELIEEFARESGENIPGSKGKIFTK

SEQ ID NO: 25938 - protein, 512 aa, Glycine max
RPLSLSLTELTSYVLCFIILLLLLEQISYILKKASIPGPSFVLPFIGNAIPLVRDPTNFWDLQSSFAKSTPSGFSANYIIGNFIVFIRDSHLSHKIFSNVRPDAFHLVGHPFGKKLFGQHNLIYMTGQVHKDLRRRIAPNFTPKALSTYTALQQIIILNHLKSWLNQSQAPDSHSIPLRILARDMNLQTSQTVFVGPYLGPKARERFERDYFLFNVGLMKLPFDFPGTAFRNARLAVDRLIAALGTCTEMSKARMKAGGEPSCLVDYWMQDTLREIEEAKLAGEMPPPFSTDVEIGGYLFDFLFAAQDASTSSLLWAVALLDSHPEVLAKVRTEVAGIWSPESDELITADMLREMKYTLAVAREVLRFRPPATLVPHIAAESFPLTESYTIPKGAIVFPSVFESSFQGFTEPDRFDPNRFSEERQEDQIFKRNFLAFGAGPHQCVGQRYAFNHLVLFIALFTTLIDFKRDESDGCDDIVYVPTICPKDDCRVFLSKRCARYPSFPSVEDFVK

SEQ ID NO: 25939 - protein, 495 aa, Glycine max
MSLYDAAFVDTELSKRTSIFGLRLWVVIGILVGSLIVITLFLLSLCLTSRRRHHHHHHKNPRPRHPSTTLPTPPISKEILEIVHVPPPPDTVHLPPPPPTKPDHPRSAATAALYSSGESRATASACETASSLGSVGPEVSHLGWGRWYTLRELEAATNGLCEENVIGEGGYGIVYRGLFADGTKVAVKNLLNNKGQAEREFKVEVEAIGRVRHKNLVRLLGYCVEGAYRMLVYEYVDNGNLEQWLHGDVGPVSPMTWDIRMNIILGTAKGLAYLHEGLEPKVVHRDVKSSNILIDRQWNPKVSDFGLAKLLSADHSYVTTRVMGTFGYVAPEYACTGMLTEKSDVYSFGILIMELITGRSPVDYSKPQGEVNLIEWLKSMVGNRKSEEVVDPKIAEKPSSKALKRALLVALRCVDPDAAKRPKIGHVIHMLEAEDLLFRDDRRTGGESSRSHRDYQLEHKDSKLDKRQIGGEITDQSEDDSTTSSRLHPQPHRSR

SEQ ID NO: 25940 - protein, 141 aa, Haemophilus influenzae Rd KW20
MMTERTFSIIKPDVVKRNLIGAILTRFEQNGFKIIASKMVRLTREQAEGFYAEHQGKEFFVPLVEYMMSSPIVVSVLEKENAVKDYRTLIGTTNPETAAEGTIRKDFALSQRENSVHGSDSIESANREIAYFFTNSEIFER

SEQ ID NO: 25941 - protein, 134 aa, Zea mays
MRKHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEECASA

SEQ ID NO: 25942 - protein, 911 aa, Kluyveromyces lactis NRRL Y-1140
MKSDFKFSNLLGTVYRQGNVLFSQDGSKLLSPVGNRVSVFDLINNTAFTFEYEHRKNVAVVDINKQGTLLLSIDVDGRGILANFKTRNVLHHFNFKEKVYDLKFSPDGKLFALACGRFLQIWRTPETTEDRQFAPFVRYRIHAGHFSDITSLTWSKDSRFIISTSKDLTARIWSVNSEEKNLASTTFAGHRDNVIGAYFSDDQEKIYTVSKDGALFQWEYTKKPGEGEDNDEDEEDVDLSKYSWRITKKNFFHANRAKVKCSAFHAASNILTVGFSNGEFRLYELPEFIMIQQLSMGQNAVNTVAINSSGEWLAFGSSKLGQLIVYEWQSESYILKQQGHFDTLNGLCYSPDGSKIVTASHEGKIKIWDVASGFCLATFDEHAGGVSAVEFAKKGQVLFSASLDGTVKAWDLIRYRNFRTFTATERIQFNSLAVDPSGEVVCAGSEDSFDIFVWSVQTGQLVDTLSGHEGPISCLSFSNENGVLASASWDKTIRVWSLFGRSQQVEPFEVFSDVLSISMKPDGQQIAASTLAGQILFFDVAEGKQVGNIDGKRDIISGRHLEDRFTSESSARSKYFTTIHYSFDGLSLVAAGNNNSICLYDIPNEVLLRRFTVSKNMMLNGTMEFLNSSRMTEAGSLDLIDQDAENSDLEDRVDNSLPGSNRGGDLSTRRVRPAIRVTSIRFSPTANAFAAGSTEGLLVYSVDNTILFDPFDLDVDVTPQNVIQSLDDKEYLNAILMAFRLNEGYLIHRVYENIPIKDIPLIAHELPVVYVSRILKFIGEYALESQHLEFNLLWIKSVLTAHGKYISTNKHQFSSALRAVQRFIGRMANDVVQTYKRNKYTLDFLTNTDGSSTNAVDEDMNLLGNDSDNESEDKEDINMDDDLDGGEWVGFEEKTINLPVNDEDSDDEILL

SEQ ID NO: 25943 - protein, 238 aa, Triticum aestivum
MNFSVGAGGSGDGGGEGGRVQAERWLEIAAKLLAARDLVGCKRFAERAVEADPLLPGADELLAVADVLLTSQAMLYTGEPDPFAVLQVPSKTTDHGAISRAFRRLALLLQSSNPHPGADVALRIVNDAYELLSDPSRQPLRSARTNIPSGAPSHPAAAAAPAAEATDFWTACPFCCYVHQYPRELVGRALKCPNESCRRGFVAVEIPTQPTIVPGTEMYHCAWGFFPLGFPNSADLGG

SEQ ID NO: 25944 - protein, 831 aa, Euglena gracilis
MALLGNKNESTFKWVAMGVGAGVVAAVLLSATHDNALYTVPATRVTSISAVNPVTYQRVNFDNVLQAAPSASVENQSEIYAASGHNVTGLAAVLALPLAAAVGFLFGRSKKSTVAMATYSGKPIEVVSLGEKPQLPKAERRSTALQGAHAGLIINRTGPMTDDELCVNTIRFLAVDGVNKANSGHPGAPMGQAPIAHVLWNEEMKYNPKNPYFVNRDRFVLSSGHGCMLQYALLHLTGYDDVTLDQLKSFRQWGSKTPGHPENFETRGVEVTTGPLGMGISNAVGLAAAEAHLAAVYNKPGHTLIDHYTYTIAGDGCFQEGISHEACSYAGHLKLGKLIAFYDDNNITIDGETSLSFTEDVAKRYEAYGWQVLKVADGNTDVNGIRKAIAQAKAEKNKPTLIMVKTVIGYGAPTKANSHDAHGAPLGKDEAAAARKNLGWEFGEFEIPEQALNTFRQAIPRGAAVEAEWNKRFEAYKQAYPELAKQFQDTVLDNKLPEGWEKALPTYKAEDKAFATRINSQKCINALAPVLPGFMGGSADLAPSNMTLMECTGDFLAGQYENRNFRFGVREFGMGAVANALALHKSGIIPYCATFLIFSDYMRNAIRIAALSQAGTIFVMTHDSVALGEDGPTHQPVEIIASLRLIPQLAVVRPCDGNETSGAYKMAVLRSNGIGKPGISGRPKTFPTLLALSRQVLPNQKGSSIDAVAKGGYTIQDCEGKPDLILIGTGSEVQLCIESAAALAKEGKKVRVVSMPCTEFFDEQPKEYRDSVLIPGVPAVSVEAGVTAGWQKYSHAQVGIDSFGASAPGDKCMKEFGMTVENVVATAKSLL

SEQ ID NO: 25945 - protein, 330 aa, Triticum aestivum
  misc_feature (198)..(198): Xaa can be any naturally occurring amino acid
  misc_feature (300)..(300): Xaa can be any naturally occurring amino acid
  misc_feature (319)..(319): Xaa can be any naturally occurring amino acid
  unsure (1)..(330): unsure at all Xaa locations
MAKFGEGDARWIVQERADGANVHNWHWAERDCLDWSRALLSKLLAGLPVLSGEGGLTLRTTTLDKLDGEAYVNIRKGKVIPGYELSLTLAWEADATTESGLVKVTGTAEVPYLADENADEDPELRITVRGDDGPLARRAKDAFIAHGKPLVIAKIRDYVAAMANGGPAKDGIDSKKISTKAAPAAGGAAVAPAPSVKXQQRPVQAPAAKEKKANGKDKEGFKTIEMTEKFNCRSKDIYEILMDDNRWNGFTQSNARISKDVGGQFSLFDGVITGVNEELQEWKLIVQTWRVGTWADGVHXTVRLVFDDPESGVTILSSXTDLPEGRKFGN

SEQ ID NO: 25946 - protein, 370 aa, Arabidopsis thaliana
MDSTATVASDRLSQLNSFEETMTGVKGLVDSGIKEVPAMFREPPAILASRKPPLALQFTIPTIDLNGGVVYYKNQDSVTRRSMVEKIGDAAEKWGFFQVVNHGIPLDVLEKVKEGIRAFHEQDAELKKRFYSRDHTRKMVYYSNLDLFTAMKASWRDTMCAYMAPDPPTSEDLPEVCGEIMMEYAKEIMNLGELIFELLSEALGLNNSNHLKDMDCSKSLVLFGQYYPPCPQPDHTLGLSKHTDFSFLTIVLQGNLGGLQVLHDKQYWIDIPPVPGALVVNLGDLLQLISNGKFISVEHRVIANRAAEPRISVPCFFSTVMRESHRVYGPIKELLSEQNPPKYRDTTISEFASMYASKEINTSALLRLEI

SEQ ID NO: 25947 - protein, 471 aa, Burkholderia sp. 383
MNQRQGFDAIVEREKGLHRGLSTGQLSMIAIGGAIGTGLFLGSGFAIGFAGPSVLVSYAIGALIALLLMGCLAEMTVAHPTSGSFGAYAEHYVSPWAGFLVRYAYWASIVFAVGTEVTAIAVYMKYWFPAVPGWYWIVGFSAALIGINLVSVKVFGAVEYVFSMLKIAAIVAFIALGAVVVFGAPAGSGIGFANYTAHGGFFPKGVWGMWVAVIVSIFSYLSIEMIAVAAGEARDPHQAITRAFRATMVRLVFFYLLTLALMLAIVPWTAAGADESPFVKVMAATHVPGAAGVINFVILVAALSAMNSQLYITTRMMFSLSRAGYAPKALGRLTGHGVPAAALGLSAIGIALATVLNVLYPDTSFVMMMSVSMFGAMFTWLMIFVTHLFFRRHHRGQVLAFRMWGFPVTSLLGAALMFAALVTTYFTREFRMTLFCGVPFMIVLSVVYAVWYRGKGAEPAAGREGVHVPGQ

SEQ ID NO: 25948 - protein, 144 aa, Zea mays
MAQGTLEVLLVGAKGLENTDYLCNMDPYAVLKCTSQEQKSTVASGKGSDPEWNETFVFTVSENATELVIKLLDSDGGTDDDSVGEATIPLDGVYTEGSIPPTVYNVVKDEEYRGEIKIGLTFTPEEARDEDQPEENYGGWNQSS

SEQ ID NO: 25949 - protein, 143 aa, Burkholderia sp. 383
MSQDHSIQGRVVPGKATPRGRFPHITRAGDFLFVSGTSSRRPDNTIAGASADALGTVQLDIREQTRTVIENIRDILRSEGADLSSLVEISSFLVNMNDFAGYNAVYGEYFDETGPTRTTVAVHQLPHPHLLIEMKAIAYAPKK

SEQ ID NO: 25950 - protein, 204 aa, Triticum aestivum
  misc_feature (37)..(37): Xaa can be any naturally occurring amino acid
  misc_feature (167)..(167): Xaa can be any naturally occurring amino acid
  unsure (1)..(204): unsure at all Xaa locations
PASSSPPDNTLPWPPAVMASSATTVAPFQGLKSTAGXSPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRXQVQCVSFIAFRPAGLRGVRQGLNYELKQWPISYEGLL

SEQ ID NO: 25951 - protein, 174 aa, Triticum aestivum
  misc_feature (88)..(88): Xaa can be any naturally occurring amino acid
  unsure (1)..(174): unsure at all Xaa locations
MVYHSSFSDDDGITKACGCPLLPLKTHIKGPAPASDSDKADIVDEAITFFRANVFFKNFHVKSLADKLLIYLTSYINIALKRLASGRXAGVGTKAIINLGLEKVPVPGEPGFPFPGLFTLPQSGEEAELLRNYLKQIREETSGRLLNCAYRANGTPNKWWLAFAKRKFMNVVIL

SEQ ID NO: 25952 - protein, 329 aa, Chlorobium tepidum TLS
MRRRPATIKRSTLMGFLSKIFGKKEVELKRPQVREDAALIKTLVGHEDRVLGVRFSPDGKKLVSGSFDEKVKLWDVETGNAIHTMSGHTTWVKCVDYSPKGDKVASGSIDSTVRIWDVATGQCLHVCKGHDTEVRMIAFSPDGKTVASCSRDTTIKFWDTETGNEVKTLFGHKSYIECIAFSADGKKLVSCGEEPVVKIWDLETGKNIANYPTGDTLSHFVSFSPDGSQIALCGRDAKVKVLDAATGQMLKVLEGHEDGVRALCYNPAGTLIASAANDESVRLWDVAKGALVHTYRGHTHEVQSVAFSPDGKVIASGSDDFKIKLWGVV

SEQ ID NO: 25953 - protein, 468 aa, Mesorhizobium loti MAFF303099
MAYDVVIIGSGPGGYVCAIKAAQLDLKVAVVEKNATFGGTCLNIGCIPSKALLHASEMFAEAGHSFDTLGVEIPAPKLNLTKMMAHKDATVASNVNGVAFLFKKNKIDSFRGTGKVVAAGKVSVTGEDGKVEEIETKNIVIATGSDVAGIPGVKVDFDEKIIVSSTGALSLDKVPGHLVVVGGGVIGLELGSVWARLGAKVTVVEFLDTILGGMDGEVSKQFQRMLSKQGFEFKLGAKVTGVAKAKKGATVTFEPVKGGAAETIAADVVLIATGRRAYADSLGLKEAGVEVDERGRVKTDGHLKTNVPGIYAIGDVIAGPMLAHKAEDEGVAVAETIAGQAGHVNYEVIPSVVYTSPEIASVGKTEEELKKAGIDYKVGKFPFSANGRARAMLHTDGFVKILADKASDRVLGVHIVGFGAGEMIHEAAVLMEFGGSSEDLARTCHAHPTMSEAVKEAALATFFKPIHI

SEQ ID NO: 25954 - protein, 67 aa, Oryza sativa
  misc_feature (21)..(21): Xaa can be any naturally occurring amino acid
  misc_feature (27)..(27): Xaa can be any naturally occurring amino acid
  misc_feature (30)..(30): Xaa can be any naturally occurring amino acid
  unsure (1)..(67): unsure at all Xaa locations
MAAGAPAGAHNRCVFVGNIPXDATEEXVRXIWEEVGRVVSLRLVIDKEKGKHQGYGFREYRRRRTGP

SEQ ID NO: 25955 - protein, 648 aa, Oryza sativa (japonica cultivar-group)
MAVAVLDRSFSSEYPASSRTEGRSCSWKRVFVQTENGYVLGIELERGENAHTVKKKLQVALKVPTEESSLTFGDLVLNNDLSSIRNDSPLLLRKNQMHRSSSTPCLSPTAHDVQEQDHSEPIEILGCLSPSSRMKQLAKDVVEAIRNGVDPVPVNSGMGGAYYFKNIYGERVAIVKPTDEEPFAPNNPKGFVGKTLGLPGLKRSVPVGETGLREVAAYLLDHDNFANVPPTMLVKITHSVFNVNDTVSCKSKVFHNKLQAVSKLASLQQFIAHDYDASDHGTSSFPVSAVHRIGILDIRIFNTDRHAGNLLVRKLGPGPDNFGVQTELIPIDHGLCLPESLEDPYFEWIHWPQASIPFTEEELEYIANLDPVKDAEMLRLELPFIRGACLRVLVLSTIFLKEAAAFGLCLSEIGEMMSRQFTGKEEEPSELELLCMEARKWVKKRELFLPEAGVEDDNDGITQFSIDSEDGSDASELPSFSKFGLMNASHRNPLSKLDECDEEDGEEEEDDDGDEEDDDEDMFKDDAGNLKNPFSKHIPSVSKLSASFKGLGFIGKARAYHKGVPKNKVTAKTNYSGKGSEHQSGSRSANELLPPSASFVKLSDMGSDEWSAFLDKFQELLPSAFRARKHAAADGPRPLQRLGTSCQF

SEQ ID NO: 25956 - protein, 453 aa, Ashbya gossypii ATCC 10895
MLAFTRIAPKVRTLASVARMQLRTYASYPPHTIIGMPALSPTMTQGNLAVWTKKEGDKLSPGEVLAEVETDKAQMDFEFQEEGFLAKILVPEGAKDVPVNKPIAVYVEEEGDVAAFKDFKVEESAAESKDAPAKEEAAPAKAAPAAAAPAKAAKKSTGSAASGGRIMASPLAKTIALEKGISLKEVTGTGPNGRITKEDVEKYLAKAPKKTESAAAPAAATYEDVPISNMRRVIGSRLLQSCQSIPSYPISSDISVAKLLKLRQSLNAAGKDQYKLSINDILIKAIAGAAKRVPEANAYWLEDQGVIRLFKNVDVSVAVATPTGLITPIVKNAESKGLRSISAEIKELGKRAKENKLAPHEFQGGTICISNLGMNNAVSSFGSIINPPQSTILSIGTLRRVPVEDAGAEYGFTFEDRMNITGVFDHRTIDGARAADFMRELKNIIENPLELML

SEQ ID NO: 25957 - protein, 107 aa, Actinidia deliciosa
GMVGGMLLHLRSLRKFEHSGGWIKALLEEAENERMHLMTMVELVKPKWYERILVLTVQGVFFNAFFALYLLSPKLAHRVVGYLEEEAIHSYTEYLKDIDSGKIENVP

SEQ ID NO: 25958 - protein, 206 aa, Pyrococcus horikoshii OT3
MMLMPAKVVGEDKVKKQPSFVKPWLGLKYLFKKPVTIKIPDEKIEPAPKYRGFHTLDWKKCIGCNFCGQICPARAIEMTWIEVNGKLEKRPHPKIDYGRCTFCQFCVDVCPTGALGFIESYILTTTGKEEELQLFDWVPLPPDKFKELQDEYGDWRFPIERIEFNKETKEVTYYLRNGETFKFKIVGYGLKPPKPPSKPQQEKKEG

SEQ ID NO: 25959 - protein, 394 aa, Pyrococcus horikoshii OT3
MIIMVTQEELIREARQNGMELYPINRDTYELFFGPQHMATENFSIILKMDGNRVVKAIANPGFLHRGFEKLAEFRPWYTNIALLLRICVPESDVPEAIYSMAVDEIIGWEVPERAQWIRTLVLELARVSAYLFWIMGLSFKLGVYTAGQWAAAYRERIMRIFEELTGARVYHIFTIPGGVRRDIPGDKWLRQVRDTVEYIRSKLPDFDNILFENYITYRRMEGIGVMDKKFALAEGVTGPNLRATGVAYDVRKDDPYLFYSEVEFEVPTLKEGDALARALVRRYELEQDLYIIEQLLEMGPPSGPYKVEDPRLKNLPRFKVPAGDAFAHVESTKGDFGAYVVSDGGNKPYRVHVRGPSIAHGIRVLEKLLVGARIADVPIILMSLDNCPPDIDR

SEQ ID NO: 25960 - protein, 391 aa, Pseudomonas syringae pv. syringae B728a
MQQRCNVAVLGLGAMGAATAYQLAKAGVDVIGIDRYDPPHTQGSSHGDTRITRLSAGEGPQYLPLVRSSQHIWRELEALSGESLFEQCGVLVMTSSPAYDPEDVNDFTHQTIALARTHGVKHEVLAAAAIRERFPQFSPVLDSAIGYFEPEGGFVRPERCIAVQLKLARQHGARLLTHETVTHLQAHGDQVRIITDKGSIIANKVVVSAGMWSSGLLGAPFSDLLRVCRQKLFWFELQHEAVFAAPSPSFILSHGPGEADVNYGFPPLPGENSMKVATEQYLETSAADRLDRTITAWEEQEMFRTQVQGRIAGLTPKVVKSSVCAYTVTPDCHFIIDEHPHLKNVTVVSACSGHGFKHSAGLGLALAQRCIDGESDVDLSAFSLQRFARQA

SEQ ID NO: 25961 - protein, 329 aa, Haemophilus influenzae Rd KW20
MKKQDLMSIDEIQKLADPDMQKVNQNILAQLNSDVPLIGQLGFYIVQGGGKRIRPLIAVLAARSLGFEGSNSITCATFVEFIHTASLLHDDVVDESDMRRGRATANAEFGNAASVLVGDFIYTRAFQLVAQLESLKILSIMADATNVLAEGEVQQLMNVNDPETSEANYMRVIYSKTARLFEVAGQAAAIVAGGTEAQEKALQDYGRYLGTAFQLVDDVLDYSANTQALGKNVGDDLAEGKPTLPLLHAMRHGNAQQAALIREAIEQGGKREAIDEVLAIMTEHKSLDYAMNRAKEEAQKAVDAIEILPESEYKQALISLAYLSVDRNY

SEQ ID NO: 25962 - protein, 551 aa, Ustilago maydis 521
MTASTSNVSSSNSKLKKSKASSPSASPEVSTPSTSNSNDDQDGHVSEDMSDAEEGESQEHSASGSGISDHDDDDDPSADKDSPAADEEQDEKKVATIADDGKKVEFSDLGVIPQIVEACTNMGFKHPTPIQVKAIPEALQARDVIGLAQTGSGKTAAFTIPILQALWDNPKPFFACVLAPTRELAYQISQQVEALGSTIGVRSATIVGGMDMMSQSIALSKRPHVIVATPGRLQDHLENTKGFSLRGLQYLVMDEADRLLDMDFGPIIDKLLQSIPRERRTMLFSATMTTKVAKLQRASLKNPVRVEVDTKYTTVSTLKQHYMFMPFAHKDTYLVHLANEQAGHSIIVFTRTVHDSQRLSILLRLLGFPAIPLHGQLSQQARLGALNKFKTGGRSILVATDVASRGLDIPAVDLVVNYDIPTNSKDYIHRVGRTARAGRSGRSVTLVTQYDVELLQRIEAVIGLKMTEFPGGNDKEAVMLLSERVAEAHRAAVRELKDKGVGSAGGSGKRKRKMDGKYGDDMDRDDDQVQAGLPVSGNGRHQNQNRKKGRR

SEQ ID NO: 25963 - protein, 308 aa, Mesoplasma florum L1
MKKILTMGSIGVDHVFNVDKLPNKGQSIISKNFNIFFGGKGANQAVAAAKLGADVKYIGHVGNDDAGLHAIENLVKNKIDASYIKKINNINTQVANIIVDDKGDNLLIVDTGANFTFLKDEINEYKELIDHSDILLTQLETNLEFVEDFINYGHSKNKLIILNPGPAKVISNKIIEKCDFITPNESEICILLGKEYTENYELLKKYAYELWDINKKNVIVTLGENGSIWIDEKGELHKFEAYKVKAVDATACGDTFMGGISAYLAQDKTIEEAIKFATAAASLAVTKMGAQSSLPELKEVHEFIKKNG

SEQ ID NO: 25964 - protein, 366 aa, Mycobacterium smegmatis str. MC2 155
MVNRYKVAVIAGDGIGREVVPEGLRVLQAASERFGFTLDLEEFDYANVDYYLKHGQMMPDDWFEQLRGFDAIFFGAVGWPELVPDHISLWGSLIQFRRHFDQYVNLRPVRLLPGIAGPLAGRKPGDIDFYVVRENTEGEYSSIGGKIFEDTPRETVIQDTVMTRVGVDRILRYAFELAQRRPRRLLTSATKSNGISISMPYWDERVEQMSTMFPDVSVNKFHIDILAANFVLHPDWFDVVVASNLFGDILSDLGPACTGTIGVAPSANINPERTFPSLFEPVHGSAPDIAGQGVANPVGQIWCASMMLEHLGERTAAKAVLDAIEAVLADGAVLTPDLGGTATTTALGTAIADSVGASASASAGTR

SEQ ID NO: 25965 - protein, 444 aa, Neisseria meningitidis MC58
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFSSVLTGKGLEWGGSLIRPEATGYGCVYFAQAMLQTRNDSFEGKRVLISGSGNVAQYAAEKAIQLGAKVLTVSDSNGFVLFPDSGMTEAQLAALIELKEVRRERVATYAKEQGLQYFEKQKPWGVAAEIALPCATQNELDEEAAKTLLANGCYVVAEGANMPSTLGAVEQFIKAGILYAPGKASNAGGVATSGLEMSQNAIRLSWTREEVDQRLFGIMQSIHESCLKYGKVGDTVNYVNGANIAGFVKVADAMLAQGF

SEQ ID NO: 25966 - protein, 496 aa, Burkholderia sp. 383
MNRDTTDAARTPRLLRHYIDGAFVETARTFADTSPVDGREIARVCEADEASVDAAVRAARAAQAAGWRDTTPAQRADWLHRIADGIQARFDDFVAAEVADTGRPLAQARTLDIARGIANFRTFADLVRTAGDDCFESQTADGAQYLNYVTRKPLGVVGIISPWNLPLLLFTWKVAPALAMGNCVVAKPSEETPGSATLLAEVIDAVGLPRGVFNLVHGHGPAAAGEFLTRHPGIDAITFTGESRTGSAIMKAVADGVKDISFELGGKNAAVVFADADFDAAVDGIVKSSFTNAGQVCLCSERVYVERPIFERFVAALKTRTEALQVGAPDDPATTMGPLISRGHRDKVLSYFRLAVDEGATVVTGGGVPAFGDARDDGAFVQPTIWTGLPDTARCVTEEIFGPVCHVAPFDSEDEVIRRVNDSAYGLAASVWTTHLARGHRVAKRIETGIVWLNAWFVRDLRTPFGGTKLSGIGREGGRHSLDFYSETTNVCVRVA

SEQ ID NO: 25967 - protein, 392 aa, Nostoc punctiforme PCC 73102
MKALCWHGANDVRVDTVPDPKIINPRDAIVKITSTAICGSDLHLYDGYIPTMEKGDILGHEFMGEVVELGSAVKNVKIGDRVVVPFTISCGSCFFCQKDLWSLCDNSNPNAWIAEKLMGHSPSGLFGYSHMMGGYAGGQAEYARVPFADVGLFKIPDGLTDEQVLFLTDIFPTGYMAAENCDIQPGDTVAIWGCGPVGQFAIRSAYMLGAERVIAIDRVPERLQMAKDGKAEVLNYEEVEVGEALKDMTGGRGPDACMDAVGMEAHGTGPDAFYDQVKQAVRMETDRPTALRQVIVACRKGGTVSIPGVYGGFVDKIPMGAAMNKALTFKMGQTHVHKYLRPLLDRVQNGDIDPSFVITHRLPLEQAPHGYEIFKHKKDNCIKIVLKPGQAA

SEQ ID NO: 25968 - protein, 345 aa, Streptococcus thermophilus LMG 18311
MKSAVYTKAGQVGLAEIDRPQIVAADDAIIKIVRTCVCGSDLWSYRNPEMEEGHRNSGHEAIGIVEEVGEQVTTVKPGDFVIAPFTHGCGQCDACRAGFDGSCDNHSGNNWSEGVQAEYIRFHFANWALVKILGQPSDYSEGMLKSLLTLADVMPTGYHAARVANVQKGDKVVVIGDGAVGQCAVIASKMRGASQIVLMSRHEDRQKMALESGATAVVAERGEKGIDKVREVLGGGADAALECVGTEAAVEQALGVLHNGGRMGFVGVPHYNNRSLGSTFAQNILVAGGVASVTTYDKQVLLKAVLDGDINPGRVFTTSYKLEDINQAYKDMDERKSIKSMIVLD

SEQ ID NO: 25969 - protein, 356 aa, Mycobacterium smegmatis str. MC2 155
MIELGVLRGDGIGPEIVSATTQVVERALDAAAVGVRWVPLPFGRQAIDEFGTPVPDVTLERLDGLTGWIIGPHDNAGYPEQFRGTLSPGGVIRKRYNLFANIRPARALSKSVRAVCPDIDVVIVRENTEGFYADRNMYDGAGEFMPTADVALAVAVFTRAAIERIAHEAFRIAATRRRSVTIAHKTNVLTRTTGLFRDTCMAVADQYPDVEVRGEHVDALAALLVSRPTQFDVIVAENMFGDILSDLTGQLSGSLGMAPSLNASDSKAMAQASHGAAPDIAGRDVANPVAMMLSAAMLLRWLGERAGSGRALVGAADAVEHAVRRTLDAGLSTPDVGGSAGTREFTDGVLTALRPT

SEQ ID NO: 25970 - protein, 702 aa, Oryza sativa
MRRHRPYLDGVAAAAATFLLAVLLHAPLAAGEDEPPPWVLCGPYPPSGNYSKNGTYQVNLDLLSTTLPKNTSSSPAMYATGTVGDVPDKVYGLALCRGDANASACERCVAAALRDAPRRCPLVKDVLVFYDLCQLRYSNRDFFLDDDYFVTTYTLQRSRRVGAAAAAAFDAAVAVLVNATADYAAADSSRRYGTGEEEGVDGDSDRPKIYALVQCTPDKTPEVCRTCLSTVIGQLPKEFSGRTGGGMFGVWCNFRYEVFPFFSGRPLLQLPAFVETPPPPPSPSATSGEKTKNRIGTVLAIVMPAIAAILLMVVACFCCWKRIKKRRPEEQTFLSCKSAKNYDSVSSDDIQSIDSLILDLPTIRVATDDFADTKMIGQGGFGMVYKGVLPDGQEIAVKRLCQSSRQGIGELKSELILVAKLYHKNLVRLIGVCLEQQEKILVYEYMPNGSLDIVLFDTDKNRELDWGKRFKIINGIARGLQYLHEDSQLKIVHRDLKASNILLDFDYSPKISDFGLAKIFGGDQSEDVTNRIAGTYGYMAPEYAMRGNYSIKSDVFSFGVLVLEIITGRRNTGSYDSGQDVDLLNLVWEHWTRGNVVELIDPSMGDHPPIEQMLKCIHIGLLCVQKKPASRPTISSVNIMLSSNTVRLPSLSRPAFCIQEVSASDSSNPYSERYPRPRHSGYSDNSTVVSSNDLSITELVPR

SEQ ID NO: 25971 - protein, 424 aa, Bacillus cereus ATCC 10987
MIEIKVPELAESITEGTISQWLINVGDKVEKGGSVVELETDKVNVEIIAEDSGIVSKLLGEPGDTVEVGATIAILDANGAPVAVSTPAPAAEQPKQETAEAPKAEAPKAAAPSAEQTATLQGLPNTNRPIASPAARKMARELGIDLNDVRSTDPLGRVRPHDVQAHAAAPKEAPAAPKSPAPAPVAKTEFEKPVERVKMSRRRQTIAKRLVEVQQTSAMLTTFNEVDMTAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDAERMENRPMMYIALSYDHRIVDGKEAVSFLVAVKDMLEDPKSLLLEG

SEQ ID NO: 25972 - protein, 461 aa, Rhizobium leguminosarum bv. viciae 3841
MSSYDYDLFVIGGGSGGVRGARVAASLGKKVAIAEEYRYGGTCVIRGCVPKKLFVYASQFHEHFEDAAGFGWTVGESSFDWKKLVAAKDVEIARLEGLYKKGLAGANAEILETRAELVDAHTVRLLKTGRTVTAKTIVIATGGRPNPHAALPGHELCISSNEAFHLEELPKSMVISGGGYIAVEFANIFHGLGVETTLIYRGAEILSRFDEDLRRGLHEAMVAKGIRILCHDTLQKVSKGEDGLVLETLNNGTLQAGVVMLALGRDPNTEGLGLEAAGVAVDERGAVIVDEYSRTNVENIYALGDVTNRVQLTPVAIHEAMCFIETEYKNNPTRPDYELIPTAVFSQPEIGTVGLSEEDAGKRYSELEVYRAQFRPLKATLSGRAERMIMKLIVDAASRKVVGAHILGHDAGEMAQLLGITLKAGCTKDDFDRTMALHPTAAEEFVTMYAPSYRIRDGKRI

SEQ ID NO: 25973 - protein, 464 aa, Novosphingobium aromaticivorans DSM 12444
MASIAPDSRTDLHTERANPHWVRLGGDHKLDHVPGEDGWPVLGTTLMQLADPLGFQRRMVETHGPVFRTRSFGRRGVNLIGADANELVLFDRDRLFSNEQGWGPVLNLLFPRGLMLMDFEAHRVDRRALSIAFKPEPMRAYCSVLNTGIAQAVQGWGGQMRFYDAIKALTLDTAASSFLGLPLGPEADRLNKAFVDMVQASGGVVRRPLPFTRMGKGVAGRRLMVEYFGRLVRERRADPGQDMFSQFALATREDGSLLPEDVVVDHMIFLMMAAHDTITSSATVLFWQLARNPDWQDRLRAEARAVTGGDGLPLAYEDLGRMELTEMAFKEALRFMPPVPNMPRRALRDFEFGGYRIPAGTPVGISPAAVHADPAHWPEPDRFDPLRFTPENVSGRHKYAWVPFGGGAHMCLGLHFAYMQVKLLVSHILTRYEVAMQPGPAPSWQAWPIPKPRDGLRVEMRRIC

SEQ ID NO: 25974 - protein, 232 aa, Rhizobium leguminosarum bv. viciae 3841
MDAREMKIKAAEAALAHVESGMRLGIGTGSTAEEFVRLLAEKVAGGFRVEGVPTSERTARLCVELGVPLKSLDELPALDLTIDGADEVDQALRLIKGGGGALLREKIVAAASERMIVIADESKLVETLGAFALPIEVNPFGLVSTRIAIEKVAARLGLSGELDLRQSGDGEFTTDGGHHIIDASFGRIPDAEALSSELNSIPGVVEHGLFINMAALAIIAGPAGARTLQANR

SEQ ID NO: 25975 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFMDMLDGIFSFVLLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLFAAVTARYLAGTKAAKQWGTKLHSFCVGLEGAPDLKAAKEVAEYIGTVHHEFHYTVQDGIDAIEDVIYHIETYDVTTIRASIPMFLMSRKIKSLGVKMVISGEGSDEIFGGYLYFHKAPNKEEFHQETCRKIKALHKYDCLRANKSTFAWGLEARVPFLDKEFIRVAMNIDPECKMIKKEEGRIEKWALRRAFDDEEHPYLPKHILYRQKEQFSDGVGYGWIDGLKAHAEKHVTDRMMLNAANIFPFNTPTTKEAYHYRMIFERFFPQNSARLTVPGGPSVACSTAKAVEWDAAWSNNLDPSGRAALGVHASAYGNQVKAVEPEKIIPKMEVSPLGVAI

SEQ ID NO: 25976 - protein, 310 aa, Pyrococcus horikoshii OT3
MNLVFGMIASIGELLIDLISVEEGDLKDVRLFEKHPGGAPANVAVGVSRLGVKSSLISKVGNDPFGEYLIEELSKENVDTRGIVKDEKKHTGIVFVQLKGASPSFLLYDDVAYFNMTLNDINWDIVEEAKIVNFGSVILARNPSRETVMKVIKKIKGSSLIAFDVNLRLDLWRGQEEEMIKVLEESIKLADIVKASEEEVLYLENQGVEVKGSMLTAITLGPKGCRLIKNETVVDVPSYNVNPLDTTGAGDAFMAALLVGILKLKGLDLLKLGKFANLVAALSTQKRGAWSTPRKDELLKYKEAREVLAP

SEQ ID NO: 25977 - protein, 490 aa, Xanthomonas campestris pv. vesicatoria str. 85-10
MPRFSDQLLYIGGRYVPARGGHTFEVVNPATGEVLANVHNAGADDLDAAVDSAQAGQRQWAALTTVERSRILLRAVALLRERNDALAELETLNTGKPLSETRSVDVVTGADVLEYYAGVAQALQGAQVPLREGSFFYTRHEPLGVVGAIGAWNYPIQIALWKAAPALAAGNAMIFKPSEVTPLTALKLAEIFTEAGLPDGVFNVLPGDGASVGTALTEHPQIEKISFTGGTATGRKVMASASSSSLKEVTMELGGKSPLIVCADADLDLAADIAMMANFYSSGQVCTNGTRVFVPRALRHAFEARLLARVQRIHIGDPLDERTTFGPLVSAAHMQRVLEHIEQGKAEGARLLCGGERLQDGALAQGYYVAPTIFSDCTDVMTIVREEIFGPVLSLLTYDDEDEAVTRANATTYGLAAGVVTPDLARAHRLIHRLEAGICWVNTWGESPAPMPVGGYKQSGVGRENGLATLQAYTRTKSVQIELERYASVF

SEQ ID NO: 25978 - protein, 442 aa, Mesoplasma florum L1
MKTVIIGGSATGMGVAAKLKRLNEQNEIVVIQDKDYVSLGACGIPYYIGHNFENPETLIARKIEKFEESQISVISNSKVNKIDFENKKVIFEESQISYDNLVIAVGAKPITPEIKNIDAKNIFTVNSKEDAIEIRKTINDDSNVLIIGSGLIGLEMVENIKHSTAAKISIIEKADRVLKNLFDEEFSELVEKEILNQEIELFKNNEVIEFVKDNNGKVTGAKTINGEIIKCDVVILSIGVIPNTSFLRDTDLELENNGAIKINEYCETNIPNVYAGGDCCSSLSYLYKNTRTFYLATVANKQAKIIANNVNKNKSSKFVGALGTTIIRFFDLELARTGENRMFIDMNSIETKEVLIKDKDHTNYVTGQEDIWLKVIIDVKTKEIINVQMIGKNKSVLRIYGLVGLIWSRSKVDETLEQIDLPYSPPFSRTTDIIHIALSKLI

SEQ ID NO: 25979 - protein, 125 aa, Escherichia coli
QTHIKINRGELLRGIEQDHTRQLPDFRPGDTVRVDTKVREGNRTRSQAFEGVVIAINGSGSRKSFTVRKISFGEGVERVFPFASPLVNQVTIVERGKVRRAKLYYLRELRGKAARIKSDRSRVMK

SEQ ID NO: 25980 - protein, 96 aa, Cenarchaeum symbiosum
MFRFTKEQAEEFYAVHKERPFFNELVSFITSGSVVAAVIEGNNAVTAVRTMIGSTKSSEAAPGSIRGDLGLGFTDNIVHASDSAESFSHEERVAFQ

SEQ ID NO: 25981 - protein, 221 aa, Xanthomonas campestris pv. vesicatoria str. 85-10
MQQNCRARTCDPRRMSLLIEQARYHLSAHNARQLPDDGGYEVAFAGRSNAGKSSALNALTRQNALARVSKTPGRTQQLVFFQIQPERYLVDLPGYGYAKVPQDLQAHWQAFIDRYFRTREALRGLVVVMDIRHPLKDYDLQMLGYAAERGLPAHGLLTKADKLGRGQQMQTLQKVKKEVTSRFGDSVTVQTYSGESRQGVDELRAIVGAWLGLDVETTAAE

SEQ ID NO: 25982 - protein, 300 aa, Zea mays
  misc_feature (90)..(90): Xaa can be any naturally occurring amino acid
  unsure (1)..(300): unsure at all Xaa locations
MAMYSQSVLVRAPPPPPPPCRFVPRPCYVMARPLLVFMPSGALLKAAVRDVWASNFDEELSNLSAVLPRYPCVCVDTEFPGAVHDSDMPXPRYMRGPRESYELVKRNVDDLKLLQVGIALSGPTGRFPVAWQFNIRGFDPALHPHAPASIAMLREQGMDFAMLNEFGIDPEDFAAGFRRSGLACGRLTWTAFSGSYDFGYLAKAITGGQPLPDTLDGFLALVRRLFGHSVFDVKHLARCCAMRGGLEQVATALGVKRAAGRAHCAGSDSLLTTDVLLLMMHRFFRNVDVLAHAGTIVDLT

SEQ ID NO: 25983 - protein, 116 aa, Nostoc punctiforme PCC 73102
MSETTETIFSKIIRREIPVDIVYEDNLALAFKDIHPQAPVHILVIPKKPIPTLADAESQDHALLGHLLLTAKRVAEEAGLKNGYRVVINTGDDGGQTVYHLHLHILGGRQLDWPPG

SEQ ID NO: 25984 - protein, 182 aa, Streptococcus thermophilus LMG 18311
MTKVAVVFADGFEEIEALSPVDVFRRAGFDCSMLGLESASVTGSHGIQVTMDGVFDGNLDEYDLVVLPGGMPGSTKLRDHQALIASLQEVAKAGKYVAAICAAPIVLERAGLLEGRKFTCFPGVEEQIASGDHQTDLVVVDDNIVTSRGAGTALAFAYALVDLLGGDGQQLAHTMVYDRLFQ

SEQ ID NO: 25985 - protein, 320 aa, Arabidopsis thaliana
MRPPLTGSGGGFSGGRGRGGYSGGRGDGGFSGGRGGGGRGGGRGFSDRGGRGRGRGPPRGGARGGRGPAGRGGMKGGSKVIVEPHRHAGVFIAKGKEDALVTKNLVPGEAVYNEKRISVQNEDGTKTEYRVWNPFRSKLAAAILGGVDNIWIKPGAKVLYLGAASGTTVSHVSDLVGPEGCVYAVEFSHRSGRDLVNMAKKRTNVIPIIEDARHPAKYRMLVGMVDVIFSDVAQPDQARILALNASYFLKSGGHFVISIKANCIDSTVPAEAVFQTEVKKLQQEQFKPAEQVTLEPFERDHACVVGGYRMPKKPKAATAA

SEQ ID NO: 25986 - protein, 575 aa, Blastopirellula marina DSM 3645
MSQPTLSKIENLKLDSRQLRGTLADELQNDRPDFSADAIQLLKYHGSYQQDDRDVRKQKNADGTKKEKAYSCLIRTAVPGGRVSAEQFLAELDLCDRLGNGSLRITTRQGFQLHGVLKSNLKETIRTINQIKLSTFAACGDVSRNVMCCPAPFKNNPVREQMQTLAQEIAVHFRPRSTSYYELWLTDDEGNKQDVADFQPVAEPIYGERYLPRKFKFGVAEPADNCIDVYTQDVGLLAIVEENEVIGYNVIVGGGMGNTPSADKTFPRLGDEVTFATPDQVIAVCGAIVKVQRDFGNREDRKRARLKYLLHDWGVAKFKSQVEAYYGAPLPEPKHAPVTGVDDHVGWHVQGDGKLFLGVNIENGRIVDVGDVRIKSGLRAILQRYGMPTRLTPLQSVILCDIDPADRRGVEALLGEYGLKSADELSLARRFAVACPALPTCGLAITESERVMPQLIDQIEPVLAQHGLEKSQISIRMTGCPNGCARPYVADIGLVGKSVGKYTIYLGGNPQGTRIGFVYQDATPLEEIPAQLSPLLASYQAEKSGDEAFGDYCARLGRETLLAKVGRAEAAILQN

SEQ ID NO: 25987 - protein, 679 aa, Candida glabrata CBS 138
MSFGEIDKLAVSTIRLLSVDQVSKANSGHPGAPLGMAPAAHVVWSQMRTNPKNPDWIARDRFVLSNGHACALLYSMLHLTGFDFSIDDLKNFRQLNSRCPGHPEFELPGVEVTTGPLGQGISNAVGMAIAQANFAATYNKPDFTLSDSYVYTFLGDGCLQEGVSSEACSLAGHLKLGNIIAIYDDNKITIDGNTTVSFDEDVCKRYEAYGWEVLHVENGNEDLNAIAQAVNKAKQSKDKPTLIKMTTTIGYGSLNAGSHSVHGSPLKEDDLKQLRKKFGFDPEKSFVVPQEVYDYYQAKIATPGAKANQEWDAKFAKYQQKYPEQGKELARRLAGELPAGWCSKLPTYTPADSAVATRKLSEIVFQSIYDELPEMIGGSADLTPSNLTRWKEAVDFQPPSSGLGDYSGRYIRYGIREHGMAAIMNGISAFGANYKAYGGTFLNFVSYAAGAVRLSALSGHPVIYVATHDSIGVGEDGPTHQPIETLAHFRALPNLHVWRPADGNETSAAYKVALESKHTPSVIALSRQNLPQLEGSSVEKALKGGYVLKEANNADITLVSTGSEVYLTVDAVKVLAAKGITARVVSLPDFLAFDQQPEDYKLSVLPDGAPVMSVEVLSTKSWGKYAHESFGIDRFGASGKAPEVYDYFGFTPEGIAERAEKVVKFYHGQKLSSPLKKAL

SEQ ID NO: 25988 - protein, 507 aa, Bordetella parapertussis 12822
MTTVHSATPEETRRLLQQLGVDPARYDGGTLEVRSPIDGQAIARLPELTAEQARARVADARQAFLAWRKVPAPRRGELVRLLGEELRAAKAELGRLVSIETGKILSEGEVQEMIDICDFATGLSRQLYGLTIATERAEHRMMETWHPAGPVAIISAFNFPVAVWAWNAAIALVCGDSLLWKPSEKAPLTALATQALLERALARFGDAPAHLSQVLIGGREVGEALVDDPRIPIVSATGSTAMGRKVGPKVAERFGRSILELGGNNAAIICPSANLDLALCGIAFSAMGTAGQRCTSLRRIFVHEQIADDLVARLQQVYESVAIGDPRDSGTLIGPLRDQAAFDAMQRSLADARAAGGRVTGGAREPVGGHDQAYYARPALVEMPAQSEVVERETFAPILYVMRYRDLDEAIALQNDVPQGLSSSIFTNDLREAERFVSAEGSDCGIANVNIGPSGAEIGGAFGGEKETGGGREAGSDSWKAYMRRTTNTVNYGNALPLAQGVKFDVA

SEQ ID NO: 25989 - protein, 548 aa, Candida glabrata CBS 138
MSQRKLQQEIDKLLKKVKEGLEEFDSIYEKFQGTESSNISYREKLEGDLKREIKKLQKQRDQVKTWLSKEDVKDKDTVLMETRKLIENDMEKFKQIEKLMKTKQFSKEALTNPDIIKDPRELRKRDESLFIHECIDELTKQLESLEAQEDNEHQIERHEFHIANLENILKLLQNNELDPDKLNEFHDDIKYYVENNDDPDFIEYETIYEDIGCELNKAAIAAQQEESIKSTPKKSPTKKSSKISGSAAKRSPTPLAGTANANKNESSDKTKTIDTQETKADKSKPEEIIKSEDKPTKQAEDEQSNNEGDDNEDEDDDKEDDYVEPVDRTAEINEILQQDIQLNSTAMNNPLFKDEIQYWLESKRNLLQPIEDMTPAMIQQLESSLLNCPDSLDADSPSLYRKPLSQHHPTSIFFPNEPIRFVYPFYEQTQPNHQNGSEGRNNKHEDIYSRTSLAKIFNMFDLDTLFFIFYHYQGTYEQFLAARELAKIRNWQFNKKDRCWYYKEIEKLPPGMTKSEEESWRYFDFKKSWLSRRCGSDFVYNEADFEKL

SEQ ID NO: 25990 - protein, 434 aa, Zea mays
MAASGRWRRLRTLGRGASGAVVSLASDAASGELFAVKSAGASGAATLRREHAVLRGLRSPHVVRCVGGGEGADGSYQVFLEYAPGGSVADAVARGGGALEERAIRALAADVLRGLAYLHGRSVVHGDVKARNVLLGADGRARLADFGCARTPGFSARRPLGGTPAFMAPEVARGEAQGPAADVWALGCTVVEMATGRAPWGGADADVLAAVHRIGYTDAVPDAPSWMSAEARDFLARCFARDAAERWTAAQLLEHPFVAAPCHGHGDHEVPRVSPKSTLDAAFWEAEDDDDDADEAVLASASERIKSLACSACALPDWDGEDGWIDALGDQQRVEVCGAVQVARSAPGKVSSVLAVPAGEMDVGGGGGLPCDELEAEDVSFGGEVPGAADASAERQKKRYLILRSHYCHVLSCQLVPCNLPLVVVNNAIKLWVP

SEQ ID NO: 25991 - protein, 252 aa, Streptococcus thermophilus LMG 18311
MSRKPFIAGNWKMNKNPEEAKAFVEAVASKLPSADLVEAGIAVPAVDLTTVIAAAKGSNLKVAAQNTYFENSGAFTGETSPQVLKEIGTDYVVIGHSERRDYFHETDEDINKKAKAIFANGMIPIICCGESLETYEAGKAPEFVGAQVSAALAGLTLKQVASSVIAYEPIWAIGTGKSASQDDAQKMCKVVRDVVAADFGQEVADKVRVLYGGSVKPENVAEYMACPDVDGALVGGASLEPESFLALLDFVK

SEQ ID NO: 25992 - protein, 339 aa, Nocardioides sp. JS614
MLTPPRHTRAVVLQRRPQGPPRPDDFALVQQPLPRPHRGAVVVGVADLSLDPYLRSVLGAGHLAQAALALGSAVVPGTAVAIVLESEHPSFAPGDWVVGDIGWREHGIVDGDALRPVPVIDGLPRSAVLGAAGMPGLTAYAALERHLRPQHGETVAISSATGGVGATAGQLAAARGARTVAIVGSAEKAADALELGYEAAVVRTTSDWATDLARACPDGIDGYLHMGDQQTLDCVLDRLSVGARISLCGLMDQYNDGPRTVLDAGKVMSARASVHGMVVYDHQDLATVHREAVASLVAADQLRLHEHRTIGLASAPAAFCELMSGANRGKAVVEVASFS

SEQ ID NO: 25993 - protein, 369 aa, Xanthomonas campestris pv. vesicatoria str. 85-10
MKSRAAVAFGPGKPLEIVEIDVAPPKAGEVLVRITHTGVCHTDAFTLSGDDPEGIFPSVLGHEGGGIVEAVGEGVTSVKVGDHVIPLYTAECRKCKFCLSGKTNLCQAVRATQGKGLMPDGTTRFSYNGEPIYHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGEIDLDPFITHTMPLEEINEAFHLMHEGKSIRTVIHF

SEQ ID NO: 25994 - protein, 290 aa, Oceanobacillus iheyensis HTE831
MVNITVVGSSSIDLVVTAPTRPKAGETIIGDDFQTVPGGKGANQAVAASRLGANVSMIGRVGKDTFGEEILSNLQENKVSVEYVEPVTDVASGTAHITLAEDDNSIIFVKGANDYVTPDYIKKSLDKLINADIVLIQQEIPEETVEFVIETCHTYEVPILLNPAPAREVSNQVIERTTYLTPNEHEFSIMFGNENRSDVLKRYPNKLLITEGKNGVRYFDGEAEIVIPSYEVVPVDTTGAGDTFNASFAIAIAEGRSLEDAIRFANKAASISITKFGAQGGMPTRTEMEE

SEQ ID NO: 25995 - protein, 119 aa, Brassica napus
  misc_feature (8)..(8): Xaa can be any naturally occurring amino acid
  misc_feature (13)..(13): Xaa can be any naturally occurring amino acid
  misc_feature (21)..(21): Xaa can be any naturally occurring amino acid
  misc_feature (24)..(24): Xaa can be any naturally occurring amino acid
  misc_feature (26)..(26): Xaa can be any naturally occurring amino acid
  misc_feature (30)..(30): Xaa can be any naturally occurring amino acid
  misc_feature (56)..(56): Xaa can be any naturally occurring amino acid
  misc_feature (93)..(93): Xaa can be any naturally occurring amino acid
  unsure (1)..(119): unsure at all Xaa locations
PGACIINXSSVNXYKGNKTLXDYXAXKGAXVAFTRALSLQLADRGIRVNGVAPGPXWTPLIPASFGKEKVEQFGSQVPMKRAAQPAEIAPSFXFLASNQDSSYMSGQILHVNGGVIVNS

SEQ ID NO: 25996 - protein, 348 aa, Burkholderia sp. 383
MKIVKPLLIAAAVAAALSVTTTAFAAGAGAGVEAVRPDATTSAFLAALNGQKGPGLETLSPAKARQVLVDAQNGTKVDLSGIDVSNRTIEQDGLSVPVTIVRPQGATGTLPVFMFIHGGGWVLGDFPTHERLVRDLVVQSGAVAVFVNYTPSPEAHYPVAINQAYAATKWVAAHGAEIGVDGSRLAVVGNSVGGNMAAVVALMAKDKGGPAIRFQGLMWPVTDHNFNTGSYNAYQQGHFLTRPMMKWFWDAYTKNEAQRNEIYASPLRASTAQLKGLPPALIQVAQFDVLRDEGEAYGRKLDAAGVDATTTRYDGTIHDFGLLNALAMDAPTKAATKAMANEIATRLK

SEQ ID NO: 25997 - protein, 329 aa, Triticum aestivum
MSSRMAGATLLRHLGPRLFAAAEPASGLAASARGIMPAAARIFPARMASTEAAGPRAKQEEATEKPQGATAPEQNKKAVASYWGIEPRKLVKDDGTEWPWFSFRPWDTYRPDTSIDVAKHHEPRAVADKVAYLIVRTLRKGSDLFFQRRHASHALLLETVAAVPPMVGGVLLHLRSLRRFEHSGGWIRALMEEAENERMHLMTFMEVTQPLWWERALVLATQGVFFNAYFVGYLVSPKFAHRFVGYLEEEAVHSYTEYLKDLEAGLIENTPAPAIAIDYWRLPADARLKDVVIAVRADEAHHRDANHYASDIHYQGMTLNQTPAPLGYH

SEQ ID NO: 25998 - protein, 309 aa, Arabidopsis thaliana
MSGEASTSRRKRQRVPSSVESVENGGGDAVARSGTLFELDLLDCPICCHVLTSPIFQCDNGHIACSSCCTKLRNKCPSCALPIGNFRSRIMERVVEAVMVTCPNVKHGCTEKFSYGKELIHEKDCRFALCYCPAPNCNYSGMYKDLYSHYYVNHYDTWNQIGCGNFAGAWLRISEKILVLQYGQGPLIAVQCFKEPQGMYVTVNCIAPCAPGVGEFSYELSYRMPRGDNTMTFKSEEMNRIQKVSFQTPDKDFMLVPYYFLGDFSTLKMEICIRKLKKDEEEADEDEESEEEEEDDDDDDDEEDADEEE

SEQ ID NO: 25999 - protein, 372 aa, Streptococcus pneumoniae R6
MNNTEFYDRLGVSKNASADEIKKAYRKLSKKYHPDINKEPGAEDKYKEVQEAYETLSDDQKRAAYDQYGAAGANGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAAAGDLKVNPKKKGFFDHIKDAFDGE

SEQ ID NO: 26000 - protein, 274 aa, Zea mays
MAAATAAASTMSLLPISQLRQQHGAGAMRRRPWVARRRRYVVPTARLFGPAIFEASKLKVLFLGVDDEAGSKQHGPLPRTYTLTHSDVTARLTLAVSHTINRAQLQGWYNRLQRDEVVAEWKKVRGRMSLHVHCHISGGHFLLDLIAGLRYVIFRKELPVVLKAFVHGDGDLFSRHPELEEATVWVYFHSNLARFNRVECWGPLRDAAAPAEDDSTAPPDASNSKEAGQMMAMCEWPHRCPQQCDCCFPPHSLIPWPNEHDMAAADASGSAQQQ

SEQ ID NO: 26001 - protein, 496 aa, Burkholderia sp. 383
MNQPTFEDWQARAAVLRVEGRAFIDGDARHAHTGATFACVSPIDGCVLAHVADCGADDVDLAVAAARRAFDARSWAGMNPRTRKAVLQRWAALMREHLDELALLETLDTGKPIADTTAIDVPAAAHCVDWYAEAIDKVGGEVAPVDHHLVGLVTREPIGVVAAVVPWNFPLLMAAWKFAPALAAGNSVVLKPSEKSPLTAIRVAQLACDAGVPPGVFSVVPGGAEPGKALALHRDVDCIAFTGSTRTGQQIMACAAQSNLKRVWLELGGKSPNIVLRDCPDLDRAAQAAADAIFFNMGEVCTAGSRLLVHRDIKDAFVAKLVDASRRFAPGHPLDPSVTMGAIVDRTQLDRVMGYIGAGRDEGKLVTGGARVREETGGFYVEPTVFEVKPDAKIAREEIFGPVLSVIVFDEVDEAVRIANDTEYGLAAAVWSADLSTAHAVARRLRAGTVWVNCYGDGSDDMNFPFGGYKLSGNGRDKSLHALDKYTELKSTVVRL

SEQ ID NO: 26002 - protein, 582 aa, Candida albicans SC5314
MLHKKETNDTFVQLNRSPSTGEQKSSGIWSSIKDSFKPALPQDKLTGVDDIPDRELTDIERININAANSNLQRKLKTRHLQMIAIGSSIGTGLFVGTGGALSTGGPAAIVLAWAISAISVFMTMQGLGELAVAFPVSGGFNLYASKFLEPGIGFAVGWNYFLQFFVLLPLELVAGAITIKYWNASINSDVFVIIFWFVVLVITMLGVRWYGEAELVFCTIKVIAVIGFIILGIVLICGGGPNHEFIGGKYWREPGPFANSFKGFASSLITAAFSFGGTEMIALTASESSNVRHALPKAIKQVFWRIVIFYLGSIIMIATLVPYNDKRLLGSSSVDVTASPFTIAIVNGGIKGLPSVINAVILISVLSVGNASVYATSRTLNSLAEQGMAPKWTGYIDRAGRPLFAILITNVFGLFALIAADNEKQVVAFNWLLALSGLSSIFTWMSINLSHIRFRRAMKVQNRSLTELPFVAQSGVWGSYFGLTLNILYLIAQFYIGLFPVGGKPNAYDFFLAYLGVPVILASWIGYKIWKRDWTLFIRAKDIDLDTGRINVDLDLLQQEIAEEKAQLAEKPFYIRIYRFWC

SEQ ID NO: 26003 - protein, 1462 aa, Candida albicans SC5314
MSTVVNRRSSHQFDSPSNHLDHSSSMNVDKVVQSVTNATKRLSQISTNTNNSNKKRKTQNKIGPWKLGRTLGRGSTGRVRLAKNTTTGQLAAVKIVPKSNFKKLENPKYKRSKEDATRLPYGIEREIIIMKLISHPNIMGLYDVWENKNDLYLILEYIEGGELFDYLIKRGKLQEYEAINYFKQIINGINYLHQFNICHRDLKPENLLLDFNKNIKIADFGMAALEVKEKLLETSCGSPHYASPEIVAGKNYHGAPSDIWSCGIILFALLTGHLPFDDENIRKLLLKVQSGKFNMPPELSFEAKDLITKMLKVNPRERITIDAILTHPLLAKYPEPTVSYSSTTTLDINSINIKQIESVDKIDKEILKNLSVLFHNCDEKTIISRLLSPNRCPEKMFYYLLMKYRNEHLSNSNSFNSSNDVDSARSLPRSTSYVKTTVTDHATGEKHTTVKKIQQSSSIYSNRSLLKKSTSAKGNVLSNITNRPNTPKQFSASSSFNKKKALHSKTQIYASRSRNASSRSLKSNSSTGRNGNNASVTSVNKIPEITGATVLQPIPSMAMNRGDEQQNKTKKNLTGTFGNKSLLNFQLICEEVFENDKENSKPVSKTPVSQLPPPPPPPIETPTSRTNSVKRGKTWSLARRERELAEQVRQRNEARENKLKAEELARKELEQEKKRIAEEKKRLEQQERELDEKQKLQEKQKAALEKLQKHQSAHDFEGLFASNRRSVTDMAPSSGMSSLDPRAHMVSRANTIGSPNLSSSSVNIDENASKVLHKFGIDVAPSPKRFSRASKTSTSKNLSSFLAPTVSRNLSSQLKTSSSKNLAGYLHGTTDTNGSAIAAKKKDDSTNEALTIEEFNAKERTSMSPSISKASVNKRNSNQSSYYRSMFSDNGNDDNVTKVRTGESHLSVQEEEEMDMENAIDEDISLIPNPRFSRFSFGGLLGSNTVANEEGDWTIMNSTLNHSNTVVRGTHNKSSTMLGLGIKMRDTTTIKEDEEFEDEKPFISVPSSEDDEGNTHKNKRGGLRDSGNYDFDEEHSVASTANTEYSDVASQGQQMPGSHTIHQLETELSNFDLLSYRVADIGKVNKHKPSIVDSKETLLKNHSSDEATIEVKEDNNEHDFNDKIKQHYDDNGDSEEDDEDEDEEEEDDDDDDDARSSFEARPHSHNYSLAEITSESPVGGGYESPSIANDFKKSRHSTGIFSTTQFPRSPYVVNNNGDSNKDENSQQQTKHMLNDGHKGLITSPVQDTFGSKKPVESNSLFRRLSLNPNRAAPKAPAPPPPSAPISSAAKANISQPLSSPTKGHNRFSRISIGSKNMLQKEDKSTKSNWFKKFFHSLTTPSAKDQSGNSSSKVASKDIKIIDTSLTAAQLIRVIKYQLELKKIEGSISKVDIDEEFGLISGVIPSKFANGRKLKFKIEVIDLINSSSLHVIKMKGNDKGFQSLVNIVTFIIKKEEQDKISRR

SEQ ID NO: 26004 - protein, 274 aa, Pseudomonas syringae pv. phaseolicola 1448A
MDRYVVFGNPIGHSKSPLIHRLFAEQTGQALDYQTSLAPLDDFTAFAQAFFQTGRGANVTVPFKEEAYRLAHSLTERGQRAGAVNTLSKLDDGKLLGDNTDGAGLVRDLTVNCGRSLRGQRILLLGAGGAVRGALEPLLAEQPAVLVIANRTVEKAERLAQEFADLGPVFASSFDWLEEPVDVIINATSASLAGELPPISPSLIQPGATFCYDMMYSKEPTAFCRWATEHGAAQSVDGLGMLVEQAAEAFLLWRGVRPDSAPVLAELRRLLAAG

SEQ ID NO: 26005 - protein, 475 aa, Xanthomonas axonopodis pv. citri str. 306
MSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 26006 - protein, 447 aa, Ustilago maydis 521
MKILIKSLAGGNFHLDAELTDTIGTIKSKIQNEQGHAPELQKIIFSGKILTDDKTVADCKIKEKDFLVVMVSKPKAPKPATAGASTSVAAPEKPTEAALAPAPDAARAAAEAPKGQDAAVPTSDSSSPATTATAAATTTAAAAAAAADAPASAESATPSSAQTQQPSGTSGSFLTGGALESAMQSMVEMGFERDQVQRAMRAAFNNPDRAVEYLMTGIPEHLVNPPAAAAEAAARTSSEGQQTPASGATPGTPAAPAPAGAAGGSRVAATPATPATPTPAGRAGNLFEAAAAAQAGRGGGAARAGTGDSSGSGGGAGVLGEDDGSGEQVIDLGNPAMLAQLQQLVQQNPAALQPLVHAIAQSNPQLAEAMNHDPQGVLALLAGGAAAADDIDLPTLAELDEPDRASVQQIVAMGIPEAKAIECYFMCGKNVEMAVQYYFENPQDFDD

SEQ ID NO: 26007 - protein, 431 aa, Lactobacillus sakei
MSIITDILGREVLDSRGNPTVEVEVYTEDGGFGRAIVPSGASTGEHEAVELRDGDKSRFGGKGVLKAVENVNGPLAKEIVGFDTTDQRGIDAAMIKLDGTENKGKLGANAILGVSLAAARAAADELGLPLYEYLGGPNAHVLPTPMMNVINGGAHSDNKVDFQEFMIMPVGAKSVREAIRMGSETFQALKSLLSADGKVTSVGDEGGFAPDFANNEEPLQYLIKAIEKAGYKAGEDISIAIDVASSELWNNEDKTYKLRWSTGEEFTTPEFVKYLEGLVAKYPIISIEDPIDENNWEDWASITKELGEKVQLVGDDFFVTNTDYLRKGIKMGAANSILVKGNQIGTLTESLEAIEMAKEAGYTAVVSHRSGETEDTTIADLVVATNAGQIKTGSMSRTDRLAKYNQLMRIEEQLGDTASYKGINSFYNIKK

SEQ ID NO: 26008 - protein, 336 aa, Atropa belladonna
MEVNHNNGSTTKIILKNGSICNGDVNGNSHTHKKIENKLVECTNSIKPGWFSEFSALWPGEAFSLKIEKLLFQGKSDYQDVMLFESATYGKVLTLDGAIQHTENGGFPYTEMIVHLPLGSIPSPKKVLIIGGGIGFTLFEVSRYPTIDTIDIVEIDDVVVDVSRKYFPYLAAGFDDPRVTLIIGDGAAFVKAAQPGYYDAIIVDSSDPIGPAKDLFERPFFEAVAKALRPGGVVCTQAESIWLHMHLIKQIIANCRQVFKGSVNYAWTTVPTYPTGVIGYMLCSTEGPEVNFKNPVNSIDKDTSHVKSKGPLKFYNSDIHKAAFILPSFARDLVEF

SEQ ID NO: 26009 - protein, 296 aa, Bordetella parapertussis 12822
MLISARTLRGIITATPTPFTREGGVDREVLRSHIEFLIGRGAAGLAPLGGTGEYPALCARERADVVRWTVEAARGRVPVVAGVLATGYEDAVQAGLAAREAGADALMVVTPYYALAGDAGVRAYFERYRAAVDLPIVLYEIPRRTNVELRAETIAAMAGDGTIVGIKYSGSDFAKLTRLIHLAGDTLAVLSGEEPLFPAAVALGAVGGVLAMSNLDPAPWARIQSLVESGEMAQALQLHHRQGALADAVYSEMNPVGLKAALQLKGFAFGEARLPLQPAGPQTLLRLQQAFEALES

SEQ ID NO: 26010 - protein, 293 aa, Candida glabrata CBS 138
MSEITHPTIVDGWFREISDTMWPGQAMTLKVEKVLHHEKSKYQDVLIFKSTNYGNVLVLDNVIQATERDEFSYQEMITHLAMNSHPNPKKVLVIGGGDGGVLREVVKHECVEEAWLCDIDEAVIRLSKEYLPDMAGVYSHPKVKTHIGDGFQFLRDYQNTFDVIITDSSDPEGPAETLFQQSYFELLRSALTDKGVITTQAESMWLHLPIIKDLKKACSQVFPVAEYAYTTIPTYPSGTIGFMVCSKDASANVKKPLREMTEEQEKKLLRYYNKRIHESSFVLPTWVAKELEL

SEQ ID NO: 26011 - protein, 580 aa, Oryza sativa (japonica cultivar-group)
MDDDGETPMPSLELHKLPTLAGAAIPNPIARHPLYHPSPSFFISPTDVVLRDILFDASPASAAGERRRRHVAAYHRAGPRREVAFDPATVRAAIFTCGGLCPGTNTVVRELVVGLSELYGVRGGVFGVRNGYRGFYSDEVVPLDPAAVEHWHKAGGAALGTSRGGFDLARIVDAIERHGFNQVYAVGGDGTMRGAARIQREVRRRGRLAVAVAGIPKTVDNDVGVVDRSFGFHTAVEAAQQAIAAGHVEAESAANGVGLVKLMGRSAGHIALHATLSSRDVDCCLIPEEDFYLRGAGGLFDFLYRRIKDNGHAVVVVAEGAGQRLIPRTTTTSASGACAGADESGNETFLDVGAWLKAEMRAWWEEEHAGEVFTVKYIDPTYMIRAVPANAGDNLYCTLLAHAAIHGAMAGYTGFVSGTINGNYAYIPMDEVAEAKNPVDTKDHKWAWSFVVYLGGHSHGRGGAALASSQERAKNSHHEFLGSFLGSKEKARDAIFYSYTKYINGFAATLEEEEAMEISKHPSVISVFPNRGHRLHTTRSWEFLGMEKDGRIRANSIWAKARFGEGVIIGNLDTGNLTSA

SEQ ID NO: 26012 - protein, 336 aa, Streptococcus thermophilus LMG 18311
MVVKVGINGFGRIGRLAFRRIQNVEGVEVTRINDLTDPVMLAHLLKYDTTQGRFDGTVELKDGGFEVNGKFVKVSAERDPEQIDWANDGVEIVLEATGFFTKKVLAEKHLHPGGAKKVVITAPGGNDVKTIVFNTNHDILDGTETVISGASCTTNCLAPMAKALNDNFGIVEGLMTTIHAYTGDQMILDGPNRGGDLRRARAGAANIVPNSTGAAKAIGLVIPELNGKLDGSAQRVPVPTGSVTELVAVCEKNVTVDEVNAAMKAATNESYGYTEDPIVSSDIVGMSYGSLFDATQTKVLDVDGKQLVKVVSWYDNEMSYTSQLVRTLEYFAKIAK

SEQ ID NO: 26013 - protein, 119 aa, Brucella suis 1330
MPRFDASGLITAIVTDARDGELLMVAHMNEEALRLTLETGIAHYWSRSRKTLWKKGETSGNLQSVVELRTDCDQDALWLKVHVAGDGPTCHTGRRSCFYRQVVSSGGKVALTMVSDHDQ

SEQ ID NO: 26014 - protein, 338 aa, Zea mays
RVDEIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 26015 - protein, 469 aa, Pseudomonas aeruginosa PAO1
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIVGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVLFILGIMLMIPGINISVYAIPFWLLLMWLCYRVKLSLAERRGLGQQA

SEQ ID NO: 26016 - protein, 2493 aa, Ustilago maydis 521
MLFTMQFTTRSTVASPEQQHQHQQRSISYSDIELGLERISSRDSNGSSNFTHRAYPPPLSQQYDDTSTNSFHSSQPDITASSSTLSSRLVSANYSRPRFEHAHTQPPTPDQDRSSSGSGSGSGSRSYFPANSHSDSLPGPSTHSISPSFDEDELRQIMSHIPANQATSSSDGDVGKAVQSANHQDISPFLFQSENAAPFSSSHSNRTSVNPSAASTASPSTSAATRTRPRGGTNASQYNTLDTSFGSIDRPGLSSSRSQYSLRPQTPPSASTSTSTLNGSKDTHASAVKKTRNPFGFLKKKSSAHSNASSNHPTRHDIGSVSSLSSRYGPNAAANVNPMRPPAWLDNHCTLANSNSPSSASLRSHYHQPPASSNPPPWQNPLVSRADSTPSAMSLEDEVEAEHHLKKDPRKRIKGVRHHLAKTTKPGEDADSARDPAFAAQSQSIEQEVELSLDMNFDQLDDFVDTNAARQRLQGSITESASPSEHRSPNGSEAGVYRSPSPSQTPIAERQTSVTSTVESPSHASEASLAPSGSLRTPSRTTASTSTSSASTVLSDRLPSQVNMLPRNSVPRLSLAEMQNYQSLRKLSNNLIDMSQTQNPSAMGASYRRGSIAAAQAPVDAPQLGVAPRTDSELSDRKDSVVSTHSMRSNHSGISPKTSYANLPSVIQERQKPATALPSAANWTSSITRDKTANGHADHAYQFPPATEYQSNLLLSVRKSSASSGQEPSSSWMAPDSWAVQPDKMRDYLRDDNVGEEEDDDDDQHQARAALATDGKRRGSSSGISSTHASSMFRTSSTDPFKKTASLAGSRRGTDDSVDPLTALPPLPGSKSVDEAAANKVDVLQQTNNLAQSALVQQQSQSQNHHQPSPNVRPTSRGGAGAHMFASAGASAAAAAAGKLGLHRPSKHRMNARPNTAGSVGATRPSTTTLGSTLSAEDDTSINGSIRRDGHPLKRSATANTNNATGTLPRNHFIRVYKTDGTFATLSCSLVSTANEVQTILARKSLTTESAAYRLFVRDKGSERPLGISDKPSQLQRRRLIQAGYTENDGLEDMGRDDLSYLLRFVFRPDSVPTFDSESIGHSEHTFQHLDLHSRNLEMVPIFLYKHADWIVSLDLSGNPMSDLPLDFVQLCSSLRTLRLSNLALKRIPQSVRHSETLTHLDVSNNRIVELAHVSLDLIPELMSLKVQNNRLFDLPSYFSSISTLRNLNISNNRFEEFPKVICDVPSLVDLDVSFNSITELPAEIANLINLERFILAGNELEKLPDSMSELVSLRTIDLRRNKVQDVSSLLGLPRLQNIQAESNNIKSFEATLGPQLTQVELGRNPLSKVRIAALTTCDLTSLDLSSTNMTRLEEGLFPQLPALVKLTLDGNQLVVLPDTLGDLKRLEMLSCSNNLLATLPESIGDLKALKELLVHNNNLKTLPQTLWLCESLAHINLSSNLLESFPAVPDIRTDASVGDAAAAAGTSAVIAARKGSTSSSLTHRSNTGGANGNINLSTPSEVFVAPLSLSLQKLRLGDNRLGDDVFSVLSELTSLEVLNLSFNEIFEIPDFSLQTLTKLRELYISGNQLSTIPSDDLVVLQELRILHLNCNKLTTLPTELGKLKKLANLDVGNNVLKYNIANWHYDWNWNMNPELRYLNLSGNTRLEIKTKLSDMGFTRKSNISDFSRLTSLRMLGLMDVTMPLHSNATPDESDNRRVRTSLSQVNGMAYGIADALGKHDNLSVIDLVIPTFRKDEGECIFGLFDGRGHGAHVGSRIAHHLAEWSGHRLSWEFQKHQNEMTAEPVSVPDALRRAFLRLQKDYADALINDGSRKLSEAHAEAAADVTRSSAPAIAAASNKHDWRAGASAILAYVVDHTLYIANAGDALAVMSRNGGTAHLISNKHEPFDRAEIERIRSAEGWVSLRGYVNDMLDVSRSFGYFHLFPIVNAAPAVTTVQLTDSDEFVIIANRTLWQYVSYQTAVDIARTQRNDPMIAAQKLRDFAISYGAEESIMVMVISVGDLFYRSDQRNGGGLNFASYKNSDAIQKAGRRFREELPGDRTLARLDREVAPPIGQVALVFTDIKNSTSLWETNNGMQTAMRLHNYLLRRQLRTIGGYEVKTEGDAFMVSFPSVSAALLWCFTVQQQLLQEDWPREILDSEDGKEVYDQSGELIHRGLSVRMGIHWGRPVCEADPITRRMDYFGPMVNRAARISGAADGGQILASKDVIKELQGLLGTFDESSTAGGAGGEGENLEKTEEELDEDAFRLLNPNVSRDVVLLRRMGFGLSQLGERRLKGLETPEMLWLVYPKQLAGRLEQAKTDDAPDAPTAQVYEPTVQLLDIEDVKQVGMLCLRLEYLSNSTVCPGIFAAKDEADRSQPSTPLDDNGRNPIDGHGTAVPLLSHQARRKGVEAMLTMHPELLIYSIRDDATDEELAGILDQLTTRIQNAVSSLMLNMLRDKTANGTKELGVDPGVLELLMGLLSQPPPRASTSALSLPSPRTSPRNRLLELVP

SEQ ID NO: 26017 - protein, 649 aa, Nostoc punctiforme PCC 73102
MCGITGFWDISKQFSGEHLDETIQKMSKTLLHRGPDDGGIWTDVEVGVALGHRRLSIVDLSPLGHQPMMSANGRYMVVFNGEIYNFLELRRELTQLGHNFRGHSDTEIMLAGFSEWGLDKAIRRFNGMFAFALWDRQKRILHLGRDRLGEKPLYYGWQGSTFLFTSELKALKAHPNFRAEINRDALTQFFRYSYLPAPYSIYQGIYKLPPGTLLSWNGIDAHPDPVTYWSAREVTELGIAEPFMGSESEAVIQLEALLREAVGLRMVADVPLGAFISGGIDSSTIVALMQAQSSQPVKTFTIGFNEEAYNEAKHAKAVAKHLGTDHTELYVNPKEALEVIPKLPFLYDEPFSDVSQIPTFLVSQLAKQQVTVSLSGDGGDELFAGYNRYLFGRKIWQAIGWIPTTVRKNSARALTSVSPQNWNRGFANVNALLPSRIKQPEFGNKLHTFSEIMALPNPTAIYTKLVSHWEDPKALVIDGLEPPTILSNSQNWPHLLDFTQCMMYFDTVTYLPDDILVKVDRASMGVSLEGRIPFLDHRLVEFAWRLPLSMKIRNGQGKWLLRQVLYKYVPPTLVERPKVGFGVPINSWLRGPLRDWAEELLNENRLKNEGFFNPKPIREKWEEHLSGAASWEYRLWDVLMFQAWLEANH

SEQ ID NO: 26018 - protein, 326 aa, Fusobacterium nucleatum subsp. vincentii ATCC 49256
MIEILLKEWIERVKYYIHLIADYSIKESQVGAVLDDVLNLSGKMLRSKLLLLCAFLGSNWKDNKEKICKLAAMVELTHLASLIHDDIVDDSPYRRGKVSIQGKYGKDAAVFAGDFLIARIFYYGAMENLNETVSILSKTVEYMCIGEIEQDLCRYQEDISEKKYFENIERKTAALFQAASYIGAKETGCSEEIIQKLKLFVKNLGLMFQLKDDILDFTSNSKELGKETHKDFQNGIYTFPVIMALKNPKAREVLLPIMRKNKEEKLSLTEILQLQSYIIQFGGIEASYEKIKYLSTINRQLIKELGQNSKITVYLEKILNDLEVKK

SEQ ID NO: 26019 - protein, 706 aa, Magnaporthe grisea 70-15
MQRSDSHQAGGGVSGDATSLPTLNPVLSRYVDAVFKSHTDRNTGKWPKDQIATFLRVVQGEDGAEPQSALLKQSDLDLEGFVSYMLSPESSIIGPAKDQDLSWPLASYFISSSHNTYLTGNQLYSLSSTEAYTNVLRRGCRCIEVDVWDGDASDAEVSSVSSDDDDPDKYAKRKERVGQIKDKIPKSLTSRFRESSLAKRLGQFVDSKTEPKQPPISTSNSQGSGGPSPSALTRGADEDSTNDQNLSALQKTQTHEAPVIEPKVYHGYTLTKEVSFRDVCYAIRDDAFTASDLPLIVSLEVHCGPEQQLCMVDIMEEAFQGYLVPKPAEDAAVLPSPEALRNKILIKVKYAPPVDAPEVAGTSPSSVEDVHSNAVLAATDSAKSAPMSSTSETLSPSTTSPNLDTPKKKKKSKIIQRLSDMGIFTRGVSFKSLSQPEAVMPTHIFSVSEKAVLDLHEKYGQELFDHNRHYLMRTYPSGMRIGSSNLDPVVFWRKGIQVVALNWQNWDEGMMLNEGMFAGTRGYLLKPEGYRGNKSAATPTSTSGQTQATAVRHRTLDLAVEVFAAQNIPLPPGDEKVKSFRPYIKCEIHVEEPGERHGGADAVPHNGREKEGEFKARTKTIKGTVDPDYGGEILRFSAIDGVVEELSFLRFTVRDDELGRDDLAAWACVRLDRLRAGYRIIRLLDGKGMESDGLVLVKISKSIYDC

SEQ ID NO: 26020 - protein, 151 aa, Candida albicans SC5314
MSDERTFIAIKPDGVQRGLISSILGRFEQRGFKLVGIKLVQPTESLLRTHYEDLQSKPFFPSLLSYMLSGPVLATVWEGKDVVKQGRAILGATNPLQSAPGTIRGDFAIDMGRNVCHGSDSVESANKEIDLWFKKEELVEYKPALFGWIYE

SEQ ID NO: 26021 - protein, 566 aa, Saccharomyces cerevisiae
MEKSAEFEVTDSALYNNFNTSTTASLTPEIKEHSEESRNGLVHRFVDSFRRAESQRLEEDNDLEDGTKSMKSNNHLKKSMKSRHVVMMSLGTGIGTGLLVANAKGLSLAGPGSLVIGYVMVSFVTYFMVQAAGEMGVTYPTLPGNFNAYNSIFISKSFGFATTWLFCIQWLTVLPLELITSSMTVKYWNDTINADVFIVIFYVFLLFIHFFGVKAYGETEFIFNSCKILMVAGFIILSVVINCGGAGVDGYIGGKYWRDPGSFAEGSGATRFKGICYILVSAYFSFGGIELFVLSINEQSNPRKSTPVAAKRSVYRILIIYLLTMILIGFNVPHNNDQLMGSGGSATHASPYVLAASIHKVRVIPHIINAVILISVISVANSALYAAPRLMCSLAQQGYAPKFLNYIDREGRPLRALVVCSLVGVVGFVACSPQEEQAFTWLAAIAGLSELFTWSGIMLSHIRFRKAMKVQGRSLDEVGYKANTGIWGSYYGVFFNMLVFMAQFWVALSPIGNGGKCDAQAFFESYLAAPLWIFMYVGYMVYKRDFTFLNPLDKIDLDFHRRGLRP

SEQ ID NO: 26022 - protein, 683 aa, Rhodopirellula baltica SH 1
MPMTATTTDNQTLAIDTIRCLSMDAVQTANSGHPGTPMALAPIAYQLFQNTMNYDPAKPHWPGRDRFVLSCGHASMLLYSTLHLIGVQATDRYGKPTGGESISLEDIKNFRQIGSVCAGHPEFAEAAGIETTTGPLGAGVSNSVGMAMAEKWLAANYNTDDLTLFNYNTYAICSDGDLMEGIATEAASVAGHLKLDNLCWLYDDNNITIEGDTELAFSEDMGKKFEGLGWNVLHVDDANDVEALGKAIAKFQACGDKPTLIVVKSIIGYGAPNKQNTHGAHGAPLGWDEVALAKKSYGLPEDEKFYVPEGVRKHFAEGVGKRGATASSQWEDVWTKYQAAEPAKAAELKAMFAGELPEGWDKDIPVFEADAKGDATRNSSGKVLNAIAKNVPFMIGGSADLAPSNKSDLKFEGAGEFLPRQYKGRNLHFGIREHAMSGIANGLCLSGLRGYAATFFVFTDYMRGGMRLSSIMHQPTMYILTHDSIGVGEDGPTHQPVEHLTACRAIPGLNVFRPGDSNEVAECYRTAMGINDHPSAFVLSRQNMPTLDRSKYAAASGCARGGYILSDCEGTPDVILMGSGSELYMAVDAGEQLTAQGKKVRVVSMPCMDIFAQQDASYINEVLPPEVTNRVAIEAGIQMCWDRWIGSQGKFIGMHSFGASGPFDAVYEHFGINADAVVKAALS

SEQ ID NO: 26023 - protein, 340 aa, Atropa belladonna
MAFRNGSTTTTITTINHPNDASTIPKNGTNITTTLLKNGSTNEFGCIKPGWFSEFSQLWPGEAFSLKIEKLLFQGKSDYQDVMLFESATYGKVLTLDGAIQHTENGGFPYTEMIVHLPLGSIPSPKKVLIIGGGIGFTLFEVFRYPTIENIDIVEIDNVVVDVSRKFFPYLAAGFDDPRVTLVLGDGAAFVKAAQAGYYDAIIVDSSDPIGPAKDLFERPFFEAVAKALRPGGVVCTQAESIWLHMHIIKQIIDNCRQVFKGSVNYAWTTVPTYPTGVIGYMLCSTKGPQVDFRNPVNPIDKKTSHIKSKGPLKFYNSDIHKAAFILPSFARNLMESELD

SEQ ID NO: 26024 - protein, 92 aa, Glycine max
RLQPPHKYVPWVVVDGQPLYEDYENFEAYICKAYKGHPPKVCEGLARPPTPTVLEVAEAVNKVSYYDSGDIRLKPDEDGHAKIKKVVPDDDD

SEQ ID NO: 26025 - protein, 299 aa, Schizosaccharomyces pombe
SKLDSYTHLSFYEKRELFRKKLREIEGPEVTLVNEVDDEPCPSLDFQFISQYRLTQGVIPPDPNFQSGCNCSSLGGCDLNNPSRCECLDDLDEPTHFAYDAQGRVRADTGAVIYECNSFCSCSMECPNRVVQRGRTLPLEIFKTKEKGWGVRSLRFAPAGTFITCYLGEVITSAEAAKRDKNYDDDGITYLFDLDMFDDASEYTVDAQNYGDVSRFFNHSCSPNIAIYSAVRNHGFRTIYDLAFFAIKDIQPLEELTFDYAGAKDFSPVQSQKSQQNRISKLRRQCKCGSANCRGWLFG

SEQ ID NO: 26026 - protein, 404 aa, Nostoc punctiforme PCC 73102
MKKIFEIALGIVTSIGGFLDVGAIATAAEAGSIFGFQLIWAIILGTICVIFLVEMSGRLAAVSKHTLAAAVRERFGFNFYIIPLIAEIIVDFLVLAAEIGGVCIALQLLTGISFQWYALPVAFAIWLLIWYGNFGIIENGISVLGLVTLVFVVATFKLHPSLTQLGSGLLPTLPQQDTAHYLYLGVGILGALISPYLFYFYSSGAVEDKWDEGYIGVNRAVAGLGMSFGSVVSLGVLIVSALVLKPKGIEVDSYEQAALMLTESFGYWGFVLFAVSLGIACFGAALEVTLDTAYIVAQSFGWNWGENLKPKDAARFSLVYTVFVFLASLLMVFGIDPLQLTLFSMAITAVILPPVIIPFLVLMNDELYVGNYRNGWISNSVVIFTIVLTFVLAIVAIPLEILGG

SEQ ID NO: 26027 - protein, 180 aa, Sulfolobus islandicus
PKSVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 26028 - protein, 364 aa, Brassica napus
  misc_feature (126)..(126): Xaa can be any naturally occurring amino acid
  unsure (1)..(364): unsure at all Xaa locations
MRSKNNSSTIASFSLLDRRQAPRISGFEFWRMVFFRSVAAFTRLRSRVGQQSSLGSSVRWIQMQSSTDVDLKSQLQELIPEQQDRLKKLKSEHGKVQLGNITVDMVIGGMRGMTGLLWETSLLDPXEEGIRFRGLSIPECQKVLPAAQSGGEPLPEGLLWLLLTGKVPSKEQVKALSQDLANRAAVPDYVYNAIDALPSTAHPMTQFASGVMALQVQSEFQKAYENGIHKSKFWEPTYEDCLNLIARVPVVAAYVYRRMYKNGDSIPSDKSLDYGANFSHMLGFDDDNMKELMRLYITIHSDHEGGNVSAHTGHLVGSALSDPYLSFAAALNGLAGPLHGLANQVSLCLYPQQIFDCSIYGRAS

SEQ ID NO: 26029 - protein, 434 aa, Streptococcus thermophilus LMG 18311
MSIITDVYAREVLDSRGNPTLEVEVYTESGAFGRGMVPSGASTGEHEAVELRDGDKARYGGLGTQKAVDNVNNVIAEHIIGFDVRDQQGIDRAMIALDGTPNKGKLGANAILGVSIAAARAAADYLEVPLYSYLGGFNTKVLPTPMMNIINGGSHSDAPIAFQEFMIVPAGAPTFKEALRWGAEIFHALKKILKERGLETAVGDEGGFAPRFDGTEDGVETIIKAIEAAGYVPGKDVFIGLDCASSEFYDAERKVYDYTKFEGEGAAVRTAAEQIDYLEELVNKYPIITIEDGMDENDWDGWKALTERLGDKVQLVGDDFFVTNTAYLEKGIAEHAANSILIKVNQIGTLTETFDAIEMAKEAGYTAVVSHRSGETEDSTIADIAVATNAGQIKTGSLSRTDRIAKYNQLLRIEDQLGEVAEYRGLKSFYNLKK

SEQ ID NO: 26030 - protein, 180 aa, Sulfolobus islandicus
PKGVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 26031 - protein, 326 aa, Bacillus cereus G9241
MQKETAIIIGGGPCGLAAAISLQKVGINPLVIEKGNIVNAIYNYPTHQTFFSSSEKLEIGDVAFITENRKPVRNQALAYYREVVKRKSVRVNAFERVEKVQKDGEVFQVETTKRDGNKEIYIAKYIVVATGYYDNPNYMNVPGEELQKVAHYFKEGHPYFDRDVVVIGGKNSSVDAALELVKAGARVTVLYRGSEYSPSIKPWILPEFEALVRNGTIHMHFGAHVKEITEHTLTYTVDGEAYTIQNDFVFAMTGYHPDHSFLTKMGVRIDEETGRPIYAEDTMETNAENIFIAGVIAAGNNANEIFIENGRFHGDALAQTIATREM

SEQ ID NO: 26032 - protein, 464 aa, Archaeoglobus fulgidus DSM 4304
MEFISSRDMQILDTNCEYFGLSRMLLMENAGKGVAEEVMKRFYEGKVQIFAGSGNNGGDGFVAARHLKGFDVEIFLLSKPKTELAIKNLEICRKAGFPVKEGLPEEIDADIVIDAMLGTGVRGRLREPYSTAVKMINESDAFKVAVDVPTGLDPDSGSYEEAVKADLTVTFHKAKPGLAKAREVCGEVAVKDIGIPESFENLCGPGDVAFSYKRYEDAHKGVHGKVLVVGGGDYTGAPALASLAALYAGADIVTTAVPMAIRKVVASFSPNLIVRGVGEERIEMKNLEELEELVKRHDVVVAGMGVGENPEFKEVVEELLKSCKKAVLDAQGIVDSVPENCECILTPHRGEFGRVFGDTEVQKAALKAKAVILLKGREDVITDGSRVKVNRSGNAGMTVGGTGDVLAGIAAAFLCNDDAFHSACAAAFLNGLAGDVCFEKFGYNYTATDLVKAIPEAILRCKSF

SEQ ID NO: 26033 - protein, 342 aa, Arabidopsis thaliana
MNLDFDDSKRMHYGVTKQERVKMLQRFIKRVDGKLALCKNVPLNRFSIKCKDDVGPAPVIGWITNVLKRRVSELALDISSCWDWPMSTAIDGCNTMVQEFWESCSVSSTSLKRLTYLKANFDSLVEARLDLQMTHDQIHKAKFSADDPIQHEGLVGNATVFFIGICNVRSLYLSYNTLEVLCFCCEPLPVFNNLIQLTVKTDRLVGWESLTALLKNSPNLETLVFEGLLHRYDMKCQSSDECLCKPWEEENIPTCLSLSPVKVLKIMKFGDIDEDEDMDKMMDQVEYFLETMPNLEQLIIHYETSIDEDVEEVLSQFQMVPREGLTECRIQVISDNLVLSSI

SEQ ID NO: 26034 - protein, 222 aa, Zea mays
  misc_feature (96)..(96): Xaa can be any naturally occurring amino acid
  misc_feature (203)..(203): Xaa can be any naturally occurring amino acid
  unsure (1)..(222): unsure at all Xaa locations
MGEEASCDAVSLTEAGTNAKPVGKEVGREPAAAPAAAADPRLQGISDAIRVVPHFPKQGIMFNDITTLLLRPRVFKDAVDLFVERYRGMGIDAVAXLFRLARGFVFGPAIALAIGAKFIPLRKPRKLPGEVISEKYVLEYGTDCLEMRVGAIERSGERVLVIDDLVATGGTLCAAIRLLERAGADVVECACVIGLPKFKLGIXKDLYKLNGKPVYVLVESRE

SEQ ID NO: 26035 - protein, 377 aa, Oryza sativa (indica cultivar-group)
MPATAGRVRMPANNRVHSSAALQTHGIWQSAIGYDPYAPENNKHQPPSSSVSANAAAANAAAASAPSASAPSSSSAAASSDNAYTSFQGLLALARITGSNSDETRGACRKCGRVGHLTFQCRNFLSVKEDLDMEDDIDAGIRAASQANAQAKLDEFRKKTSGGKDADEGSDDEDEDDEEDSDDSSDSDIDPELERIIAERERAKSARKHSRDEEKKTSRHRSSSRGRSKHRRSTKRSDTEDDLEEERSKDKKKKSRRKRHERSDEDSESDSDKKRHRKSRKDRKRRRSHRRSDDTSDEDESGGEDRRRRRHRKRQHHHRKGASDGDSGSGASDSADDRKRSSRRRRHRKSESSGSDGDERHGQGAKRSKEKRGKEEC

SEQ ID NO: 26036 - protein, 436 aa, Haemophilus influenzae Rd KW20
  misc_feature (28)..(28): Xaa can be any naturally occurring amino acid
  unsure (1)..(436): unsure at all Xaa locations
MAKIVKVIGREIIDSRGNPTVEAEVHLXGGFVGLAAAPSGASTGSREALELRDGDKSRFLGKGVLKAVAAVNNEIAQAIVGKDATNQAEIDQIMIDLDGTENKSNFGANAILAVSLANAKAAAASKGLPLYAYIAELNGTAGVYSMPLPMMNIINGGEHADNNVDIQEFMIQPVGAKTLREALRIGAEVFHNLAKVLKAKGMSTAVGDEGGFAPNLASNADALACIKEAVEKAGYVLGKDVTLAMDCASSEFYNKENGMYEMKGEGKSFTSQEFTHYLEELCKEYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 26037 - protein, 694 aa, Zea mays
MVSARLVALAAFHLLVLLAMGPGEARAADGGEVRALLALGAALDPTGRLLPSWAPGRDPCAPPPSGGFDGVACDDSGAVANVSLQGKGLAGTLPPAVAGLRSLTGLYLHYNALRGGIPRELAALAALTDLYLDVNNFSGPVPPEIGAMASLQVVQLCYNQLTGSIPTQLGNLSRLTVLALQSNRLNGAIPASLGDLPLLARLDLSFNRLFGSIPVRLAQLPSLVALDVRNNSLTGSVPAELAAKLQAGFQYGNNSDLCGAGLPALRPCTPADLIDPDRPQPFSAGIAPQVRPSDGRAPSTRALAAVVVVAVALLAATGVGLLALSWRRWRRQRVAGGSPSTVSGGRCSSSTEAAPSAAKASSARKSASSALASLEYSNAWDPLADARGGLGLFSQDALAQSLRISTEEVESATRYFSELNLLGRRGKKAGGLAGTYRGTLRDGTSVAVKRLGKTCCRQEEADFLSGLRLLAELRHDNVVALRGFCCSRARGECFLVYDFVPNGSLSQFLDVDADNAGGGSGRVLQWSTRISIIKGIAKGIEYLHSTRTNKPALVHQNISADKVLLDYAYRPLISGCGLHKLLVDDLVFSTLKASAAMGYLAPEYTTVGRFSEKSDVYAFGVIVLQVLTGKSKVTTTHAQLPDKDVDELVDGNLQGDNYSAAEAAQLAKIGSACTSENPDQRPTMAELLQELSTI

SEQ ID NO: 26038 - protein, 154 aa, Cicer arietinum
ILGLLAMVLLISFEVSARDLTETSSNTEKEVAEQKNEVNDVKYGGGNYGNGGGNYGQGGGNYGNGGGNYGHGGGNYGNGGGNYGHGGGNYGNGGGNYGHGGGNYGHGGGNYGNGGHGGHGGGYCGNGCCGGYYSGSCRRCCSYVGEAIDVNTLN

SEQ ID NO: 26039 - protein, 327 aa, Fusobacterium nucleatum subsp. vincentii ATCC 49256
MEIEKMEKKLAILTSGGDAPGMNAAIRATAKIAESYGFEVYGIRRGYLGMLNDEIFPITGRFVSGIIDKGGTVLLTARCEEFKQARFREIAANNLKKKGIEYLVVIGGDGSYRGANLLYKEHGIKVVGIPGTIDNDICGTDFTLGFDTCLNTILDAMSKIRDTATSHERTILIQVMGRRAGDLALHACIAGGGDGIMIPEMDNPIEMLALQLKERRKNGKLHDIVLVAEGVGNVFEIEEKLRGHINSEIRSVVLGHIQRGGTPSGRDRVLASRMAAKAVEVLSKGEAGVMVGIEKNEMVTHTLEKACSVEKRKSIEKDYELALLLSK

SEQ ID NO: 26040 - protein, 410 aa, Mesorhizobium loti MAFF303099
MTLSFDLTTEGARDALRARAAPEKPSLIGLTRAELGEALVASGIVPERQAKMRAQQLWHWMYVRGVSDFAGMFNISKDLRAELDKHFTVARPEIVEEQISSDGTRKWLFRFPPRGAGRPVEIETVYIPEEGRGTLCISSQVGCTLTCSFCHTGTQKLVRNLTTEEILAQLLTARDRLGDFPDRDTPDGAIVPAEGRKVSNIVMMGMGEPLYNFEAVKKALLIASDGDGLSLSKRRITLSTSGVVPEIFRTGEEIGVMLAISLHATNDDLRDLLVPINKKYPLKELIAACRAYPGLSNAKRITFEYVMLKDVNDSIEDAKGLIKLLKGIPAKINLIPFNPWPGTNYQCSDWETIEKFADYINNAGYASPIRTPRGRDILAACGQLKSESERMRKVDRLALEAMMIAGHGEA

SEQ ID NO: 26041 - protein, 327 aa, Burkholderia xenovorans LB400
MIAKINGDRALALARDVLDIEADAVRALRDQLDDGFVGAVDFILGCRGRVVVSGIGKSGHVARKLAATLASTGTPAFFVHPAEASHGDLGMVTAEDVFIALSNSGETEELMAILPLIKRLGAKLIAMTGRPSSSLAQLADVHLNSGVAKEACPMNLAPTASTTAALALGDALALAVLDARGFGRDDFARSHPGGALGRRLLTYVRDVMRTGDDLPKVTPEATVRDALFQLTAKRMGMTAIVDHDDHVAGIFTDGDLRRVLEREGDFRQLPIASVMTAGPRTIGPDQLAVEAVELMERHRINQMLVVDEAGKLIGALNMHDLFSKKVI

SEQ ID NO: 26042 - protein, 506 aa, Myxococcus xanthus DK 1622
MIYAAPNQPGSKVQFKPRYQNFIGGRWVEPTRGQYFENISPVTGKPFCEVARSTAEDIEKALDAAHAARLSWGRTSPTARANILNKIADRMEQNREMLAVAETWDNGKPVRETLAADIPLAIDHFRYFAGCIRAQEGGVSELDHDTVAYHFHEPLGVVGQIIPWNFPLLMAAWKLAPALAAGNCVVLKPAEQTPSSILLWTELIQDLLPEGVLNVVNGFGVEAGKPLASSPRIAKVAFTGETSTGRLIMQYASENLIPVTLELGGKSPNIFFEDVMAQDDDFFDKSLEGFAMFALNQGEVCTCPSRSLISERIYSQFMEKALDRVRKVKPGNPLDTDTMVGAQASNDQLEKILSYIDIGKKEGAKVLIGGERVALSGDLKDGYYVAPTVFQGHNRMRVFQEEIFGPVVSVATFKDFDDAIRQANDTLYGLGAGVWTRDGNTAYRAGRAIEAGRVWTNCYHIYPAHAAFGGYKQSGIGRENHRKMLDHYQQTKNLLVSYSPKAMGFF

SEQ ID NO: 26043 - protein, 514 aa, Oryza sativa (indica cultivar-group)
MSSVEMSRAHGSPRSFFPVGNPFRVMFPGGAHLSRKLQELLASYEDALALSLRKLKPEAASDVLTLSWMRLAVDCLSELHTNIANLITDLELPVSDWDDKWVDIYLNSSVKLLDICIALSSELSRLDQGQLLLQYALHVLGSESGVPSQEQLKRAEPSLREWMELVGVRCPRLVSCSATLQELAGNLSLMKVKNSVKGKVLMRALYGIESVTVFVCSIFVAVLSGSPKPLVELHVPEKFGWSQAFNDLHTAVSEELTRQLAGGSVAAVKELEEVEACAKRLHVLASTSQLEEEAANLANAVSHTEEEVMSDSIVQEGDHHCGLKLADDTTRECEVVISESIAEEGTHEAEMKKDISYEKGVAMVERISYEEHQDSNVKQANGSSDESALVVPERTSVQESKEELLNCISSMSKSAEGLRHGLDSLSKRVGDFFQIVLTGRDALLCNLRISDAASKVAELGSTALYIVLLTCGPCSAPRKSRSLCAIAELANDMANLYSSCDSDCLAACSQQVRR

SEQ ID NO: 26044 - protein, 352 aa, Glycine max
MGTVAPRVESLASSGIKCIPKEYVRPEKELKSIGNVFEEEKKEGPEVPTIDLREIDSEDEVVRGKCRQKLKKAAEEWGVMHLVNHGIQDELIERVKKAGEEFFGLAVEEKEKYANDQESGKIQGYGSKLANNASGQLEWEDYFFHLVFPEDKRDLSFWPKKPADYIEVTSEYAKRLRGLATKILEALSIGLGLEGGRLEKEVGGMEELLLQLKINYYPICPQPELALGVEAHTDVSSLTFLLHNMVPGLQLFYEGQWVTAKCVPDSILMHIGDTIEILSNGKYKSILHRGLVNKEKVRISWAVFCEPPKEKIILQPLPELVTETEPARFPPRTFAQHIHHKLFRKDQEGLPN

SEQ ID NO: 26045 - protein, 180 aa, Sulfolobus islandicus
PKSVVINPYFEWEDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 26046 - protein, 438 aa, Pyrococcus horikoshii OT3
MLILNNMKANDIIKRYSKVIAQANKMHYFPLVPVKAENAKVWDINGKEYIDFLSDAAVQNVGHNNPRVVKAVKEQVDKLMHASYIYAYPIEPLLLAEKLAEIAPIDNPKVSFGLTGGDANDAAIKFARAYTKRQTILSYMKSFYGSTYGAMSLTGLDFRVRAIVGELSGVHYLPYPYCYRCPFGKEPGSCKMECVEYIKEKFEGEVYAEGVAALFAEPIQGDSGIVVPPKNYFKKVTKILREHGILLVVDEIQSGMGRTGKWFAIEHFGVKPDIITVGKALGGGLPISATIGKAEIMDSLPPLSHAFTLSGNPTTSRAALAVIEEIEEKNLLRRAEKLGNYAMKRLREMMDKHELIGDVRGIGLMIGVELVKDRETKERAIEETSKVIERAFDLGLIVTHFSGNVLRIEPPLTIERETLDEGLDVLEKAIEDVEEGRV

SEQ ID NO: 26047 - protein, 180 aa, Sulfolobus islandicus
PKSVVINPYFEWDDEDFIKRNKVPLKDTVIYEVHVKGFTKLRLDLPENIRGSYEGLTSEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 26048 - protein, 383 aa, Triticum aestivum
DISKNFLVGQIPASFKDLKSLKFLSLAANNITGQIPSSLGQLKSLEVLDLSSNSLSGNIPSNIVTLRGLTTLLLNNNELSGNIADLTPSVSSPSVFNISFNNLAGPLHSNVRALSENDGSPEPENTPSDGGGFTKIEIASITSASAIVAVLLALIILYIYTRKCASRPSRRSNRRREVTVFVDIGAPLTYETVVRAAGSFNASNCIGSGGFGATYKAEIAPGILVAIKRLAIGRFQGIQQFQAEVKTLGRCRHDNLVTLIGYHLSDSEMFLIYNFLPGGNLERFIQERAKRPIDWRMLHKIALDVARALAYLHDNCVPRILHRDVKPSNILLDNEYTAYLSDFGLARLLGNSETHATTGVAGTFGYVAPEYAMTCRVSDRLMC

SEQ ID NO: 26049 - protein, 180 aa, Sulfolobus islandicus
PKSVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQQDNKRYYLDF

SEQ ID NO: 26050 - protein, 614 aa, Oceanobacillus iheyensis HTE831
MCGITGFVNWGKTADEQRSVLGKMTDTLSLRGPDDTQLWTKGHTGFGHKRLSVVDLEGGKQPMSKTVNGITYTVCYNGELYNTEDLRKELLKRGYTFSTTSDTEVLLTSYIEWKEACVDHFNGIFAFGIWDEEKEQLFMSRDRLGVKPLFYAEKAKGFIFGSELKAILAHPDISTKVDRTGLSEIFGLGPSRTPGHGLFKDIDELRAAHSLTFSKHGLKVWRYWNMVSNHHTDSEEETAEKVRELFVDAVQRQLVADVPVSTLLSGGLDSSAITAIAANYYKEKGYGPLTTFSIDYQGNEQHFQKSKFQPSSDRAWIEKMVEGFSTDHHDEIIAGQELAILLKEAVEVRDQPGQADIDSSLLWFCREIKQHTTVALSGECADEIFGGYPWFHDPAAAGNNFPWIRSLDSRIDLLHGDWKKKLDLESYVQEQYQSTIAETPRLDGEDKIDAKRRELFYLNMQWFMSQLLDRKDRMSMGASLEVRVPFADHRLVEYVWNIPWDIKMVNGHEKGILRKAMEGILPNEVLYRKKSPYPRTFQPEYTEQVSQWMNRILVDPNARLFEFMKKEKVEAIVKSKGKEFKDPWYGQLMRGPQLIAHLCQIDHWLRQYDVEVVD

SEQ ID NO: 26051 - protein, 465 aa, Chromobacterium violaceum ATCC 12472
MSLMRKKSVQGMLAAAQTSRGLRKELSAFDLTMLGIGAIIGTGIFVLTGTGATIAGPGLVLSFVISAFACGFAAMCYAEFASMLPISGSTYTYAYATLGELIAWIIGWDLLLEYLLASSAVSVGWSGYFQSLLSGFGVTLPQALTAAAGSVPGKETLFNLPAFCIAMIITALLAFGIKESKRVNNIVVLIKVAVVVLFIAIGVWHVKPANWQPALPFGFSGVFHGAAIVFFSFIGFDAVTCAAEEVKNPAKDIPRGVIWSLVVCSILYVVVAAIMTGIVPYMNFAGVDHPVSLALQVAKLDWFAGFVDLGAILGMMTVILVMTYGQTRILFAMSRDGLLPKIFSEVNPKYGTPYKATWLIGTIIALLAGFVPLHTLAELVNIGTLAAFTLIALSVIVLRKREPDLPRKFVCPAVPTIPALAILCCGFLMTQLSLLTWTCFAAWLLIGLVVYFGYSRRNSLLHNPA

SEQ ID NO: 26052 - protein, 260 aa, Xanthomonas campestris pv. vesicatoria str. 85-10
MTIGGMCLVALAWKAHPRWRLLLVGNRDEFHERPTAALARWAAPADNMLAGRDLRSGGSWVGLGRDGRAAVVTNVRDPLATASGRSRGHLIADYLSGSLSATAYGNALAGAAHEFPPFNLLLCDADRCEHLSNHPPLARRLAAGIHGMSNGPLDAPWPKTAALTRVLHRWCASGEEDLQPLWAAPGNPAIAPDAALPQTGVDLPTERLLSAAFISGPSYGTRASTIVAADHHGHGFIHERRFGPNGSFQGETRLEIPGSR

SEQ ID NO: 26053 - protein, 224 aa, Oceanobacillus iheyensis HTE831
MNEQDKLKKAVGEKAATMVKDGMKVGLGSGSTVYWMIRSLGERIQQDGLKIEGIPSSNQTATWAEEAGIPLTDFSNVKELDITIDGADEVDANNHLIKGGGAALFREKIIAQAAKEFVIIVDQSKVVETLGEFSLPVEVLPFSWQRTANEISKLGCVPTVRVHEEEPLVTDNGNYILDCPFKVIPHPDKLNKEIKSIVGVIETGLFIDMATTVIVGEKDNIYIK

SEQ ID NO: 26054 - protein, 226 aa, Brassica napus
  misc_feature (221)..(221): Xaa can be any naturally occurring amino acid
  unsure (1)..(226): unsure at all Xaa locations
MDSNGVDEQEMKLVQGAAGYVLEDVPHLTDYILDLPTYPNPLQSNPAYSVVRQYFVDEDDTVPQKIVVHKDSPRGTHFRRAGPRQKVYFKPADVRACIVTCGGLCPGLNTVIREIVCGLHYMYGVTEVLGVNCGFSGFYSKNTVTLTPKDVSDIHKRGGTMLGTSRGGHDTSKIVDNIQDREINQVYIIGGDGTQKGASAIYKEFRRRGLKVGVAGIPKTXDNDIP

SEQ ID NO: 26055 - protein, 451 aa, Nostoc punctiforme PCC 73102
MVADVFELPAPSVNSIVGHLFELGQDPLGFLTRCRDYGDIVPLQLGLTPSCLIINPEYIEEVLKNRNDFIKSRGLRALKSLLGEGLLSAEGESWFWQRRLAQPVFHQKRINGYSQTMVEYTNRMVQTWHDGETHDIHEDMMRLTLQIVMKCIFSDDIDAGEAKVVADALDVAMQWFESKRRQNFLVWEWFPRPENIRYRDAIAQMDEAIYKLIQERRNGGEKTNDLLTMLMEAKDEQTLQQMDDKLLRDEVATLMLAGHETTANTLSWTWMLLAQNPGVREKLESELNQVLQGKLPTLEDLGQLVYTQQIIKESMRLYPPVPLMGREAAVDTQIGDYEIPQGMAIMISQWVMHRHPKYFENPEAFQPERWTQEFEKQLPKGVYIPFGDGPRICIGKGFAQMEAALLLATIAQRFQIDLVPGYPIVPQPSITLRPENGLKVQLKQIALDTSK

SEQ ID NO: 26056 - protein, 188 aa, Burkholderia xenovorans LB400
MSNALPSAPLDAADYIKSHIRTVPDWPEPGVQFRDITPLLQEPKSLRVLIDLFVQRYIDAKLDYIAGLDARGFIIGPILAYELNLGFIPIRKAGKLPYNRLAQSYELEYGCATVEIHEDACKPGDRVVIIDDLIATGGTMMAGKILLERLGAVVVEGAAIIDLPELGGSKLLRDSGLALYTVTGFEGH

SEQ ID NO: 26057 - protein, 221 aa, Alteromonadales bacterium TW-7
MKYDAAFFDLDGTLVDSIYDLYISINLTLSDLAFPIVSQSLVESWVGNGIDMLVKRALSGDMQVSEHLDESLTNKAIAQFHKHYEQQVGQYSVLYQHVETGLAALRGMQKALITNKSRIFTEKLLDKLALTNHFELIICGDDMVKKPSPDPLLFACKKLNIEASKAIMIGDSKSDILAAKAAGIDVIAVGYGYNQGENLADYNPQYLCDNFLDIIPVLTQR

SEQ ID NO: 26058 - protein, 310 aa, Rhizobium leguminosarum bv. viciae 3841
MKVGVSILGIFVADTAYLAKRMPNVGETITGTGFAVGPGGKGSNQAVAAARAGGTVSFISKIGRDTFGDMALKTYAEAGVTPKVVQMDDMPTGAAFIYVNDGNGDNAIIVYPGAAGTIGIGDVEAARETIEQSAVFVTQLEQPAEAAQRALEIAHAAGVTTVFNPAPAEPFPDTIYPLCDYIVPNETEAAAIVGFPLDTLDDARRAGDALLAKGVKAALITLGGRGVLYHTARQSVHVPAVSSGAVIDTTGAGDAFVGGFSAALSRGASPVEAVRFGCATAGIAVTRRGTAPAMPKIEEIEALLQKGGAA

SEQ ID NO: 26059 - protein, 197 aa, Triticum timopheevii subsp. armeniacum
NQRSKSAFVPSVSILNMKNFASCSLRPLYLTRLDDPHTSELKPRRQLLDFWCAASAADDKESKAEVVPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPV

SEQ ID NO: 26060 - protein, 375 aa, Nostoc punctiforme PCC 73102
MARDYYEILGVSRDTDKEELKQAYRRLARKYHPDVNKEPGAEDRFKEINRAYEVLSEPETRARYDRFGPEGVSGAGAGFQDVGDMGGFADIFESIFSGFAGGMGSPTQQRRRSGPARGDDLRLDLKLDFREAVFGGEKEIRISHLENCEVCSGSGAKPGTRPRTCSTCSGSGQVRRVTRTPFGSFTQVSTCPTCNGTGMVIEDKCDACDGKGANQVTKKLKITIPAGVDNGTRLRISSEGDAGQRGGPSGDLYVYLFVNEDEEFQRDGINILSEIKISYLQAILGCRLEVDTVDGPVELIIPAGTQPNTVMKLENRGVPRLGNPVSRGDHMLNVLIDIPNKVTPEERELLEKLAKIKGDRTGKGGLEGFLGNLFK

SEQ ID NO: 26061 - protein, 468 aa, Saccharomyces cerevisiae
MGQILSNPIIDKEHHSGTDCLTAFGLCAMQGWRMSMEDAHIVEPNLLAESDEEHLAFYGIFDGHGGSSVAEFCGSKMISILKKQESFKSGMLEQCLIDTFLATDVELLKDEKLKDDHSGCTATVILVSQLKKLLICANSGDSRTVLSTGGNSKAMSFDHKPTLLSEKSRIVAADGFVEMDRVNGNLALSRAIGDFEFKSNTKLGPHEQVVTCVPDIICHNLNYDEDEFVILACDGIWDCLTSQECVDLVHYGISQGNMTLSDISSRIVDVCCSPTTEGSGIGCDNMSISIVALLKENESESQWFERMRSKNYNIQTSFVQRRKSIFDFHDFSDDDNEVFAITTKKLQDRLNRSKDNDDMEIDDLDTELDSSATPSKLSGEDRTGPIDLFSLEALLEAGIQIRQRPSSDSDGNTSYFHGASLSDMLASLSNAAAGETEPNDADDNDDNDGEENGKNENAKKGSKIEEIE

SEQ ID NO: 26062 - protein, 440 aa, Pyrococcus horikoshii OT3
MKIVVIGSGTAGSNFALFMRKLDRKAEIIVIGKEPTMQYSPCALPHVISGTIEKPEDVIVFPNEFYEKQRIKMMLGVEAKKIDRERKVIITDKGEVPYDKLVLATGSRAFIPPIKGVENEGVFTLKSLDDVRRIKEYISKRKPKKVVVIGAGLIGLEGAEAFAKIGMDVLVVELLEHLLPTMLDKDMAKIVQEEMEKHGVKFKFGVGVSEIIGNPVKEVKIGEESVEADLVLVATGVRANVDLAKDAGLEVSRGIVVNEYLQTSDPDIYAIGDCAEVFDAVTGKRTLSQLGTSAVRMAKVAAENIAGKKVKFRPVFNTAITELFDLEIGTFGITEERAKKEGIEVVIGKFKGSTKPEYYPGGKPITVKLIFRKEDKRLIGAQIVGGERVWGRIMTLSALAQKGATVEDVAYLETSYAPPISPTIDPITVAAEMAMRKFKS

SEQ ID NO: 26063 - protein, 68 aa, Zea mays
  misc_feature (49)..(49): Xaa can be any naturally occurring amino acid
  misc_feature (54)..(55): Xaa can be any naturally occurring amino acid
  unsure (1)..(68): unsure at all Xaa locations
GSWDTTLIFHHAGVAATLNTRLCSNRGPSTNQVHLTLGTTAVICWWMMXAIVHXXQRKPLNNPILSGE

SEQ ID NO: 26064 - protein, 180 aa, Sulfolobus islandicus
PKSVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPENKRYYLDF

SEQ ID NO: 26065 - protein, 383 aa, Magnaporthe grisea 70-15
MSRYLRPAVRMAATAARAPALRSSTGTSSLIGSQRAAAFRPAVSMQQRWASSGTKEYTVREALNEALVEELEANDKVFVMGEEVAQYNGAYKVTKGLLDRFGERRIIDTPITEMGFTGLAVGAALSGLHPVCEFMTYNFAMQSIDHIVNSAAKTLYMSGGIQPCNITFRGPNGFASGVGAQHSQDYSAWYGSIPGLKVVSPWSAEDAKGLLKAAIRDPNPVVVLENELMYGQSFPMSEAAQKDDFVIPFGKAKIERQGKDLTIVTLSRCVGQSLVAAENLKKKYGVEVEVINLRSIKPLDINAIVQSVKKTHRLMSVESGFPAFGVGSEILALTMEYAFDYLDAPAQRVTGADVPTPYAQKLEEMSFPTEQIIEEHAAKMLKL

SEQ ID NO: 26066 - protein, 605 aa, Oryza sativa (japonica cultivar-group)
MKKKKNGMGAAADRGRLLALAHHDKLNPTKPSEAQRRFKPSILLLLGSSLPRLVPPLPSSFLPVVIKQTEFHQRWLVGDLNPPPPPCHLLPIQGQGQMQMQQRRKPPPAAAPVAAKQPSPRRTPGPLSFAGALLSLLVVATFLYINDHGNMMPPHASPDPDLRLLQEAAHQKVNSILLSRHAPAPPPRTNTNTSSSDQHLRLINIPMSSDLDLELGGNSTSSSGVEIQFEQQQQQEEKNLRGCELYKGRWVYDAAGREAPLYRESECGFLTEQVTCMRNGRRDDSYQRWRWQPEGCDLPSFDARALLERLRNKRMMFVGDSLNRNQWESMVCLVQSAIPYGQKTLTKFVNNGSLNVFRAHEYNATVEFYWAPFLVQSNSDDPQVHSVRDRVIAWRSIAKHAANWKGVHYLVFNTYIWWLNNFQIKVLKSRGAPFAGSGGWSSRYALVDRAIAYREVLKTWAKWVDRRIDPNKTHVFFMAMSPNHFMPEAWGGSAGAVKCAMETQPIVNRTSGGLDIGTDWRLHGVARGVLRSMRRVGVRFVDITALSELRKDAHTSVHTLRQGKLLTPEQQADPRTYADCIHWCLPGLPDTWNHFLYAHIVAHAA

SEQ ID NO: 26067 - protein, 456 aa, Xanthobacter autotrophicus Py2
MMYLIAAIAGIAGALFGFDEGVIAGALAPLRRDLGIDPVAEGMMTAAVPFGAFLGAIVGGRLALALGRRRLLLAAAVLFVVGALLSAFAFGLWTLTFARLIIGLGVGVAAMMAPLYISECAPAAQRGMLVSIYQLAITLGILGAYVVGYAFHESWRWMFAVGAVPAIALFVGIFGLSDTPRWLAVRGREAEARAALARVREKSESDPAVKAEFAEILTGATQDENRKARLSDLLTPRVRPALIVAMGLFLLQQLSGINAVIYYAPTVFELSGFSSTTTQILATAGIGVVNVLMTLVGMALIDRLGRRLLLLIGFAGTAVALSVIAIGAATGSEMMGKLALGGLVLYIASFAIAIGPLPWVMMSEVFPLDVRALGMSIASLVNWGFNFLVVFSFPVLVAEFGLAGVFGLYAVVCVVGLAFTQWLVPETSGVSLEEIERHLDSGRPLRDLGRFTPRAA

SEQ ID NO: 26068 - protein, 444 aa, Xanthobacter autotrophicus Py2
MKTLLLTASLVLLFGILFGFSTASIAGVVEAIAQAFALSTRATEMVVTSLLVGCFIGAAAAAPVSARIGRRPACLLAAVLAMAGYSLIPLGQGVAPGAGMLVAARILIGLGVGLSSMVVPMYAAEVTPARHRGAVVSLFQLAITLGILAGYAVPLALIGRASWQQMLGGGVLVAAACAAIVLLLPESPRWLRSRGMSARADAAARALGISDEMGEEHAPDGANWRAVLGRGATGAVLVLCSVLFVLQNFSGIDGILYYAPHIFTELGFPAGTAALAATFGLGLFNVIATIAAMALVDRLGRRPLLIVGSAAMAVSLGAVIVAALADWPWVALAGLCAYIVAFALSLGPLPYVLMSELFPSAIRERGIAVASATSWLFNGIVAGTFLSVVQGIGLAGTIGIFFVVCVLSLVVSVLFVPETRRIGLEEIEADVLDGRPLRQLGAGG

SEQ ID NO: 26069 - protein, 454 aa, Haemophilus influenzae Rd KW20
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEQYFENFIEDVESGVVKPAAVILEAIQGEGGVVSAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQSECEEFIKRFKQSVVDALKVVRS

SEQ ID NO: 26070 - protein, 366 aa, Oceanobacillus iheyensis HTE831
MEKHIILLPGDGIGREIIDSAKQVLTAIASEYNHRFTFEEHAIGGSAIDEYGTPLPDKTVDACSKADAILLGAVGGPKWDANPSHLRPEKGLLGIRKQLGLFANLRPVKTISSLLYASPLKEEIVSQADMLIIRELTGGIYFGTPSERTTNGVVDTLQYSREEIERIVERGFEAARIRKKHLTSVDKANVLESSKLWREIVEEKSKDYPDVAVNHLLVDAAAMKLVTQPSFFDVIVTENLFGDILSDEASVLTGSLGMLPSASLRADGLGLYEPVHGSAPDIAGKGIANPLAMILSAALMLEHSFGLVDEAKEIERAVNDCLLQGFHTADIHIPGGVQVGTKQMTDAVLENVTTKSISDSICSSYV

SEQ ID NO: 26071 - protein, 376 aa, Mycobacterium tuberculosis H37Rv
MTKSLPGVADLRLGANHPRMWTRRVQGTVVNVGVKVLPWIPTPAKRILSAGRSVIIDGNTLDPTLQLMLSTSRIFGVDGLAVDDDIVASRAHMRAICEAMPGPQIHVDVTDLSIPGPAGEIPARHYRPSGGGATPLLVFYHGGGWTLGDLDTHDALCRLTCRDADIQVLSIDYRLAPEHPAPAAVEDAYAAFVWAHEHASDEFGALPGRVAVGGDSAGGNLSAVVCQLARDKARYEGGPTPVLQWLLYPRTDFTAQTRSMGLFGNGFLLTKRDIDWFHTQYLRDSDVDPADPRLSPLLAESLSGLAPALIAVAGFDPLRDEGESYAKALRAAGTAVDLRYLGSLTHGFLNLFQLGGGSAAGTNELISALRAHLSRV

SEQ ID NO: 26072 - protein, 467 aa, Triticum aestivum
  misc_feature (117)..(117): Xaa can be any naturally occurring amino acid
  unsure (1)..(467): unsure at all Xaa locations
MPADHEAECCSWCDQEMSLHSSPAAAGDAPTGTAEELLERARGLGPDALDAARAATGFGGRWKAIAARLEKVPPCLSDLSCHPCFSKNALCRELLQSVAATLAEAAELGVLCREPPXRAGKLQMQSDLDALAGKLDLNLRDCALLVKTGVLSDATVPSPPAEAAAAAASQTDVRELLARLQIGHAEAKHRAVEGLLDALREDEKSVLSALGRGNVAALVQLLTATAPKIREKAATVLCLLAESGSCEGLLVSEGALPPLIRLAESGSLVGREKAVITLQRLSMSPEIARAIVGHSGVRPLIEICQTGDSISQSAAAGALKNLSAVPEVRQALAEEGIVRVMISLLDRGVVLGSKEYAAECLQNFTSSNDNLRRAVVSEGALPSLLAYLDGPLPQESAVGALRNLVSAVSPDNLVSLGVLPRLAHVLRDGSVGAQQAAAAAICRISSRLSQAKAKLDDAHHHLGVRMG

SEQ ID NO: 26073 - protein, 417 aa, Chromobacterium violaceum ATCC 12472
MSGTDMPLQPSALRRLRHLLAALGPGLVVMLADTETGSVIAAAQSGAHWGYRMLPLLLVLIPLLYLAQELTIRLALGTGLSYGELVRRRWGRRAERASAAVLLLSCLGALATQLAGLAGIGQLFGIPAWQTITLLCALVLAMVCTGSYRSVERIVLCLGVFELAFLAEAWLARPDPGQMAAQLSSLPLGSHDFLLLAAANIGTCVMPWTLCYQQSALLDKGLTLDDLKPARLDTLLGAILCQIITAGILIAAAAAFGDGAGGQSLDTIPEIAGGFTRLLGPTGGRLLFALALGGGALVAAIVVCLTSAWTLGELAGRRDSLEKHPLDAPWFYGGFAAMLAGADALVASGVNLVKLSIVTSVANALLLPVMLAGLYWLACRELPAPLAPSRRYRMALAPLLLLLAGFSLYAGVVGSLG

SEQ ID NO: 26074 - protein, 376 aa, Symbiodinium sp. clade C
  misc_feature (97)..(97): Xaa can be any naturally occurring amino acid
  unsure (1)..(376): unsure at all Xaa locations
MGDEEVAALVVDNGSGMCKAGFAGDDAPRAVFPSIVGRPKMPGIMVGMDQKDSYVGDEAQSKRGVLTLKYPIEHGIVTNWDDMEKIWHHTFYNELRXAPEEHPVLLTEAPLNPKANRERMTQIMFETFNVPAMYVAIQAVLSLYASGRTTGIVMDSGDGVSHTVPIYEGYALPHAILRLDLAGRDLTEYMMKILTERGYSFTTTAEREIVRDVKEKLCYIALDFDSEMKAASESSDKEKTYELPDGNIITVGSERFRCPEVLFQPSFVGKEASGIHDTTFQSIMKCDVDIRKDLYANVVLSGGTTMFQGIGERMTKELTALAPSTMKIKVVAPPERKYSVWIGGSILSSLSTFQQMWISKGEYVESGPTIVHRKCF

SEQ ID NO: 26075 - protein, 577 aa, Streptococcus mutans
MTEMLKGIAASDGVAVAKAYLLVQPDLTFETVSVTDTQAEEARLDAALEASQNELSLIRQKAVDTLGEEAAAVFDAHLMVLADPEMIGQIKETIRTKEVNAESALKEVTDMFVTLFENMEDNPYMQERAADIRDVAKRVLAHLLGVELPNPATISEESIVIAHDLTPSDTAQLDANYVKAFVTNIGGRTSHSAIMARTLEIAAVLGTNDITERVKNGDIVAVNGITGQVIINPTEDQIAEFKAAGETYAKQKAEWALLKDAETVTADGKHFELAANIGTPKDVEGVNNNGAEAVGLYRTEFLYMDSQDFPTEDEQYEAYKAVLEGMNGKPVVVRTMDIGGDKELPYFDLPKEMNPFLGFRALRISISETGNQMFRTQLRALLRASVHGQLRIMFPMVALLNEFRKAKGILEEEKANLKAEGVAVSDDIQVGIMIEIPAAAMLADQFAKEVDFFSIGTNDLIQYTMAADRMNEQVSYLYQPYNPSILRLVDHVVKAAHAEGKWAGMCGEMAGDQTAVPLLVGIGLDEFSMSATSVLRTRSLMKKLDTAKMQELAQRALTECATMEEVLELEKEYIDFD

SEQ ID NO: 26076 - protein, 757 aa, Oryza sativa (indica cultivar-group)
MEIQKSDHHEQNLTSPRGLIHKVLRRTSSRRSPTAADHNPSPVFLETSNSKFLKQKDIDDAIKDPEKAGTHDNRIEDEKSDLLGYEICSGKLTLDNKAKSASGEQSGSGSSSNCFDARLTTEALVWGSNILKLEDIVSVSYHSGLRHFTVHACPLEKRSSGLSCFMKPRKIQKDLRFLSTSPHEAFRWVNGFADQQCYVNLLPHPMASSKKHSSELIPFDNMFDPCVKCRSPPKILVILNPRSGHGRSSKVFHGKVEPIFKLAGFKMEVVKTTHAGHAKSLVSTIDFSTCPDGIVCVGGDGIVNEVLNGLLCRDDQNVAVSVPIGIIPAGSDNSLVWTVLGVKDPISAAMSIVRGGFTPIDVFAVEWIQSGTIHFGTTVSYFGFVSDVLELSERYQKRFGPLRYFVAGFLKFLCLPKYSFELEYLPISDGGGGEHKIVEGQDKVDASDLYDDVVRRSRVECLPRASSLSSIDSIMSTGIMSGGDLEVSSPHANNEPSELVRALDPKSKRLSLGRTSTFKEPEEVIHPQAHVSSTPNWRRSKSKSRTEKAWPGAGATNDANSSRGTTTHDKEDASSTISDPGPVWDSGPKWDDEPKWDNQPNWEPETPIDLPGPLDDIELGLTKELVPSLDERWTVRKGRYLGVLVCNHSCKTVQSLSSQVIAPKAEYDDNCLDLLLVGGSGRLRLLKFLVLLQFGKHISLPNVEYLKVKSVRLKAGPNTHDGCGIDGELLHVKGQVRCSLLPQQCRLIGRPAKNPVQ

SEQ ID NO: 26077 - protein, 209 aa, Ricinus communis
MATVQGGVHDSPQGTANNAEIDGIARFAVDEHNKKENAMVEFGRVLKAKEQVVAGTLHHLTIEAIEAGKKKIYEAKVWVKPWLNFKELQEFKHATDVADTTASHPSFTSSDLGVKREGHGAEWKEVAAHDPVVQDAATHAVNTIQQRSNSLFPYQLQEIVHAKAQVVDDFAKFDMILKVKRGTSEEKFKVEVHKNNEGTFLLNQMEPHT

SEQ ID NO: 26078 - protein, 186 aa, Candida albicans SC5314
MNRGRGGFRSGRGGRSGPVQYGPPDTVLEMGSFMQACEGDIVCRSINVKIPYFNAPIYLENKTQVGKVDEILGPLNEVFFTIKPSEGVKAESFKEGDKFYIGPDKLLPLERFLPKPPSVGPKPKRKTGGKSAGGSSRGGFSSRGGGRGGFSSRGGGRGGFSSRGGGRGGARGNSRGGFRGGRGGRF

SEQ ID NO: 26079 - protein, 469 aa, Oryza sativa (indica cultivar-group)
MAHVMAASELVTATIKRPFQNDDDNSSNGNGNADGKPKARRREADPAAALAAARHEFGEHGGVNMSIEASATFTVMEPDTMRRLFAGELGPERGDLYIYSRHFNPTVLALGRQMAALEGTEAAYCTASGMSAISSVLMQLVGAGGHVVASRCLYGGTHALLSRFLPRASGVRATFVDADDEAAVRAAVRPGETRVVYVETMSNPTLAVADIPMLARVAHDAGAKLVVDNTFTPMVVSPARLGADVVVHSVSKFISGGADIIAGAICGPASLVNAMMDLQEGALMLLGPTMNAKVAFELSERLPHLPLRMQEHSRRAAEYASRMRRLGLRVAYPGLPDHPHHARLLAIANPGYGAGGMLCVDMGTEDRANRLMHHLQNTTRFGLMAVSLGYYETLMSCSGSSTSSEMPPEDRARAGISPGLVRMSVGYNGTLEQRWAQFERALSLMQQQQQQHPDRDAAAKYCKIVEWHS

SEQ ID NO: 26080 - protein, 638 aa, Blastopirellula marina DSM 3645
MCGITGAAWTDPQLAVSAEALRRMTDCISHRGPDDAGYLHRELENRNPYPAVPGVALGHRRLSIIDLAGGKQPLANEDETVWTIFNGEIFNFAALRGRLEGAGHTFRTHSDTETIVHLYEDEGPDCFRHFNGMFAIAIWDLRERRLVLGRDRLGQKPLYYYHHAGRIVFGSELKTLLALPDVPREIDPTAIDEYLTYQYVPHPNTILKGIKKLAPGELAVFSDAGLHVERYWKPDFTHEDRRPAALQDAELRELFDDAVRLRMQADVPLGAFLSGGVDSSLVVSSMQRQSDRPVKTFSIGFPQKEYDETSFARQVAEHLGTEHHEFQVTPSALEILPKLIWHYDEPMADSSAIPTWYVSQQTRAEVTVALSGDGGDELFAGYRRYRAVGLGAMIDRLGPLKRVLGAKLWQQLPSSGRQKSRMRQAKRFAEAIAMAPERRYLDWVSIFNETRRGQLYTDAFVAQLSDSDPFDFLKSAWRRCGKRDAITCASLADLTTYLPCDLNCKVDIASMAHGLECRQPFLDYRLVEFAAALPIGRKYQRGRGKQILRKVFGDRLPAQIWDRPKMGFGVPLDYWFRHELKELLIDSLLSEKALSRGLFREETVRQLLDEHMAGQFDHSARLWALLVLELWQREWIDA

SEQ ID NO: 26081 - protein, 598 aa, Oryza sativa (japonica cultivar-group)
MGTYKCCLIFKRRFRWNDAPPPDDVRALFANHSAGGGPHMAADGLRAYLQATGQDGDVDMERLVEQIRQLQGRGGRIPRVGRALPLLTVDDFHRFLFSHELNPPIRHGQGQVHHDMAAPLSHYFIYTGHNSYLTGNQLSSDCSDLPIIRALQRGVRVIELDMWPNSSKDDISILHGRTLTTPVSLLKCLLSIKQHAFEASPYPVIITLEDHLTPDLQDKAAKMVLEVFGDILYYPDKDHLKEFPSPQDLKGRVLLSTKPPREYLQAKDGNAATIKEDAKAAATDDAAWGKEVPDIHSQIHSATKHDQREDDDDTDEDEDDEEEEQKMQQHLAPQYKHLITIKAGKPKGTLLDALQSDPEKVRRLSLSEQQLAKLADHHGTEIVRFTQRNLLRIYPKGTRVTSSNYNPFLGWVHGAQMVAFNMQGYGRALWLMHGFYKANGGCGYVKKPDFLMQTDPEVFDPKKSLSPKKTLKVKVYMGDGWRMDFTQTHFDQYSPPDFYARVGIAGVPADSVMKRTRAIEDNWVPVWEEDFTFKLTVPEIALLRVEVHEYDMSEKDDFGGQTVLPVSDLIPGIRAVALHDRKGIKLNNVKLLMRFEFE

SEQ ID NO: 26082 - protein, 250 aa, Geobacter metallireducens GS-15
MAQQFKDYFSEKSDVYRSYRPGYPTELFAWLAGLPARRDAALDCGCGTGQASVALAEHFARVYAVDPSAGQIKSATPHKRVEYRVAPAEETGLPDASVDLVIAAQALHWFDFSRFYAEVRRVARGGAVFAAFTYGLLAIDDEIDRIIGRFYRDVIGPYWPPERAHVDAGYRTLPFPFAEIETPTFAMKAEWDLGHLMGYFETWSAVKEYRRLRGDDPLELVAGDLATAWGDPALVRQVSWPLVLRAGRIE

SEQ ID NO: 26083 - protein, 544 aa, Dechloromonas aromatica RCB
MSHQKILILDFGSQVTQLIARRVREAKVFCEIHPYDVSEEFIRNYGAKGIILSGGPSSVTEGDTPRAPEVVFQLGVPVLGICYGMQTMAQQLGGKVMTAEAAGKSREFGYSEVRAHGHTALLNDIADFYSPEGHGMLKVWMSHGDSVMELPAGFVKMASTASCPIAAMADESRKFYAVQFHPEVTHTQQGRAILERFVHGICGCGTDWVMGDYIAEAVDAIRRQVGDEEVILGLSGGVDSSVAAALIHKAIGDQLTCVFVDHGLLRLNEGDMVMEMFARNLGVKVIRVDAVDDFMGKLAGVSDPEQKRKIIGKEFVEVFQVESKKLAAAKWLAQGTIYPDVIESAGKGKKGAHTIKSHHNVGGLPEDMHLKLLEPLRELFKDEVRELGIALGLPREMVYRHPFPGPGLGVRILGEVTLKAAHLLQRADAIFIDELRATHATERDVAAGACTEADIGKSWYDLTSQAFAVFLPVKSVGVMGDGRTYENVVALRAVVTSDFMTAHWAHLPYELLGRVSNRIINEVRGLNRVVYDVSGKPPATIEWE

SEQ ID NO: 26084 - protein, 364 aa, Oceanobacillus iheyensis HTE831
MEEQTIRVQRSETKKEKPQSDQLIFGRSFTDHMFVMDYSDPLGWHNASIVPYQPLSIDPSSMIFHYGQSVFEGLKAFRTESGDIQLFRAEKNLERLNRSNDRLCIPQIDEEFTLKAIKQLISIEKDWVPSAEGTSLYIRPFIISTEAYIGVAPSMNYKLIVILSPVGAYYKEGINPVKIAVEDHYVRTVKGGTGEAKTGGNYASSLKAQEIVAKQGFAQVLWLDGVEKKYIEEVGSMNVFFKINGEVVTPQLNGSILSGVTRSSVIELLKHWGVPVSEKRISIQDLYQAYLDGELEEAFGSGTAAVISPIGQLTWEGKDMIVNNGETGELSKRIYDTITGIQYGHLDDPFQWIQGIEAKSPVKH

SEQ ID NO: 26085 - protein, 601 aa, Cenarchaeum symbiosum
MESRLKQALPPDPVPRAGWADNEEADNFAKTVKLFRQGWYDADSFRRFRLQNGAYGSRMTGDYAMVRIKVPAGEILPQQLEKIAYLSETYSIGSAHFSTRENVQLHWVVLEDVSEIMRGLAEVGMTSREACGNSVRNVMCSPLSGVCGAEAFDATPYALATASFFLRNPMCQNLPRKFKFNFTCCEEHGMVRMVDVGLVPQTRELKGAVQRGFKVFLGGGLGNRSFVGHQLEEFTPDEDLLYTSMAVLRIFDRLGDRKNLARNRMRYLVNEMGWEKFQNLVLKERAIVRSTQPVITRLEMDDAPPGIRTPMRITDEAPAAVPSGFARWSRTNTMAQKQDGYQTVFITLEAGDITAGQLRSLAAICREYSGEGRARTGFRQNVVIRYVKEEDLPAIYSRLTESGLAKSGALTMSTPVGCSGTTSCNLALTNSHRLAKEIQRKFLEMGLDEDADLADSSIKISGCPNSCGQHGIATIGFYGGGSRAGGNMYPVYQMSVGGRFDGQTVLGTNCMRIPAKRVIPAILRIIELFRDNKQPSDTLKSWIHRLVLGNGDGAVDTLDALKAELAPLTVAPAIEDDPDFYKDYGNEGGYHAKTGKGECAA

SEQ ID NO: 26086 - protein, 543 aa, Cenarchaeum symbiosum
MTNDYSMIRVKVPAGEILPQQLEKIAYLSETYSIGSAHFSTRENVQLHWVVLEDISEIMRGLAEVGMTSREACGNTVRNVMCAPLAGVCRDEAFDATPYAQATGTFFLRNPMCQNLPRKFKFNFTCCEDHGMVRMVDVGLVPQTREINGVMQRGFMIFLGGGQGNKAFLGHQLEGFTPDEDLLYTALAVLSVFDRLGDRKKMARNRLRYLVSEMGWEKFRNLVLKERALARSNQSVLTQLDTDGTPRGIRTPMRIADEAPAAVPSGFARWSHTNTIPQKQDGYRSVFITLEAGDITAAQLRSVAALCRDYSGECKARTGFHQNVVIRYVKEDDLPAMYSRLLEAGLAKTGALTMATTVGCSGTTSCNLALTNSHRLAKEVQRKLLELGIDEDPDFSNSSIKISGCPNSCGLHWMATLGFYGGGSRAGSSMYPVYQMLVGGRFDGHSSLGIPILRIPAKRVIPAILKVIELFREHKKPSDTLKSWLHRLVSGNGDGTIDTLDALKEELSPLTVAPSIEVDPDFYKDYGNEDNYHTKTGRGECAS

SEQ ID NO: 26087 - protein, 453 aa, Alteromonadales bacterium TW-7
MTQHFDYIAIGGGSGGIASANRAAMRGAKVALIEAKHMGGTCVNVGCVPKKVMWHGAQVAEAINLYAPDYGFNVEVKDFNWSKLVESREAYIGRIHKGYDNGLASNGVTVIKGFATFIDSKTVEVNGEHYTADHILVAVGGRPTIPNIPGAEHGIDSNGFFELNEQPKRVAVIGAGYIAVEIAGVLHSLGTETHLFVRKSKPLRTFDPYIIDTLVDIMAKEGPTLHTECSPKEVIKESDGSLTIHFENGYSQNVDQVIWAIGRTPTTDKINLAAAGVEVNESGYVKVDEYQNTTAKNVYAVGDIIEGGIELTPVAVKAGRTLSERLFNKALPDDLKMDYSLVPTVVFSHPPIGTIGLTEQEAISQYGAENVKVYKSSFAAMYTAVTQHRQACNMMLVCAGEDEKVVGLHGLGFAVDEMIQGFAVAMKMGATKADFDAVVALHPTGSEEFVTMR

SEQ ID NO: 26088 - protein, 309 aa, Arabidopsis thaliana
MAQEADGIRLEQRHGKARVRVGRVWRHAHDGSHHFVEWNVSISLLSHCLSSYRLDDNSDIVATDTIKNTVYVKAKECGDRLSVEEFAILIGKHFCSFYPQVFTAIVNIIEKPWERVSIDGKPHLHGFKLGSENHTTEARVEKSGALNLTSGIGGLALLKTTQSGFERFVRDKYTILPETRERMLATEVNASWRYSYESVASIPTKGLYFSEKFMDVKKVLMDTFFGPPETGVYSPSVQRTLYLMGSAVLKRFADVSSIHLKMPNIHFLPVNLSTKENPSMVKFKDDVYLPTDEPHGSIEATLSRITSKL

SEQ ID NO: 26089 - protein, 308 aa, Phaseolus vulgaris
MAQEVVEGFKFEQRHGKERVRVARVWRTPQGRHFVVEWRVGITLFSDCVNSYLRDDNSDIVATDTMKNTVYAKAKECSDILSVEDFAILLAKHFVSFYKKVTGAIVNIVEKPWERVIVDGQPHQHGFTLGSEKHTTEAIVQKSGSLQLTSGIEGLSVLKTTQSGFENFIRNKYTALPDTRERILATEVTALWRYSYESLYNLPQKPLYFTDKYLEVKKVLADTFFGPPNRGVYSPSVQNTLYLMAKATLNRFPDIAYVHLKMPNLHFLPVNISSKDGPIVKFEDDVYLPTDEPHGSIEASLSRVWSKL

SEQ ID NO: 26090 - protein, 898 aa, Oryza sativa (japonica cultivar-group)
MAPPENPNGAGPAAPSDPAQPQPQPPAKSKWKKKDEKKDDDLSEEDLALKEQLELYVVRAQDADPGVQKLALESMRQEIRSATSSMTSVPKPLKFLRPHYGTLKSYFETMPESSDLKRYMADILSVLALTMSAEGERESLKYRLLGSEGDIGSWGHEYVRNLAGEIAQEFQKRQDDDMPIDALMELVQQIVSFHMKHNAEPEAVDLLMEVEDLDLLVEHVDSTNYKRTCLYLTSSSKYLPAPDDMLALDIAYTIYMKFEDLTSALRIALLLDNKSMQYVKQVYTATEDLQLKKQFSFIIARHGLAMEIDDEIAADGNDKEGLQEIVNNSKLSEGYLTLARDIEVMEAKSPEDIYKVHLIDGRGASSSLDSARQNLAATFVNAFVNAGFGQDKLMTAPSDSSSSGASGNWLFKNKEHGKASAAASLGMILLWDTDSGLAQLDKYLHSNDAHVVAGALLGIGIVTCGVKNDCDPALAILMEYINKDDTNIRIGAILGLGIAYAGSQKEELKSYLSTVLGDSEKSTLEVLIFSAIALGLVFVGSCNEEIAQSIIFALMERSEAELAEPIIRLLPVALGLLYLGKQESVEATAEVSKTFDEKIRKYCDVTLMSLAYAGTGNVLKVQKLLGICSQHLEKGETHQGPAVLGIALIAMAEELGAEMAVRSLERLLQYGEQNIRRAVPLALGILCISNPKVNVMDTLSRLSHDADADVSMAAIISLGFIGAGTNNARIAGMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAGERAELATEKYIPLTSVLEGFVILKKNPEYNEE

SEQ ID NO: 26091 - protein, 718 aa, Oryza sativa (indica cultivar-group)
MGRNGSVKRTSSSGAAAAFTANPRDYQLMEEVGYGAHAVVYRALFVPRNDVVAVKCLDLDQLNNNIDEIQREAQIMSLIEHPNVIRAYCSFVVEHSLWVVMPFMTEGSCLHLMKIAYPDGFEEPVIGSILKETLKALEYLHRQGQIHRDVKAGNILVDNAGIVKLGDFGVSACMFDRGDRQRSRNTFVGTPCWMAPEVLQPGTGYNFKADIWSFGITALELAHGHAPFSKYPPMKVLLMTLQNAPPGLDYDRDRRFSKSFKEMVAMCLVKDQTKRPTAEKLLKHSFFKNAKPPELTMKGILTDLPPLWDRVKALQLKDAAQLALKKMPSSEQEALSMIRDDEPPEIKEDDDTARTIEVEKDSFSRNHLGKSSSTIENFFSGRTSTTAANSDGKGDFSFEAFDFGENNVDTKIMPNGYENARSENSSSPSTSKQDPESKYWRSTSGQKQQTSGTPAVHSGGVNSSTTEKGHGVERDATVQLASDKLRTETRRATNLSGPLSLPTRASANSLSAPIRSSGGYVDSLGDKSKRNVVEIKGRFSVTSENVDLAKVQEVPLSSLSRKSPQASPLKKSASVGDWLVNTKPMSNSHHVKELCNSSVSSSILIPHLENLVKQTMFQQDLIMNVLSSLQQNEKVDGVLSGISPQLRNTDSDTMVGSVNSEKERSLLVKISELQSRMITLTDELIAAKLKHVQLQQELNALYCREEIEDIRDDDNEET

SEQ ID NO: 26092 - protein, 418 aa, uncultured marine gamma proteobacterium EBAC20E09
MKKNAFYAQSGGVTSVINATAAALILESKKHKSKIGKVYAGKNGILGALNEELIDTSKESISAIESLRSRPGGVFGSCRVKLKSLEENKKEYERLVEVFKAHNIGYFFYNGGNDSADTAFKVSQISKKLGYPINCIAIPKTVDNDLAVTDCCPGFGSAAKYIATSTLEASLDVASMSETSTKVFILEVMGRHAGWMAASSALARKDKNDPPHIILMPEVMFNQRRFLSKIKDIVKRNGYCVIVASEGVKNSKGKFLAESDTKDAFGHAQLGGVAPYLSKLITEKLKFKNHWAVSDYLQRSARHIASKTDLLHAEAVGIHAVKYAVKGLNGVMPVIVRGKGKKYSWKIEPAPLSKIANVEKKLPKSFISKDGFNVNSKAIAYLKPLIAGEAFPEFKDGIPRISNLKLLLTPKKLKKYIP

SEQ ID NO: 26093 - protein, 472 aa, Oryza sativa (indica cultivar-group)
MEVFYYLVFGGLAAVVAGLELGKSGKDRVATTPAFNAFKNNYILVYSLMMSGDWLQGPYVYYLYSQYGFDKGDIGRLFIAGFGSSMLFGTIVGSLADKQGRKRACITYCISYILSCITKHSPEYKILMIGRVLGGIATSLLFSAFESWLVAEHNKRGFDPQWLSITFSKAIFLGNGLVAIIAGLFANLLADNLGFGPVAPFDAAACFLAIGMAIILSSWSENYGDTSDNKDLIAQFKVAAKAIASDEKIALLGAIQSLFEGSMYTFVFLWTPALSPNDEEIPHGFIFATFMLSSMLGSSIASRLLARKLKVEGYMQIVFSISAFTLFLPVVTNFLVPPSSVKGGGISFGGCLQLLGFCIFESCVGIFWPSIMKMRSQYIPEEARSTIMNFFRIPLNLFVCVVLYNVNAFPITVMFGMCAIFLFMAAILQRRLMVVSDLHRSTNADSVLKVLIMGKFPSEAVEMTGEDEPLNP

SEQ ID NO: 26094 - protein, 462 aa, Zea mays
MQEASWKETIHQLYGTRVAVLAGDFMFAQSSWFLANLENIEVIKLISQVIKDFASGEIKQASTLFDCDVTLDDYLLKSYYKTASLIAASTRSAAIFSGVGSGVCEQMYEYGRNLGLAFQVVDDILDLTQSAEQLGKPAAGSDLAKGNLTAPVILALREEPRLRGIIESEFCEPGSLAAAVELVHRGGGIRSARELAEEKGGLALRSLQCLPRSEFRSALERVVHYNLQRLIDLTVVLQTSAEVDFFTEYGDANRYKIQEVIGKGSYGVVCSAIDLHTRQRVAIKKIHGIFEHVSDAARILREIKLLRLLRHPDIVEIKHIMLPPSRKDFKDIFVVFELMESDLHQVIKANDDLTKEHYQFFLYQLLRALKYIHTANVYHRDLKPKNILANSNCKLKICDFGLARVAFNDTPTTVFWTDYVATRWYRAPELCGSFFTKYTPAIDIWSIGCIFAEVLTGKPFIS

SEQ ID NO: 26095 - protein, 332 aa, Burkholderia thailandensis E264
MSQINRQVLLVSRPEREASVDNFKLVETPLAPLADGEVRVRNHFLSIDPYMRGRMNAGRSYAEPQPLGEVMGGGTAGEVVESRNPAFAVGDRVIGAYGWQEYGTSTGKELRKVDTTHVPLSAYLGPVGMPGVTAWYGLNRIIRPRAGETIVVSAASGAVGSVAGQLAKLAGCRAVGVAGGADKCRYVVDTLGFDACVDYKAGRLAEDLAAAAPDGVDGYFENVGGAVLDATLARMNPFGRVAMCGMIATYDGAPAPLANPALILRERLLVQGFIVSEHFDVWPEALAQLASLVARQQLHYRETIAQGIERAPDALLGLLKGRNFGKQLVALV

SEQ ID NO: 26096 - protein, 444 aa, Prevotella ruminicola
MKATEVIEKLKAKFPGQPEYIQAVSQVLGTIEEEYNKHPEFEKANLIERLCVPDRILQFRVSWVDDNGNVQTNLGYRVQHNNAIGPYKGGLRFHKSVNASILKFLAFEQTFKNSLTTLPMGGAKGGSDFDPHGKSDMEVMRFCQAFMNELYRLIGPDEDVPAGDIGVGGREVGYMFGQYKKLTHQFQGILTGKGLEFGGSLIRPEATGYGNVYFLEDMLKTRGESLEGKTVLVSGSGNVAQYTIEKLLQLGAKPVTCSDSNGYIYDPDGIDAEKLAFIMELKNVKRGRIKEYAEKYGVKYVENARPWGEKADIATPCATQDEINEAEAKTLIANGVFAVSEGANMPTEPAAIKVFQDAKILYCPGKASNAGGVATSGLEMSQNSERLSWTREEVDTKLHNIMDEIHANCVKYGTEPDGYINYVKGANVAGFMKVAKAMMAQGIY

SEQ ID NO: 26097 - protein, 155 aa, Ralstonia eutropha JMP134
MNKVRKTARQLLADKPRDVISVAPDDFVLAALQLMADKDISTVLVMHGDTLAGILSQRDYARGVELAGRSASATKVRDIMTTKVVCVSPDHTCDQCLALMHARRIRHLPVLESGRIAGVLSSHDILEELLSEDEHLIRDLEHDMLNLTVDTGGCY

SEQ ID NO: 26098 - protein, 234 aa, Oryza sativa
SSSLISFLSSLFLAAVSSVFFIFCLLLSCFFVCSCCSFFLFALVVFCFVFVFLFLLSYVVRGDEEREGATGRRGAVLRSVFVRDGRCCVTPSVCYALYWCLALLYPCLLISKSNARLPPEVNRVLYVRNLPFNISSEEMYDIFGKYGAIRQIRLGNAKDTRGTAFVVYEDIYDAKNAVDHLSGFNVANRYLIVLYYQPAKMSKKSDVKKKEEEITRLQEKYGLGSKTPSSAPDA

SEQ ID NO: 26099 - protein, 225 aa, Glycine max
QLRRPPPRLVPEALNVMMEMKSHNVFPTSISYNILLSCLGKTRRVKESCQILETMKISGCDPDWVSYYLVAKVLFLSGRFGKGKEMVDQMIGKGLVPNHKFYYSLIGILCGVERVNYALELFEKMKKSSMGGYGPVYDVLIPKLCRGGDFEKGRELWDEASGMGITLQCSEDVLDPSITEVYKPTRPEKSSHVDSSRAKSPQKLTKFSGKMKMRKKTAAMKKKKK

SEQ ID NO: 26100 - protein, 299 aa, Arabidopsis thaliana
MCDPIREDGSNKRGAVSKEKRPYIHREWSWADIIRALTVINVHFLCLLAPFNYKWEALRFGFVLYALTSLSITFSYHRNLAHRSFKLPKWLEYPLAYFAVFALQGDPLDWVSIHRFHHQFTDSDRDPHSPIEGFWFSHVWWICDTRYIKYKCGGRNNVMDLKQQWFYWFLRMTIGFHVLMFWTVLYLYGGLPYLTCGGGVGGVIGYHVTWLVNSACHIWGSRSWKTKDTSRNVWWLSLFTMGESWHNNHHAFESSARQGLEWWQIDITWYLIRLFEVLGLATDVKLPSEIQKQKLALTR

SEQ ID NO: 26101 - protein, 311 aa, Chromobacterium violaceum ATCC 12472
MLLTEAAALSTLAERLNGEFLDAVEAILACQGRVIVTGMGKSGHVGRKIAATLASTGTPAFFVHPAEAAHGDLGMITGDDVVIALSNSGESAEVVSLLPALKLKGSKLIAVTGRSESTLAQAADVLLHTHVEREACPLNLAPTTSTTAQIALGDALAVTLMEARGFGQSDFALSHPGGSLGRRLLVHVKDLMHGGDALPRVAPGTPLKDALLEMSQKRLGMVTVGDADGTLHGIYTDGDLRRTLEKGVDVYRLKVDEVMGRKPRTIQPDKLAAEAGFLMKQHQITSLVVVDAQGKLAGVLHMHDLLHAGVF

SEQ ID NO: 26102 - protein, 272 aa, Nostoc punctiforme PCC 73102
MKKLIKGLREFKSSYFSANEELFEQLSHGQKPRVLFITCSDSRIDPNLITQAGLGELFVIRNAGNIIPPFGATNGGEGATIEYAIQALDIQQIIVCGHSHCGAMKGLMKLDSLRVEMPLVHDWLKYAEATRRLVKDNYSHYEGEELLEIIIAENVLTQIENLRTYPVIRSKLHQGQLSIYAWIYQIETGEILAYDPQKHAYVLPQNQLLSSEIDETLLSPPLNSNVEIHFTKTQQRPFQSSGELPIPTHEWFPMTVLSPEQMERIYRGSATK

SEQ ID NO: 26103 - protein, 104 aa, Ostreococcus tauri
MTRAKYGDESVYFDLSDVEATTGSWDVYGVDSASRYPEQQAAFFEAAAQGLGRREAVYSVLAVSAGREASDHRGPATAGSSRPARPHLSAFFERKPRKLAVEEV

SEQ ID NO: 26104 - protein, 708 aa, Myxococcus xanthus DK 1622
MSREVWPGKPWPRGATFDGSGVNFAIYSQVATRVEVCLFDPADPAREIERFGLPESTDFVHHGYVPGLEPGTLYGLRVHGPYEPTKGHRCNPHKLLVDPYAKALYGDVDWRQPVFGYPLGHEQQDLARDERDSAAGVPKSVVVSDYFDWGNDRRPDINWRETVLYEAHVRGLTMRHPGVPEHLRGTYAGLACPPVIEHLLKLGVTSVELLPVHAFADDSFLDDKKLSNFWGYNTLGYFAPEQYYASRKTPGAAVAEFKAMVRDLHAAGIEVILDVVYNHTCEGNHLGPTLSLKGIDNASYYWLMPDGRHYLDFTGCGNSINASNPQAARLIIDSLRYWVTEMHVDGFRFDLATVLGRTGEGAFDRDAALFQILHQDPVLGRVKLIAEPWDVGLGGYQVGGFPPPWREWNGKYRDALRRYWKGDENLASEMGYRITGNADLYAEARRRPQASINFVTAHDGFTLHDLVTYSHKHNEANGEHNRDGADDNQSWNCGVEGETDKADVIALRERQKRNLLASLFLSTGIPMIVAGDEMGRTQGGNNNAYCQDNELSWVDWNLDERRRKLLAFTRKLIHFRHRQPVLQRRRFFKGQHLWDSEHKDLTWFRPDGPEMKAEDWEKPFVRSLAFLLGGDAIPTPDERGQRIIGDALLILLNSHHEPVTYKLPPAAQSQRWELELCTTDDNRGPEPVKGETFELIGRSLAVFRQVAD

SEQ ID NO: 26105 - protein, 534 aa, Nostoc punctiforme PCC 73102
MNLVNKTEKTFALTTPLYYVNDVPHIGSAYTTIAADVVARFHRLLGHQVLLITGTDEHGQKIQRSAESLGKAPQEFCDEVVPSFISLWQLLDIKYDRFSRTTAPRHEAIVKEFFERVWESGDIYQGQQQGWYCVSCEEFKEERDLLEGHRCPIHTNKEVEWRDEQNYFFRLSKYQNKLTEFYQSKPNFIQPESRRNEVLSFVNQGLQDFSISRVNLDWGFPVPVDPKHTLYVWFDALLGYVTALLEPDAEPTLANALETWWPINLHLIGKDILRFHAVYWPAMLLSAGLPLPERVFGHGFLTKDGQKMGKSLGNTLDPVSLVQRYGSDAVRYYFLKEIEFGKDGDFNEVRFINVLNADLANDLGNLLNRTLSMVKKYCVDNNVPSIGNEGISDENPLKTIGLRLGEQVKEAYKELAFSQACGAILSLAQASNKFIDEQAPWSLYKQGQQESVEKVLYAVLESVRLAAYLLSPIIPNISSDIYQQLGFGIDFNDQIQSSVTAPFATHATWGILSSKQQLGTFQPVFKRIEPPKND

SEQ ID NO: 26106 - protein, 454 aa, Vibrio cholerae O1 biovar eltor str. N16961
MEKVMATHFDYLCIGGGSGGIASANRAAMYGAKVALIEAKDLGGTCVNVGCVPKKVMWHGAQIAEAMHLYAEDYGFDVDVKNFNWAKLVESRQAYIGRIHQSYDRVLGNNKVHVIKGFAKFVDAKTVEVNGELYTADHILIAVGGRPSIPNIPGAEYGIDSNGFFELSEQPKRVAVIGAGYIAVEIAGVLNALGTETHLFCRKESPLRSFDPMIIETLVEVMNSEGPQLHTHSVPKQVVKEADGSLTLHLENGQTYNVDTLIWAIGRHPATDAINLAATGVATNEQGYIKVDEFQNTNVAGIYCVGDIMEGGIELTPVAVKAGRQLSERLFNNKLNAKMDYQLVPTVVFSHPPIGTIGLTEPQAIAQYGAENVKVYKSSFTAMYTAVTSHRQPCKMKLVCAGPEETVVGLHGIGFAVDEMIQGFGVAMKMGATKADFDSVVAIHPTGSEEFVTM

SEQ ID NO: 26107 - protein, 325 aa, Listeria monocytogenes str. 4b F2365
MNLNKHSERKFDLITVGRACIDLNAVEYNRPMEETMTFSKYVGGSPANIAIGTAKLGLKVGFIGKISADQHGRFIEKYMRDLSINTDGMVKDTEGRKVGLAFTEIKSPDECSILMYRENVADLYLTPEEISEDYIKEARVLLISGTALAQSPSREAVLKAVSLARKNDVAVAFELDYRPYTWTNTEETAVYYSLVAEQADVIIGTRDEFDMMENQVGGKNEATKAHLFQHQAEIVVIKHGVEGSFAYTKAGETFQAKAYKTKVLKTFGAGDSYASAFLYGLFSGESIETALKYGSAAASIVVSKHSSSDAMPTADEIKALIAQAE

SEQ ID NO: 26108 - protein, 518 aa, Oryza sativa
  misc_feature (11)..(11): Xaa can be any naturally occurring amino acid
  unsure (1)..(518): unsure at all Xaa locations
MGVTKAEAVAXATGKVVDDIEALADLRKEPAWKKFLSHIGPGFMVCLAYLDPGNMETDLQAGANHKYELLWVILIGLIFALIIQSLSANLGVVTGRHLAELCKTEYPVWVKTCLWLLAELAVIASDIPEVIGTGFAFNLLFHIPVWTGVLIAGSSTLLLLGLQRYGVRKLEVVVALLVFVMAGCFFVEMSIVKPPVNEVLQGLFIPRLSGPGATGDSIALLGALVMPHNLFLHSALVLSRNTPASAKGMKDACRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKMGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEHSKEPPV

SEQ ID NO: 26109 - protein, 435 aa, Candida albicans SC5314
MSGQQLLEEARKAVTNKQYDEAEIKYKQIINPSESSTSTTTTTTTTTTTAKQLQQQESAILELGKIYETLNEPTKLSDLIADSRSILGNFAKSKTAKIVKTLIEDFDKLSAKDEKSLDIQIDVTKSSMQWAIESKLSFLRQSLQLKLSDLLYQKKHHHEAIKIINELLREYKKLDDKSSLVEVQLLESKIYHALRNIPKAKAALTSARTSANSIYCPTILQAELDCQSGILNSEDKDYKTAFSYFYESFEGFNSQDDPRSIIVLKYMLLTKIMLNLIDDVNNILNNKNVIKYKSKDIDAMKSIAMAYSNRSLKEFENSLLTYANELKSDAIIKNHFNALYDNLLEQNLLKIIESYSCVELSHISKVIGLNLQQVEGKLSQMILDKVFYGVLDQGNGWLIIYDEPRKDAAYEASLELVKNLSNVVDLLYEKASSLN

SEQ ID NO: 26110 - protein, 112 aa, Gloeobacter violaceus PCC 7421
MSQSTHEKIDSLVKNNKVLIFMKGTPQFPQCGFSAASVQILSSLGHPFEAVNVLDDFEIRQGIKDYANWPTIPQVYVDGEFVGGCDILIEMHNRGELKPLLDQAFEGEGAKA

SEQ ID NO: 26111 - protein, 512 aa, Triticum aestivum
MSLISTALVLLVPLGLYLYLRPCSRRRSNDPAAAVLPTKWPILGMLPGLVANMYNFHEYSYAVLAGSGLNFNGDGPPGAGMRFFITCDPANIQHIFTTNYPNFPKGAEFAAIFDIMAGGLFTIDGELWRRRRVKFVGVISSPRFADRVAAHCHDKVKDHLLPLLARMASTGTSFDMQELMVRLMFDMTAMAVFGVDPGFLSLDMPPIDASIAMDTVMEVGFLRHTMPASLWKAMRWLNIGPERKLHEAKKVLHRFVVDTMERRKTTRENVGHDEDEEVVGDILSSYINDPDFADDDLLRATLINFMIAGRDTIGTTLPWIFYNLAQNPNVVSIIRNELSPIASHKVARGMGATVIFEPEETKSLVYLRATLYETLRLYPPAHMERKTVVTDDTMPSGHEVYAGDAIYISLYSMGRMESLWGKDCLDFNPNRWLLEDGNKIKYVPSNKFLAFNSGPRMCPGKEIAVVQMKTIIAAVVWNFDLELVESQSIQPKLSCLLQMKNGLMMKLKKREA

SEQ ID NO: 26112 - protein, 336 aa, Mycobacterium tuberculosis H37Rv
MKLAIIAGDGIGPEVTAEAVKVLDAVVPGVQKTSYDLGARRFHATGEVLPDSVVAELRNHDAILLGAIGDPSVPSGVLERGLLLRLRFELDHHINLRPARLYPGVASPLSGNPGIDFVVVREGTEGPYTGNGGAIRVGTPNEVATEVSVNTAFGVRRVVADAFERARRRRKHLTLVHKTNVLTFAGGLWLRTVDEVGECYPDVEVAYQHVDAATIHMITDPGRFDVIVTDNLFGDIITDLAAAVCGGIGLAASGNIDATRANPSMFEPVHGSAPDIAGQGIADPTAAIMSVALLLSHLGEHDAAARVDRAVEAHLATRGSERLATSDVGERIAAAL

SEQ ID NO: 26113 - protein, 543 aa, Oryza sativa (indica cultivar-group)
MPPSPSAPPPLRLRLALASTAPHNNGVYTVGDFMTKRPNLHVVTPATSVDEALETLVQHKISGFPVVDDTGKLVGVVSDYDLLALDSISGSGLTGTNTSMFPEVDSTWKLCTIFLDWVIFTTYCQVLGWNDSLRSLYETFREIQRLLSKTNGKVIADVMTYSPLAVRESTNLDAATRLLLETKYRRLPVVDSTDYTTNKVVKGFQQQASWLQSAPISFQGFRPQESWMHSPNQVVGSASSHGSESASQCPARQEENNLVNIEESSDNSQETGRRGTRVNWTEEENLRLLSSWLNNSLDSINGNDKKGEYYWRDVAAEFNGNASSNNRKRTVVQCKTHWGGVKKDIAKFCGAYSRARRTWSSGFSDDMIMEKAHALYKSENNDKTFTLEYMWRELKDQPKWRRILEEDSKNKRTKISESGAYTSSSNQETEEETSRKEKRPEGQKKAKAKLKGKGKKPAPSPLGDQPSQDFVLFNEAVKLRAEAVLKSAEATTKSAEAKKEQTRMEKYQTYLKLLDKDTANFSDAKLKRHEAVLEKLATELAEE

SEQ ID NO: 26114 - protein, 488 aa, Chromobacterium violaceum ATCC 12472
MDGGPILSLEALRRLEKAAAGDGLDLMRRAALAAADWVTRHCPPASSLLVCAGPGNNGGDALYAALELQKRGHPLTVLQPVAPASDACRAARLQAESAGIAILAELPDNAPTPALLIDGLFGIGLSRPLDASWQDLIARLNRLDCARLALDCPSGLDAYTGHALGAAIRADHTLTFLCHKPGLFGGPGADFAGRVELAALDCPAALYPEAEGELNRPSAAALARSRDSHKGSYGSVSVIGGAPGMLGAALLAGRSALAGGAGKVYLCALDDRLPVDPAAPELMMRPADESADIPAADVLAIGPGLGQQELAERLLELAISRACPLVLDADALNLLAVRRDLAARIAARGAPTVLTPHPAEAARLLKLDTREIQADRVGHARRLAALFNCVVVLKGAGSLIARPDGYYRVNDSGGPELASAGQGDVLTGLVAALLAQGLDAFDAASLAARLHGLAGDGYRAESGGPIGLTASATVPRLSRALNHLHAEG

SEQ ID NO: 26115 - protein, 319 aa, Pseudomonas putida GB-1
MSSKCTGQSTPMTSKLEQLKQFTTVVADTGDLDAITRLKPVDATTNPSLLLKAAAIPGYADLLKQVKADAKGDVDLACDKFAVAVGSGILKVIPGRISTEVDARLSFDEPALLNKARQLIALYEAAGVPKDRVLIKLASTWEGIRAAEKLEKEGIQTNLTLLFSFAQAQACADAGVFLISPFVGRIYDWYKKSTGKDYVGAEDPGVQSVTRIYNYYKANGYNTVVMGASFRNIGQIEQLAGCDRLTISPELLQQLSDDQGELPQVLKPGNAGEAKQPLNESQFRWAMNEDAMGTEKLAEGIRQFARDQEKLEKLMAEKA

SEQ ID NO: 26116 - protein, 145 aa, Oryza sativa
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVQMPPVLANVCGQSVGRLNLVPDPEA

SEQ ID NO: 26117 - protein, 623 aa, Oryza sativa
MDADSPRRPTTVPSNTPQVSGLIPWYQGLIPRYHPVSWVPSIRYRSIPNWYQSAAPPRRRRRRMEAVGVAPAPAGVPEKKLLEVKESRKAAPAAPSTSMAAKWAMKKKLVGGDAGYVLEDVPHLTDYLPELPTYPNPLQDNPAYSVVKIPLFHSPTTLGTKRLTFLHTTCAPSSSCRQYFVNTDDTVTQKIVVHKTSARGTHFRRAGPRQRVYFQSDEVNAAIVTCGGLCPGLNTVIRELVCGLYDMYGVTSVVGIEGGYKGFYSRNTVALTPKSVNDIHKRGGTVLGTSRGGHDTGKIVDSIKDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKRNFPITLKYIDPTYMIRAVRSNASDNVYCTLLAHSALHGAMAGYTGFTVAPVNGRHAYIPFYRITEKQNKVVITDRMWARVLCSTNQPCFLSHEDVEHLKHDDDEHHLHNTQLLEGESSPVKDSSKCNGTAAPV

SEQ ID NO: 26118 - protein, 280 aa, Vigna mungo
TVQDRTSEAYKVFTEIAMCMRDSDGIIVNTSEAIEGRAIKAFDEGLMEGTTPPVFCIGPVISSAPCRGDDDGCLSWLDSQPSQSVVFLSFGSMGRFTRTQLREIAIGLEKSGQRFLCVVRSEFEDGDSGEPTSLEELLPEGFLERTKGTGMVVRDWAPQAAILSHDSVGGFVTHCGWNSVLESVCEGVPMVAWPLYAEQKLNKVILVEEMKVGMAVNGDKDGLVSSTELGDRVKEMMDSDRGKEIRQNIFKMKISATEAVGEGGSSIVALNRLVELWKEH

SEQ ID NO: 26119 - protein, 370 aa, Arabidopsis thaliana
MMMSDLPHDLVEEILSRLPLISLKAMRSTCKTWNVLSKHRSFANKHIGNVTASGKRDLIMIKDCKVYSIGVNLHGIQNNNNIIDLSIKNKGILHLENLDLIFKEIFNVFHCNGLLLLYGSITDDSIRLVVCNPYWGKREWVKRINNFASFDKLAFGYDKSCGCHKILRVFDSYPNRLEIYNLRSNSRMVSSFPLKWDIAFMQDGVSLKGNTYWYAKDRRSEDCYLICFDFTRERFGPRLPLPQPFIDEFLGSLYVVREEKLAVLVKRWRGGKSEIDIWVTNKIEPDEVSWSKFLKVDNTPRFFLTEGYLIYDEEKVVVFFNKEETEGLKSTVHIAYIVGENGYFRRADLREPLYQPLCRLVCSYVPSSVK

SEQ ID NO: 26120 - protein, 358 aa, Agrobacterium tumefaciens
LPRKASVFIVELKFEQESCPLGVVIPLEESKNKLASVKPLVDLTRADMEQVNQLILSRAGSDVQMIPEVANHLISSGGKRLRPMLTLASASMFGYEGDHHIKLATSVEFMHTATLLHDDVVDESDLRRGKSTARTIWGNQASVLVGDFLLGQAFRMMVDVGSLDALDVLSTAASVIAEGEVLQLSVAKNMETTEDDYLQVIRAKTAALFAAAAEVGPIVAKTDKASRSALKSYGMNLGLAFQLVDDVLDYGGKSADLGKNTGDDFREGKITLPVILSYRRGTQDERAFWRNAIENGESSDENLEKALGLITKYNGLGDTIGRATHYGTIARDALAPLPESPWKNALLEVIDFCIERLN

SEQ ID NO: 26121 - protein, 381 aa, Vigna mungo
FARAQISKTAIVKAFVIDLFCASTMESASSMGIPVYFFFTSGAAILALYSYFPKLHQECIVSFKNMVGVELRVPGNATLKARGTAGTHLGQARPCVLGHAGLLHAPPEARGVIVNSFEELEPAAVNAVTQGACFPDATHVPRVYYIGPLIAESQQSDAEGRESKECLRWLEEQPSRSVVYLCFGSRGSFSVSQLKEIAKGLEKSGKRFLWVVKRPLEEEGAKHEEAAKPGDEFDLASMLPDGFLERTKDRGMVVKAWAPQVEVLSRESVGGFVSHCGWNSVLEGVVAGVPMVAWPLYAEQHVNREVMVGEMKVAVGVNERVEDGFVSAEEVEKRVREVMETKEIRGRSFKLKQMAMAAVAEFGSSTTAIAHLLHSWTSFTS

SEQ ID NO: 26122 - protein, 535 aa, Cryptococcus neoformans var. neoformans JEC21
MTLAQKPVWDRNQIASRITQGQQLVVYHDRVLNVTPWAPYHPGGALALLHFVGRDATNEIEAYHSDAAIEMMNKFTVARVDIGKKGWPPLTPPIALGLVRHPDGVKGHWAREGPVTLGQTILQQSISLDPSSAPIPPVPNPNPPSSNPAVITLEPAQLEPPASAVDMEKEEQRSEDYRQLKKRLVEAGLFKPPGPLAGYGTDIIRYSLLAFGALYLYFNTTGWLGQMGSATCLGLLFHQLAFVVHDAGHTEVTGVWWWDRVIGMTVASWIGGLSCGWWCDNHDIHHLVTNHPEHDPDIQHIPFFAISKEFFNSLWSTYYKRTMLLDAFAKIMIPFQHNLYYIVLSLARFNLYANSYMYLLGPKPRRNAFWAYEIAGIVFYWVYYGSMLRHLPSWQMRLGYLLISHIMASPVHVQIVLSHFACSTEDLGPAESFPSRQLRTTMDVICDQNVEWIHGGLNLQVTHHLFPRLPRHNLRAASMLVKEYCKEHDIVYREHLFIEGNRHVLSTLRDVANQLNLLKKVADKEIDERMGRRRD

SEQ ID NO: 26123 - protein, 381 aa, Arabidopsis thaliana
MSDDEEPPLKKNKLPVEEPTLIPSLPDPRVRSILARVSRLSYRSLSLVCKRFHSLLTSGEIYRFRSLSGYTENCLYVCLRFSHTGRSHRWFMLREKNKSSGYVLAPIPISHSPSLHASSIVAVGSKIYKIGGVMDGSSVSILDCWSHRWLEAPSMQMERDRPSANLIDGKIYVTGGCHRGSYNPSKWMEVFDLKTETWEPVLCRSDRLTFESYHERTNNLLVDGKLYIFWADKGVVYNPKDDTWDSLEVPEMDMCLTLFYCCVIENVLYDFFYEELDIKWYDTKARTWRSLLNGMRELHKFVRHASVTLADYGGKMVMFWDKFVASGDGLGFHKTMMWCAMIALERSDSGEIWGKVEWFGPVLPNQIPLEYAFEYVGSVKV

SEQ ID NO: 26124 - protein, 235 aa, Oryza sativa (indica cultivar-group)
MEAIKEEMNAMDPKSAKEGKAKMTALFQKHGVSPFTPLKGLLIQGPIFMSFFFAIRNMIDKVPSMKGGGSLWFTDLTTPDPLYILPVLTALIFLVTVELNLQEGMEGNPMARKMKNFSRGMAVLTVPFTMSFAKGIFCYWITSNLFTLTYGFVIRRPAVRKFCNLPALEAQSASAKKQMFNLFGGSKALTTAESPVAITGGPQSSLEQPDAAALGYRVKNPEKKAKSRGKSRRRR

SEQ ID NO: 26125 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHYKEALTTKDLKKLIWNEIFS

SEQ ID NO: 26126 - protein, 102 aa, Magnaporthe grisea 70-15
MSEAAKQKAQKLIDENAVMVFSKSYCPYCTATKSKLKDIGAKYNVLELDQIDDGSAIQDALQEITGQRSVPNIFIGQKHIGGNSDFQALGNSESLIKAAGAL

SEQ ID NO: 26127 - protein, 473 aa, Ostreococcus tauri
  misc_feature (1)..(1): Xaa can be any naturally occurring amino acid
  unsure (1)..(473): unsure at all Xaa locations
XNATRRRKSIFVHGPGRRRGRPRGRKGGGRRGRDVHAGGGARARRGDDCWMIVRGEVYDVTAWVEKHPGGRTVLEQYAGRDATDAFTAYHGGERKVLARLRTMRVGTVAEGETPTPTHLKGFREMREMMEGDHKMLRSSFSDYAFVLVRLVIFFGGALACVLAPGAGFKTHMLGAVSLGLFWQQSMFIGHDAGHSSITFNRSSDAMIGWTVGNLFNGVGIAWWMATHNVHHCACNSLECDPDIQHMPVLAVSEKYFKSVYSLYHRRRMTYDRVARLLVRYQHLTFYPIMAVARINLYLQTLIFLFKAKRVRNRGMEFLTLGIGQSGTILLSLARRRGDHPRPDLLSHFSRDVFEGRPENDEWVKMQLSGTMDIECPRWLDWFHGGLQFQTQASRVPRDRRQTLRGKEWITVTFRRVLGRQSRGVSNAQARREAIQMGAALLGGDAPLSLVPEPPQASSLRRNFPFHARDIRQL

SEQ ID NO: 26128 - protein, 1137 aa, Solanum lycopersicum
MESQSSENRRGGGGRTSLNQNKQNNNKDSGLNTSSAASNMKNNASKAALAQYNADAKLMAEFEQSSVSGKSFDYSKSVLFPPHEANEEEITSYLSRIQRGGLVQPFGCMVAIEEPTFKIIGYSENCYDMLGFKPTKMKLGLIGVDARNLFTPSSGDSLAKVMASREISLLNPIWVHSRTTHKPFYAILHRIDVGIVIDLEPANSSDPALLLAGAVQSQKLAVRSISRLQSLPGGDIGVLCDTAVEDVQKLTGYDRVMVYKFHDDNHGEIVSEIRRSDLEPYLGLHYPATDIPQAARFLFKQNRVRMICDCNAQPVKVVQSEELKQPICLVNSTLRSPHECHSKYMANMGSISSLVMAILINSGDSMKLWGLIVCHHTSPRYVPFPLRYACEFFTQAFGLQLNMELQLASQLAEKKTLQMQTLLCDMLLRDVPFGVVTQSPSIMDLVKCDGAALYCGGKCWLLGVTPTEAQVKDIAQWLLVAHKDSTGLSTDCLADAGYPGAALLGDAVCGMATARITSKDFLFWFRSHTAKEVKWGGAKHHPDDKDDGGKMHPRSSFNAFLEVVKSRSLPWEIPEINAIHSLQIIMRESIQENENSSLKTLTTSQQNDADGPSMDELSSVAMEMVRLIETATAPIFGVDPSGLINGWNEKIADLTGLHASEAVGMSLINDITHEDSRGTVEKVLHRALLGEEEKNVEIKLRRFGKDPPGSVIYLVINACTSRDHKNGVVGVSFVAQDVTPEKFIMDKFIQLRGDYEAIVQSLSPLIPPIFASDENACCSEWNAAMERLTGWTKYEVMGRTLPGEVFGGLCRLTGQDALTKFMILFYQAISGHDTKKLPFGFFNRRGEFLEVFLTANKRTDEHGNVCGCFCFLQPMTIDPEASDERQDSKDSLWKYKEYVYVLQQMKNPLNGIQFTHKLLEATGVSDNQKQLLETSEACEKQILSVIDNMDFGGIEDGKVQLNMEEFVLGNVVDAIVSQVMIFLKEKNLQLLHDIPDQIKTLPLYGDQIKLQRVLSDFLLSVVHHAPSPDGWVEIKVLPGLKLIQDGNELIHLQLRMTHPGQGLPAALIDDMSGERNRWTTQEGIALNVAQKLLNVMNGHVRYVRGEDKCYFLIDVELQTLKPTQHGPKLEVTQEIEI

SEQ ID NO: 26129 - protein, 835 aa, Gloeobacter violaceus PCC 7421
MRAVLMAGGSGTRLRPLTCDLPKPMVPILNRPISEHILNLLKRHGVDEVIATLYYLPDVMREYFRDGSDFGLRMTYAVEEEKPLGTAGCVKNIENLLHETFIVISGDSLTDIDLSAAVAFHKEHGSKATLVLARVPDPMEFGVVITDAHGRIVRFLEKPSTSEVFSDTVNTGTYILEPEVLEYLPADTEVDFSKDLFPKLLAKGEPMYGYVAEGYWCDVGSLDTYREAQYDALAGKIRLEHGYRQHAEGIWIGDNTLVDPSVHLEPPLIIGHNCRIGPRARLSAGTIIGDNVTVGAAADLKRPVIWNGAIIGEEVHLRGCTIARGARVGRRAQLLEGSVVGALTTVGDEAVIAPEVRLWPSKKVEVGAHVTMNLIWGTTAIRNLFSQRGVSGLANVEITPEFAVKLGAAYGATLKPGAQVQVSRDQRAISRMISRSLVSGLMSVGVNVQNLEATAIPIARYVAPMLEVNGGIHVRVHPEHNDRTLIEFFDSQGINLGKSREKKIESAFFKEDFRRARIDEIGEITYPSRTLEFYGAGFIDHLSAVALRNSPARVVIDYAYGVSGAVLPTLLGKLGCEAVVLNAALTPNAPPTSKQRESLLTQLGNVVEALQATFGVQIFANGERFTLVDEAGAAIKDEQLTALLVELVLTDSPRAVVVVPTEVSGVVEQIAHRHDGRVVRTKASPTALMEAAAATNNVALAGSAEMGFIFPQLHPGFDAMFAVARLIEMLAEQERSLSQTRQDLPRIHHRHHVIHCPWNAKGAMMRQLVESHPEESLELMDGVKVHFSKEDWVLILPDAGEPLVHIYSNGHNRESVERMARKYREVVQEFTRDRR

SEQ ID NO: 26130 - protein, 776 aa, Nocardioides sp. JS614
MSANTEQASTDRTQDVWGERTPHPRATPWPTRVDLHLEDGLAEDQVDSWVASACLLCSNGCGVDIAVKDGKMVGVRGRETDRVNHGRLGPKGLYGSTPWSHSPDRLTTPLVREHGELVETDWDTAMGRIVARSKQLLEEQGPLSHGFYTSGQLFLEEYYTLAVIGKAGLGTPHMDGNTRLCTATAAAALKESFGADGQPGSYEDIEHCDALFLYGHNMAETQTVLWSRILDRTRGEDPPKVVCVDPRRTAVAAEAERTGGVHLAPKVGTNLALMNALIRELLEHDAWVDHAWVDAHTIGLEGLRAAVAPYTPEQAAEICGVDPDEVRRAARIFGESEAVLSTVLQGFYQSHQATAASVAVNNLHLLRGMIGRPGAGLLQMNGQPTAQNNRETGADGDLTGFRNWDNPTHVQELADHWNVDPMTIPHWAPPTHAMQIFSYAQAGTVGLLWISATNPAVSMPETERIRSILSGDQCFVVVQDLFLTETAQLADVVLPAAGWGEKTGCFTNVDRTVHLSQQAVDPPGEARSDLDIFLAYADAMGFEDQDGGPLITWRTPEETFAHWSAATRGRPCDYTGITYELLSGPTGVQWPLGVERLYADAQFPTHTEQCETFGHDLTTGATVTEQEHRAQAPAGRAFLKGAPYSPPHEEPSAEYPFRLTTGRTVYQFHTRTKTARSRPLDACAPHAWVELAPADSQRLGIADGDLVRLESPRGSVDVPARVTEVTEGAVFVPFHYGDHPANELTMTVWDPVSKQPTFKTAACRVTRLGAGTGEEG

SEQ ID NO: 26131 - protein, 441 aa, Magnaporthe grisea 70-15
MAAELRERVAKPHIDHYLSPDTHGLKKPKSSSNEIKSEKRREPRQEHPAGDEKYGRVVAILRRLAFVSYFAICVCTILMTQVIGAPLYWYNRDWYYSWMSMTKAHFGITITTMTKWWGPTIIRISGDDSMDGQIRQKPDGTVEFAFPERLVMIANHQLYTDWLYLWWVAYANSPQMHGWIYIILKESLKYIPVIGTGMMFYGFIFMSRKMAVDKPRLAHRLQKLKTSSADPSASAGRSLNPMWLLLFPEGTNASANGQIKSGKWAEKIGVKNPQHMLLPRSTGMHFILSELKGTVEYLYDCTVAYEGIPRGDFGEQYFTLSSTYFEGRPPKSVNFHWRRFRVADIPLDTPEAFDEWMRERWYEKDDLMDKYLTNGRFPSSKVAIVGAKSSDDAYIETEVRPRWPGEVMQLFSVVGPGLLVEVDVGFRIRWNCGVHNICRKI

SEQ ID NO: 26132 - protein, 1106 aa, Oryza sativa (indica cultivar-group)
MLRSHSKARALPLDGTVEHLGCGQGVVIGAARQGEDQVGFLQELRSMPTTESMTVRTVRRKLRSAMAWGISEKASGLRSLSWTGWLRRAKAAWGGAARVRRAMERRAGGRGRRAAANGGAAGRGRRRVQPQRLLRHGLQEEERMEPPPPPPYIHIETNDFLHRRHKRQKEEDIAVCECQYNLLDPDSACGDRCLNVLTSTECTPGYCLCGVYCKNQRFQKSQYAATRLVKTEGRGWGLLADENIMVTEFTLILWSANVVKYIQAGQFVMEYCGEVISWKEAKRRSQAYENQGLTDAYIIYLNADESIDATKKGSLARFINHSCQPNCETRKWNVLGEVRVGIFAKQDIPIGTELSYDYNFEWFGGAMVRCLCGAGSCSGFLGAKSRGFQIHITVMSCIIIIEEDPSWLKICRFVLPGSTCHFKQSLNFLKCRNIDGYNKSEHRFSVENVPLYDSADDEPTSIPKDILIKDEPNTQDGNNNTIQNTGIPIIASSIDFTQNGSIEYGAQCAEDALQNSTRGVANLQNQSAPRDNNHTELVAVKRRPTLRGGKAKRGMRKQLNVVGICDRLASEVAREEILYCEEMKNEAAAEIDSLYDEIRPAIEEHERDSQDSVATSLAEKWIEASCCKYKADFDLFPLFRISRVMGKSEHGNLLVSLSDGLPHYSLAAAVGLAIGVAGLCKALHSSLVIPPVSQKKLLSNSDRLYYTGGLKNLGNNCFLNVILQALASCDGFVSSLDNLLGSEDVLPEEKSEKMPLIFALSSLIKVENKVLVPVTLVVSGITEQWWSGGIVTYCNTVNTLSLDFENFYCLPLSPVATINGDIINGCSLVDCLEHFTALEHLDNYRCDHCWHNVAAKYLSLKSEVDEEKINKLHTCVDYGTCSCRHIFTPEEMTCSISSQATKQLAITHFPKILCIHLLRASVGLDGEFVKRGGHISFPLLLDLSPFAGGALIPGQGPKPSAMNKQRHGQQTLHLWRQLNAEMPVNMFPAATDGDSSSHHCGDESINTLGRSFYVGNRDADSRFLSSSSLTDKLYGLSSVVEHYGVCGGGHYAAYRRVTPNSDSNEPVQSLASFRKEWLYVSDDHVSHVSECEVLAAEATLLFYERL

SEQ ID NO: 26133 - protein, 339 aa, Candida albicans SC5314
MTKMSNPLKVIDISEDSITTARELLDAATSQGFLFLEGHDFTQEEVDKLFELSKSFFELPNNYKSKYPVDSSNHGYVMMGKENLDPNGQKQGDPKEALNIANLNFETGKSLNIIPDWISENQERDELISNTILRLYRLSIKILRMLARALEIEDDETHRIKGENWFASKYASDSESGSTFRLLHYPCQTSLNPESVIRAGAHTDYGSMTLLFQKENQEGLEIFSPISKKWEQVPFIPSTIEKMAPPLVVNIGDLLSYWTAGLLKSTIHRVKFPAKAQELGQDRYSIVFFSHPSDNALLEPVPSEIIRKIEGRGANKETTYITAKQHLQKRLAATYGWKK

SEQ ID NO: 26134 - protein, 147 aa, Triticum aestivum
YGCDLIQESGILLRLPQAVMATAQVLFHRFYCKKSFARFSAKRVAASCVWLAGKLEESPRRSKHIIFVFHRMECRRESLPIEFLDVFSTKYTELRHDLIRTERHLLKEMGFICHVEHPHKFISNYLATLEAPELTQEAWNLANDSLR

SEQ ID NO: 26135 - protein, 427 aa, Dechloromonas aromatica RCB
MSSIVDVIAREILDSRGNPTVEADVLLESGVMGRAAVPSGASTGTREAIELRDGDASRYLGKGVMQAVENVNTEISEAIIGLDAQEQAFIDQTMIDLDGTDNKSRLGANAILAVSMAVAKAAAEESGLPLYRYFGGMSPMQMPVPMMNIINGGEHANNSLDIQEFMVMPVGAANIREAIRCGAEIFHALKKLLNKKGHSTAVGDEGGFAPNLGSHAEALQIIMEAIEIAGYVPGQDVLLALDCAASEFYKDGKYKLAGEGLELTSAQFVDYLANLADQFPIVSIEDGMSEADWDGWKLLTDRLGDKVQIVGDDIFVTNTKIFKEGIKKGIGNSILIKINQIGTLSETFAAVEMAKRAGYTAVISHRSGETEDSTIADIAVGLNAGQIKTGSLSRSDRIAKYNQLIRIEEDLGDTASYPGRETFYNLR

SEQ ID NO: 26136 - protein, 381 aa, Glycine max
RIRSATSAPPPRLMPDLSTLTRIPWNKQDEMVLADMCVKPGEAWEYCPRDALRRASKILKDEFDLEMNAGFENEFILLKSITREGKEEWIPFDSSPYCSSSAFDAASPILHEVAASLHSLGISVEQLHAEAGKGQFELVLKYTVCTKAADNLTFTREVVRAIARKHGLLATFIPKYALDDLGSGSHVHLSLSRNGQNVYMASDRSSKHGISTLGKEFMAGILHHLPSILAFIAPLPNSYDRLQPNTWSGAYLFWGNENKEAPLRATSPPGTPDGLVSNFEMKSFDGSANPYLGLAAILAAGIDGLRRKLSLPEPVDTNPNPETLQRLPASLSESLDALNKDDFLKEFMSDKLLTTIKAIRKAEIDHYTKHKDAYKQLIHRY

SEQ ID NO: 26137 - protein, 308 aa, Shigella flexneri 2a str. 301
MAVAMDNAILENILRQVRPLIGQGKVADYIPALATVDGSRLGIAICTVDGQLFQAGDAQERFSIQSISKVLSLVVAMRHYSEEEIWQRVGKDPSGSPFNSLVQLEMEQGIPRNPFINTGALVVCDMLQGRLSAPRQRMLEVVRGLSGVSDISYDTVVARSEFEHSARNAAIAWLMKSFGNFHHDVTTVLQNYFHYCALKMSCVELARTFVFLANQGKAIHIDEPVVTPMQARQINALMATSGMYQNAGEFAWRVGLPAKSGVGGGIVAIVPHEMAIAVWSPELDDAGNSLAGIAVLEQLTKQLGRSVY

SEQ ID NO: 26138 - protein, 343 aa, Mycobacterium tuberculosis H37Rv
MRIGVLTGGGDCPGLNAVIRAVVRTCHARYGSSVVGFQNGFRGLLENRRVQLHNDDRNDRLLAKGGTMLGTARVHPDKLRAGLPQIMQTLDDNGIDVLIPIGGEGTLTAASWLSEENVPVVGVPKTIDNDIDCTDVTFGHDTALTVATEAIDRLHSTAESHERVMLVEVMGRHAGWIALNAGLASGAHMTLIPEQPFDIEEVCRLVKGRFQRGDSHFICVVAEGAKPAPGTIMLREGGLDEFGHERFTGVAAQLAVEVEKRINKDVRVTVLGHIQRGGTPTAYDRVLATRFGVNAADAAHAGEYGQMVTLRGQDIGRVPLADAVRKLKLVPQSRYDDAAAFFG

SEQ ID NO: 26139 - protein, 609 aa, Oryza sativa (japonica cultivar-group)
MGRKIKVKKKKASSKVWQPGVDTLEEGEELQFDPQAYNYLRGFNIGWPCLSFDVVRDQLGLVRSEFPHTLYGVAGTQAERASWNYIGIFKICNINGKKREPIPASAIDGDSDMDSESSSDEEDEAANEDTMPILHLKKVAHAGCVNRIRSMNQEPHICATWGDTGHVQVLIFDSRGTESKLYQRLEWTCEVWDFSSFLNSLAESGAVAHNEDDRIHNHVPVKIFGGHKDEGYAIDWSPLVTGRLVSGDCNKCIHLWEPTSNSWNVDTNPFWSPTEADIFASCSADRTISIWDIRTGKKPCISVRAHNADVNVISWNRLASCMIASGCDDGSFSIRDLRLIKDDSLVAHFEYHKHPITSVEWSPHEPSTLAVSSADHQLTIWDLSLEKDAEEEAEFRARMREQADAPEDLPPQLLFVHQGQKDLKELHWHPQIPKNLLLVLLIIFEGRQLMDHLTKEQIAEFREAFNLFDKDGDGTITSKELGTVMGSLGQSPTEAELKKMVEEVDADGSGSIEFEEFLGLLARKLRDTGAEDDIRDAFRVFDKDQNGFITPDELRHVMANLSDPLSDDELADMLHEADSDGDGQINYNEFLKAKAEYDGGTWKWRPSVK

SEQ ID NO: 26140 - protein, 224 aa, Triticum aestivum
MEQCGVGLYGVVEGSGYATVTTAPPKRPAGRTKFRETRHPLYRGVRRRGAAGRWVCEVRQPNKKSRIWLGTFATPEAAARAHDVAALALRGRAACLNFADSATLLAVDPATLRTPHDIRAAAIALAQAACPHDARRSSVSVASARAPAMVIMEEAAAAPYDSYAMYGGLADLDQHSYCYSNGMSGGGDWQSISHMDGADEDGSYGAGDVALWSYWSRGIDRADC

SEQ ID NO: 26141 - protein, 401 aa, Apodachlya brachynema
  misc_feature (180)..(180): Xaa can be any naturally occurring amino acid
  unsure (1)..(401): unsure at all Xaa locations
SGNPSVEVDLVTEDGLFRAAVPSGASTGEFEALELRDGGKDYMGKGVKTAVHNVNDIIAPALIGKDQNKQTELDTFMVETLDGTKNEWGWCKKKLGANSILAVSLALCKAGAAAEKVPLWQHIANLAGNPTPCLPVPSFNIINGGSHAGNKLAMQEFMILPVGATSFTESMQIGCEVYHXLKKVINKRYGLDATAVGDEGGFAPNIQVNGEALDLIQEAIALAGYTDKVKIGMDVAASEFYTGKEDARYNLDFKNENAQDSDKISADELIDVYQSFITKCKDKSPIVSIEDPFDQDDWESWMKLTAAVGEDIQIVGDDLTVTNPTRVQKAIDQKACNALLLKVNQIGSVTESIQAVTMSKRAGWAIMASHRSGETEDSFIADLAVGLSAGQIKTGAPCRER

SEQ ID NO: 26142 - protein, 184 aa, Arabidopsis thaliana
MQFFAVADLLLWRNRTGAVILLISSTGFWFLFERAGYNLLSFVSNVLLLLVAIFFLWAKSATVLNRPLPPVPNMEIPEEFANKAADDLRVWINYVLSIASDITIARNPIRLLQVSLVLWAISYVGTLINSLTLVYIGVLLSLSFPIVYEKYQDHIDEKVNSTSKFVRNISRKFPLPINKEKKHQ

SEQ ID NO: 26143 - protein, 388 aa, Apodachlya brachynema
  misc_feature (161)..(161): Xaa can be any naturally occurring amino acid
  unsure (1)..(388): unsure at all Xaa locations
SGNPTVEVDLITQDGLFRASVPSGASTGIHEAVELRDGGSRFLGKGVLKAVNNVNDIIGPKLEGMDPRKQKDIDHLMIQLDGTDNKGRLGANAILGVSLAVAKAGAKSKGVPLFQHFADMIKNDKLILPVPAFNVINGGSHAGNKLAFQEFMIMPVGASSXSEAMVMGCEVYHHLKGVIKKKYGQDATNVGDEGGFAPNIQSNREGVELLMSAIEKAGYNGQVKIAMDVASSEFYTDAGHYDLNFKNKGSNEKPLTGEELGALYQQLSNEFPIISIEDPFDQDDWSHYKSFTNAIGEKVQVVGDDLLCTNPKRIATAVDTFACNALLLKVNQIGSVTESVQAVADAKKAGWGVMTSHRSGETEDSYIADLAVGLSTGQIKTGAPCRER

SEQ ID NO: 26144 - protein, 128 aa, Burkholderia xenovorans LB400
MKRYGVEGGKGTGGQHMPFARAVEADGWLFVSGQTPMENGEVINGGIVEQSHKAIQNVFAILKEAGYGAEHVVRCGVWLDDPRDFASFNKVFREYFGENPPARACVVSSMVIDCRVEVDCVAYKKPTA

SEQ ID NO: 26145 - protein, 389 aa, Heterosigma akashiwo
SGNPTVEVDIFTDNGMFRASVPSGASTGIYEACELRDGGDRYMGKGVLQAVNNVDTLIKDALIGKDPTQQREIDQIMLDLDGTKNKTKLGANAILGVSLAVSKAGAAAKGVPLYQHYADLAGNTQLVLPVPSFNVINGGSHAGNKLAFQEFMVLPTGAATFSEAMQIGCEMYHTLKKVIKERYGQDATNVGDEGGFAPNIQSNREGVELLMEARSRCGHGDKIVFGMDVAASEFWTEDKEYDLDFKTKDNDGSQKITGAELAQMYKDLAAEFPIVSIEDPFDQDDWEAYTAMTADMGTDCQVVGDDLLVTNPERIQMASEKSACNAPLLKVNQIGSVTEAIDAVKMAKQNGWGVMTSHRSGETEDCYIADLAVGLCTGQIKTGAPCRER

SEQ ID NO: 26146 - protein, 363 aa, Buchnera aphidicola (Rhopalosiphum padi)
MKKKFRIAVLPGDGIGPEIMREAYKILNILEKNFSLPLEIREFSVGGIAIDREGIALPEETLRGCENSDAILFGSVGGKKWDYLPIESRPERASLLPLRKHFNLFSNLRPAKLYSDLKNLSPLRSNIVRNGFDILCVRELTGGIYFGKPKGRSKNENGEYSFDTEIYYDFEIKRIAHLAFELASSRRCKVCSIDKSNVLASSILWREIVEEVSKNYPNIILSHLYIDNACMQIIKNPSQFDVLLCSNIFGDIISDECAMITGSIGMLPSASLNSKKFGLYEPAGGSAPDIEGKNIANPIAQILSLSMLIRHSMNLNEIADKIDSSVYRALKAGYRTLDISDGKNYIKTNEMGDIIAKFLINGK

SEQ ID NO: 26147 - protein, 737 aa, Ostreococcus tauri
MTTARPGTRPVRRFKSSTFDLISARIVPAIALPSITVAVDDAAPMSRAVDRAGVRARGRGDRARGRRRREGSWITLTSDDSSTGPSGCRTPACARTPTSPSVPIRESRLVTYPSRPGPIPSARRPRPWTSKRERATRSPGAVDAGPHGARARCGATRRDARADWLAKNDGKEKKRDGKKPTRDARGRRRPQTSETTSGRSEKDDVTFDGFTNEELRPDFGFRRDLYELYDVPVNDEPLGAGSYGVVRAAVSKKTGEVFALKTLKKAPWIKAPASMQAVNYYHGKIRNEVEVMRTIGGSLSVCYLYEAFEDDENCHLLMELCSGGELLDRVVIGSSEEYREAKVANLVKSVLRTTVQCHRRGIIYRDIKPDNFLFQTEDQDSPLKATDFGLAGKLPPNGENLARRCGTPSYMAPEVIERNYNSPADVWSAGVVTYQLLSGRLPFTDKINPRPNAKEVFRAILEDPIDFETDPWPEVSEDAKDFVKKLLNKDPDARPTARAALLHPWLTKSEALWKAEALKGKDTALNGQVVARLQRFATQGLLKRSVLRLITSEMLSEDMEDAVSLKNADLATLKKLFEKLDTSGDNMVELVELEVGLREIGYDVTGKESKQLLGSLDTSGDGLIDVNEFTAALLDWEKIEKTSDYPKWVERAFKVLDKDGSGEIDADEVAELIFEDWEEDNDSVRTSIIRACIREADKDGNGQIDLEEFAGLLQSDPSDDLDQYDSRIASSFDFDQV

SEQ ID NO: 26148 - protein, 688 aa, Oryza sativa (indica cultivar-group)
MALTTLCQLKLGIVKSSFCFNAATDNDGRAEASRYDDGRRLMVISVSLIAAAAAAAAGGGAAILLGALAIGVASRRGRAAAAGGGGEGEERIGDLSASFLAELRVSTNLLHTPNTADHEVRCCSFDRGMSLHCCPAAGDPPAPAGTAEELLERARSLVPAALDAARAATGFGGRWKAIAARLERVPPCLSDLSSHPCFSKNSLCRELLQSVAATLAEAAELGARCREPPRAGKLQMQSDLDALAGKLDLNLRDCALLIKTGVLSDATVPPVAPAAEAAAQTDVRELLARLQIGHAEAKHRAVDGLLDALREDEKSVLSALGRGNVAALVQLLTATAPKIREKAATVLCLLAESGSCECLLVSEGALPPLIRLVESGSLVGREKAVITLQRLSMSPDIARAIVGHSGVRPLIDICQTGDSISQSAAAGALKNLSAVPEVRQALAEEGIVRVMVNLLDCGVVLGCKEYAAECLQSLTSSNDGLRRAVVSEGGLRSLLAYLDGPLPQESAVGALRNLVSSAISPDSLVSLGVLPRLVHVLREGSVGAQQAAAAAICRVSSSSEMKRLVGEHGCMPLLVRLLEAKSNGAREVAAQAVASLMSCPANARDIKKDEKSVPNLVQLLEPSPQNTAKKYAISCLLTLSASKRCKKLMISHGAIGYLKKLSEMDVAGAKKLLEKLERGKLRNLFSRK

SEQ ID NO: 26149 - protein, 630 aa, Digitaria sanguinalis
MPKRDKGARPRVSPPHTPPPGTESEAEGADDEAGASSAAEMGTYKCCIFFTHKFAIDDTTTPEDVRTLFSRYSGGSPYMGPDDLRRYLANWGGAGGEVAEQIVDRVLQDRSRTPRFGRPALTVDDFMHFLFSEDLNPPLRHSKVHQDMNAPLSHYFIHTGHNSYLTGNQLSSDCSDVPIIKALQLGVRVIELDIWPNSSKDDIDVLHGRTLTAPVSLIKCLRSIKQYAFVASPYPVIITLEDHLTPDLQAKVAQMVLEVFGDMLYYPESKHLQEFPSPEALKGRVMLSTKPPKEYLEAKGGTIKDREIEHQFKKGEKEEAAWGVEVPDIQDEMKVADRNEDDILFRERGLDDDDEQKTCKHVAPEYKHLITIKAGKPKGALVDALKNDPDKVRRLSLSEQELAKVASNHGPNIVSFTHRNMLRIYPKGTRFNSSNYNPFLGWVHGAQMVAFNMQGHGRALWLMHGFFQANGGCGYVQKPDFLMQTCPDGKVFDPKADLPVKATLKVKVYMGEGWHKDFKQTHFDTYSPPDFYVEVGIAGVPLDSVMRKTKAVEDNWVPVWEEEFAFPLTVPEIAVLRVEVHEQDVSEDDFGGQTALPVEELRPGICAVPLFDHKGHKFNNVKLLMRFEFT

SEQ ID NO: 26150 - protein, 540 aa, Ostreococcus tauri
MGGETRAWTTDARRARDGDGKATAEDERAAKDTVEITGLDDDDHRFNLRTLWRFMGPGFLMCIAYVDPGNFESDLQAGVLFGYKLLWVLLWATAGGWYIQGLTIRLALATGWDLARCLREEYPDPVRYALWVISELGIIASDVPEVIGTALALKLIFSIPTWVGVVLTSMSTMVFLGLQSFGVRKLEAFMASLVGVMSLCFLAECTYVDAAVSSVTAGIIIPRLPGSTALYIAISLVGAVVMPHNLFLHSALVLSRGFVLGEKSLKMAYKYNVVESGLALSVSLFINIAVVVVAAANFAHLTDPQEKNNVRDRPLQYAPQMLKEVLGPAAKGFFAAALLASGQSSTITGTYAGQFVMDGFLELRVNPVLRAFVTRMCAIVPSLAVVLIAGDQYSESLIVISSTILAIQLPFALIPLIKFTASSNIVGPMAVKPKALRYTIALTGTIISANVILVILTVAESGLVHASLAGVFLGMIITALLGLYVVSLVWLAMRPVHQNLTARIAPRMKRPSSASEDPEDAAWTNDELLPDPNEPAVYSL

SEQ ID NO: 26151 - protein, 564 aa, Oryza sativa (indica cultivar-group)
MAGAGAGEILDLPVVDLASSDLAAAAKSVRKACVEYGFFYVVNHGAEGLVEKVFAESSKFFEQPLGEKMALLRNRNYLGYTPLGADKLDASSKFKENFPCWKETMKLYHETALATGKRILSLIALSLNLDAEFFDCPVAFLRLLHYPGEANESDDGNYGASAHSDYGVLTLVATDGTPGLQICREKDKCPQLWEDVHHIEGALIVNIGDLLQRWTNCVFRSTLHRVVAVGKERYSSLRPCFFQLGIIIIQIIESSPWIQTPEVDSSRSNKQQTLPGGRGSGKPEMVAAAGDRLDLPVVDLASSDLRSSAESIRKACVEYGFFYVVNHGIEEGLLEKVFAESRRFFEQPLEEKMALLRNSSHLGYTPPYTEKLDASSKFRGDLSEKFKIGPIGDEGFQNDANQWPSEERLPCWKETMKLYRATALATGKRILSLVALSLNLDAEFFDCPLAFLRLLHYPGEINESDDGNYGASAHSDYGILTLLATDGIPGLQICKEKDRHPQLWEDVHHIDGSTLHRVVAVGKERYSVAFFLDPDPDFVVQCLESCCSEACPPRSSSFSILALV

SEQ ID NO: 26152 - protein, 308 aa, marine gamma proteobacterium HTCC2080
MNKLDQLRGMTDVVADTGDIDAIERLKPQDATTNPSLLLKAAKMPRFEELVAVVKAGNNSGADACDQFAVAVGAEIIKLIPGRISTEVDARLSFDTQATLKKAREVMALYDNQGINSERILIKIAATWEGIRAAEILEREGIQCNLTLVFGFAQAQACADAGVFLISPFVGRILDWYMANTGLKVTQSNEDPGVQSVNRIYEYYKSHGYGTVVMGASFRNTGEVEALAGCDRLTISPDLMEALSEDHGKLTRSLVPLPATLNKAAPLSEGNFRWQNNEEPMVTDKLSDGIRRFAADQVKLEHILTRDH

SEQ ID NO: 26153 - protein, 316 aa, Oryza sativa (indica cultivar-group)
MAGGGGGGNRLDLPVVDLASSDPRAAAESIRKACVESGFFYVVNHGVEEGLLKRLFAESSKFFELPMEEKMALRRNSNHRGYTPPYAEKLDPSSKFEGDLKESFYIGPIGDEGLQNDANQWPSEERLPSWRETIKMYHASALATGKRILSLIALSLNLDAEFFENIGAFIRPSAFLRLLHYPGEVDDSDYGNYGASAHSDYGMITLLATDGTPGLQICKEKDRNPQLWEDVHHIDGALIVNIGDLLERWTNCIYRSTVHRVVAVGKERYSAAFFLDPNPDLVVQCLKSCCSESCPPRFLPIKSGDYLKERLSVTYK

SEQ ID NO: 26154 - protein, 526 aa, Oryza sativa (indica cultivar-group)
MSDSELSQSTVVFGLHLWELVGIGVGAAFVLLLVLLSLLCLVASRRRRRRRGVAVATPVLHLATAVAPPKHPGKPPKDIQEVPSRAAAAAAAPKAQPAQVIQAPPPQPPPSESIQIETGKEHRITFREQQHQPPQPPPYHQRSGGPSSRGGSGESRGGGGGGGGGGAEPGVPEVSHLGWGHWYTLKELEDATAMFADEKVIGEGGYGIVYLGVLEDGTQVAVKNLLNNRGQAEREFKVEVEAIGRVRHKNLVRLLGYCAEGNQRMLVYEYVNNGNLEQWLHGDVGPVSPLTWDMRMKIILGTAKGLMYLHEGLEPKVVHRDVKSSNILLDKTWNAKLSDFGLAKLLGSERSYVTTRVMGTFGYVAPEYAGTGMLNETSDVYSFGILIMEIISGRVPVDYNRPPGEVNLVEWLKTMVSNRNSEGVLDPKMTEKPTSRALKKALLVALRCVDPEARKRPKIGHVIHMLEVDDFPYRDERRGGKAPGQVKSGEIPPVEAGDSSGNNTPKETPKGQPKDEPFKWRNQAAA

SEQ ID NO: 26155 - protein, 392 aa, Solanum tuberosum
MSCTVAIPNSPAFSPATRIPVTNSLLCKSASFSSSSPSRKSSESLTLTKFPSFTFSSLSSSSQLKILLIEKSSPETISLNRNSSECSTSAPISTSPTVSKRKRPARLDIPVVSTNFGNFPGTPTAAADFVEVEGDEYSVCCKRGRRGAMEDRYSALVNLQGNSKQGIFGVFDGHGGPKAAEFAAEHLNKNIMDELVRRNDEDVVEALKNGYLKTDTEFLSEEFGGGSCCVTALIRNGNLVVSNAGDCRAVVSRGGIAEALTSDHKPSRKDEKDRIETSGGYVDCSNGVWRIQGSLAVSRGIGDRYLKQWVIAEPETTVVELNPELEFLVLASDGLWDKVSNQEVVDAARPLCCTGMSKPQPLLASKKLIDLAVSRGSVDDICVMIIQLQQFW

SEQ ID NO: 26156 - protein, 900 aa, Arabidopsis thaliana
MPVDLDNSSTVSGDASVSSTGNQNLTPKSVGKKKRNLPGMPVVLTDCLNSDPDAEVIALSPKTLMATNRFVCEICNKGFQRDQNLQLHRRGHNLPWKLRQRSTKEVRKKVYVCPVSGCVHHDPSRALGDLTGIKKHFCRKHGEKKWKCEKCSKKYAVQSDWKAHSKICGTKEYKCDCGTLFSRWRQIVINIFKGLIFLMDFTNLWIGFCCRRDSFITHRAFCDALAEESAKNHTQSKKLYPETVTRKNPEIEQKSPAAVESSPSLPPSSPPSVAIAPAPAISVETESVKIISSSVLPIQNSPESQENNNHPEVIIEEASRTIGFNVSSSDLSNDHSNNNGGYAATALLQKAAQMGSTGSGGSLLRGLGIVSTTSSSMELSNHDALSLAPGLGLGLPCSSGGSGSGLKELMMGNSSVFGPKQTTLDFLGLGRAVGNGGNTGGGLSALLTSIGGGGGIDLFGSGEFSGKDIGRSSESFSFIPKWVFSQMSATALSRLNPVSQFGFQRIVAGKSKSFFSNSGQRRLFSDSSRFRQAMAASGSLPVFGDACLDDLVTTCSNGLDFTKKRSSGGSFTINCPVASMRLGKRGGMMKNRLVCHYSVVDPLEKSRALFGTLSKSVHTSPMACFSVGPAHELSSLNGGSQESPPTTTTSLKSLRLVSGSCYLPHPEKEATGGEDAHFICDEEQAIGVADGVGGWAEVGVNAGLFSRELMSYSVSAIQEQHKGSSIDPLVVLEKAHSQTKAKGSSTACIIVLKDKGLHAINLGDSGFTVVREGTTVFQSPVQQHGFNFTYQLESGNSADVPSSGQVFTIDVQSGDVIVAGTDGVYDNLYNEEITGVVVSSVRAGLDPKGTAQKIAELARQRAVDKKRQSPFATAAQEAGYRYYGGKLDDITAVVSYVTSS

SEQ ID NO: 26157 - protein, 582 aa, Magnaporthe grisea 70-15
MLPARAQSSNAFPPTEPKPSQAYASSQPSREPAHSALGQGLDWTGQDTPPSQRNPHRPPPRCFEIHAPRRSKTAHLSAHSPTSSSSHDDPENTADEEDSEDYCKGGYHPVQIGEKFKDGKYTIVRKLGWGHFSTVWLSRDNSSGKHVALKVVRSAAHYTETAIDEIKLLNKIVQAKPDHPGRKHVVSLLDSFDHKGPNGTHVCMVFEVLGENLLGLIKKWNHRGIPMALVKQITKQVLLGLDYLHRECGIIHTDLKPENVLIEIGDVEQIVKRVVKSEPSDKENNRNGRRRRRTLITGSQPLPSPLNATFNHANLFPSPSSQHSSLGQMLHDGAKSKSSTSPRRDGDDKQKQREKSADLLSREVSGISLDKTGEKRKADDNHGFDVISVKIADLGNACWVSHHFTNDIQTRQYRSPEVILGSKWGASTDVWSMAAMVFELITGDYLFDPQSGTKYGKDDDHIAQIIELLGPFPKSLCLSGKWSQEIFNRKGELRNIHRLRHWALPDVLKEKYHFKEEEAKRIAEFLLPMLELVPEKRANAGGMAAHLWLDDTPGMKGVKIPGLDAGSRGEGIDGWANEVRKR

SEQ ID NO: 26158 - protein, 221 aa, Zea mays
MKLDVPARQQSSQDAEQSGKTVAAAVLGTEAWSHPELPLLLRDANTDDALVPPLNFAMVDDGIFRSGLPDAANFRFLLSLNLRSIVYLCPEPYPEENARFLRTNGIRLHQFAVEGSKSGPTVLDTMSAQEPFVHIPEETIREALKVVLDVRNQPVLIHCKRGKHRTGCVVGCLRKLQKWCLSSVFDEYLHFAAAKARTTDQRFMELFDASSLMHLTAASQY

SEQ ID NO: 26159 - protein, 506 aa, Dechloromonas aromatica RCB
MNPSSLYLSTTLRRVETRHATEPLMQRAGAAAAEWVATLAGDQNHPVLVLAGPGNNGGDAFEVARLLQKRFFDVCVVFAAPPDKLPADAASARQRYVAAGGVTTHAIPEETRWSLIVDGLFGIGLTRAPEGDYAQWITAANRLAERDHCPLLALDCPSGLNADTGIAQAPSIHATHTITFIAAKPGLFTADGPDHCGEIRVASLDLDPVSEIPPDGQRLSLADVDSRLKPRRNNTHKGSFGSAGILGGAKSMVGAAFLAGRAALKMGAGRVYLGMLDPEAPSVDLLQPELMMRRADALLQADLQALACGPGLGRSAEALRLLEQSLKAPVQLVLDADALNLLAEDSRLEGKLYNRVGPAILTPHPAEAARLLGCSVRDIQSDRIKAARELAERYRSHIALKGCGTLIATVDGRWWINTTGNPGMATAGMGDVLSGLIVALLAQNWPPEMALLAAVHLHGAAADRLVAHGRGPIGLTAGEIIDTSRDIFNEWVAVPPACKMFASNAA

SEQ ID NO: 26160 - protein, 662 aa, Zea mays
MFGKLTSIGKPSGIEESTEVMKTISNAWERHNSDDIRFCLLVVVNAYIRPVAMLKNLRAKGLSTLTCMIKNCGPQILNCLFDPNCRKALQCLNSCSPTDQVCNYRCIASYESPYLEAFSLCVLQKNNCLDLNAEIPSKPNVMPLTMFREQKLSHEIAEDLFVGWLDSMEWSWRVAAGQNPAYDQFPCQYQLFYRGKAKGSFWYEPVFQVKTLEGELVWRRRRYRVRRASTPGTFYFSVLDNGVISKEYWTIVDVAEDFSWGLFHYHGAAQAAGLSYTGAVLVTPDGSYPDLEDPRLASALENCAIKKWELYTVDNCSCMGAPLGTPEGSKLHHQISPGKESLIYIYSNRSHWLQQCSLHWFGSPYVDPSSISYRRYRDSPKLRIEKEWPGLYEKPSETYAKKRPQYPKEWFSMLAGLTAGHQRAWDAGCGTGQAAIGMAEHYESVVATDVSEGQIQHAIAHPKVRYLQTPEHLSEDEVVSLVGGEGSLDLVVVATSIHWFDVPLFYAVVKRALRKPGGVLAVWGYNYEIHPFEDALHGQLYPALRPYQDPRAVLAMERYRCLPFPFEPVGVGAEGAPADVDMEVEMTLEDLVGFLNTGSVVTTARAKGADLEAVCRDALKRVEDEWAGAPTVPRKLVFKAFMLAGRPPSAEKRSYRTEAPSC

SEQ ID NO: 26161 - protein, 341 aa, Glycine max
MAAASLVSLWVLFSGVALFPGSCSPQHHNILKLKMISPFTHNLSTSKIIDSHLHIWASPQEASEFPYAPGQEPPVPGNLHFLLQNMEEAGVDGVLIVQPIFHKFDHSYVTSALKKYPTKFVGCCLANPTDDGSGLKQFEDLVLKDGYRAVRFNPELWPAGEKMTNKVGKAIFQRAGELNVPVGFLCMKGIGLYMSEIEQLCTEFPSTVVLIDHLGFIKPPLNEEEGLVFSQLLNLSRFPKVYVKFSSLFQVSREKFPYLDLAPLLSQVVASFGANRVMWGSDFPYAAAECGYKEAKEAVLLIANQISLPPSDLEWIMGRTVAQLFPNQWTDAKQGFHRERE

SEQ ID NO: 26162 - protein, 387 aa, Phaeodactylum tricornutum
SGNPTVEVEVTTADGVFRASVPSGASTGAYEAVELRDGGDRYMGKGVLQAVQNVNDILGPAVMGMDPVGQGSVDDVMLELDGTPNKANLGANAILGVSLAVAKAGAAAKKVPLYRHFADLAGNNLDTYTMPVPCFNVINGGSHAGNKLAFQEYFVIPTGAKSFAEAMQIGCEVYHTLGKIIKAKFGGDATLIGDEGGFAPPCDNREGCELIMEAISKAGYDGKCKIGLDVAASEFKVKGEDEYDLDFKYDGDIVSGEELGNLYQSLAADFPIVTIEDPFDEDDWENWSKFTTKNGATFQVVGDDLTVTNIEKIERAIDEKACTCLLLKVNQIGSISESIAAVTKAKKAGWGVMTSHRSGETEDTYIADLAVGLCTGQIKTGAPCRER

SEQ ID NO: 26163 - protein, 149 aa, Trichodesmium erythraeum IMS101
MERTFIAIKPDGVQRGLVGQIISRFETKGFTLVGLKIMTVTKELAEKHYDVHKERPFFSSLIEFIKSGPLVAMVWEGEGVVASARKIIGATNPLTAEPGTIRGDYGISLGRNLIHGSDAIETAQTEINLWFKEEELVSWKPTLTSWIVE

SEQ ID NO: 26164 - protein, 401 aa, Phytophthora palmivora
SGNPTVEVDLVTELGEYRAAVPSGASTGEFEALEMRDGGKAYMGKGVLNAVKNVNEIIAPALVGKDVTQQAELDRFMVETLDGTQNEWGWCKKKLGANAILGVSLALCRGGAAAKKQPLWQYIADLAGNPTPCLPVPSFNIINGGSHAGNKLAMQEFMILPVGATSFTEAMQIGSEVYHNLKKVIKGRYGLDATAVGDEGGFAPNIQSNGEAIDLIEEAIKAAGYTNQVRLGMDVAASEFYTGAADARYNLDFKNENAPDSEKIPADKLQEVYEGFIAKCAGSSKIVSIEDPFDQDDWESWIKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRER

SEQ ID NO: 26165 - protein, 324 aa, Arabidopsis thaliana
MAMEIGEDEWKVCCGSSEFAKQMSTSGPLTSQEAIYTARDIWFNQVNVTDWLEAFSAHPQIGNTPSPSINSDFARRSVSEQSTAFATTSASALQELAEWNVLYKKKFGFIFIICASGRTHAEMLHALKERYENRPIVELEIAAMEQMKITELRMAKLFSDKAKVISETDSSSSPVSTKPQDRLRIIGGHLNVAAEAKAPKRSRPPITTHVLDVSRGAPAAGVEVHLEVWSGTTGPSFVHGGGGVWSSVGTSATDRDGRSGPLMDLVDALNPGTYRISFDTAKYSPGCFFPYVSIVFQVTESQKWEHFHVPLLLAPFSFSTYRGS

SEQ ID NO: 26166 - protein, 388 aa, Trichodesmium erythraeum IMS101
MKAMILAAGKGTRIRPITYRIPKPMIPILQKPVMEFLVELLRKHGFDQIMVNVSHLAKEIENYFRDGQRFGVNIAYSFEGRIEDGNLIGEALGSAGGMRRIQDFYPYFDDTFIVLCGDALIDLDLTKALQRHKEKGAMATVIMKSIPREQVSSYGVVVTDETGRIQSFQEKPKVEEALSTNINTGIYIFEPEVLDCIPSGVEFDIGSQLFPKLVEIGAPFYGVAMDFEWVDIGKVPDYWQAIRDVLIGKVKNVSIPGKEVSPGIYTGLNVAVNWDKIDIKRPVYIGGMTRIEDGAKIVGPSMIGPNCWICSGATVDSSVIFEYSRLGPGVRLVDKLVFGRYCVDKTGSSIDVQAASLDWLITDTRHPFPSPPPAEHETIKDILQENGG

SEQ ID NO: 26167 - protein, 525 aa, Burkholderia xenovorans LB400
MRFLRFLKIFFTVIRFGLDEMMLSRVNDRRVRLLLRITTIGRKFDAPPGVRLRLALESLGPIFVKFGQVLSTRRDLLPVDIANELAKLQDQVPPFDSAVAIGLVEKSLGAPVDVLFDDFERVPVASASIAQVHFATVKAGQHAGKAVAVKVLRPNMLPVIDSDLALLRDIAVWAERLWADGKRLKPREVVAEFDKYLHDELDLMREAANGSQLRRNFAGLDLLLVPEMYWEFCTPTVLVMERMVGVPISQVETLRAAGVDIPKLAREGVEIFFTQVFRDGFFHADMHPGNIQVSLDPAHFGRYIALDFGIIGALSDFDKNYLAQNFLAFFKRDYHRVATLHLESGWVPPTTRVEELESAIRAVCEPYFDRALKDISLGQVLMRLFSTSRRFNVEIQPQLVLLQKTMLNVEGLGRSLDPELDLWKTAKPYLERWMNEQIGLRGWYERLKIEAPQWSKTLPQLPRLIHHALAERHDHTRGANDEMIRQILLEQKRTNRLLQGLLLFGVAVGVGAALARVFLALAYGG

SEQ ID NO: 26168 - protein, 284 aa, Trichodesmium erythraeum IMS101
MIIGVPQVSETLSEGIALLTNLAEKGEINPWDVQVIEVIDRYLSKLTPESNISGSDDFDNLYQSGQAFLYASILVWLKADHLANSESSENNSEISEIVQIPEAENFETPKITPKLEQQLRRRAVAPSPRKRRVTLQELIEQLQLIGAAIENRKALPRTRKTTSKARAQTAKVIAELAHQENLVETAKDLEEFLLEKWPQISEGYLEFENLLELWSLRLDLKAEKQQNEQINVQVKSDRVGAFWALLLLSAQSKIELSQEEFYQEIKIHTISSHSQEQKVLDDKI

SEQ ID NO: 26169 - protein, 501 aa, Sulfolobus solfataricus P2
MISVKEMRALEINSSALGVSTLLLMENAGRSVKDEIVKRFNVKDKVAYVYVGHGGKGGDGLVAARHLADEGAKVTVILLGENKHEDAILNLNVIEEMDYSITLVEIKDMDELKPISADILIDAMLGTGFSGKPREPFRSAIKAFNNSKGFKVSIDVPSGINADTGEAYEDEYVKPDLVVTFHDIKPGLLKYNFNTVVTKIGIPVEAEIYVGPGDLIVNARSRPYYSKKGDSGRVLVIGGSYTFSGAPTLAALGALRAGADLVYVASPEDTARIIAGYSPDLITIKLRGKNISPDNFEELKLWIDRADVVVIGPGMGLAEETIEASKLIVNYLKEKNKLAVIDADALKAISGFDLYENAVITPHAGEFKIFFGEEPDKNIRDRISQVITYAKKCKCTVLLKGYVDIISDGKRFKLNKTGNPGMTVGGSGDTLTGITATLMAQKIEPFIAAYLGVFINSLAGTLAYNRLGAHLTPTDIINEIPNVINNPLDSFKRKLYKRVLS

SEQ ID NO: 26170 - protein, 560 aa, marine gamma proteobacterium HTCC2080
MKQADINQVIADRLAALDIATDINTEAFPNIIALFDDALKRHGNATACTSLGHSLSYRELDELAENFGAWLLYESGLAAGDRVAVQMPNLIQYFVVVLGALRAGMVVVNTNPLYTEREIEHQFNDAGVKLLVVQANVAQQAAAVLPRTTVEKVVITELADLHPQPKRFLINFIAKHIKKLVPAFSIPGALKLTEVLAAGRKHECVSVTQLRAGDLAMLQYTGGTTGVAKGAMLSHGNLVANVLQADALFGSYQLQGSGDTFVQPLPVYHIYAFTASMYALYVGAHTVLIPNPRDLKSVVSAFKTYRPRLFFGLNTLFVALTNDSAFQALDFSDLKVTLSGGMALTEDAAKTWEALTQCPVSEGYGLTETSPVATGNPGGAQQLGTIGIPVPKTEVRVVDATNQPLGFDDAGELCIRGPQVMQGYWQRPEATAEAINAEGWFLTGDVAVIQPDGYLKIVDRKKDMIVVSGFNVYPNELEDVVSKHPGVLECAAVGLPDSKNGEVIKMFVVRKDLALTEAELKDFCRTQLTGYKVPRHIEFRDDLPKTNVGKVLRRELRESA

SEQ ID NO: 26171 - protein, 388 aa, Thraustotheca clavata
SGNPTVEVDLTTEHGLFRASVPSGASTGIHEACELRDGGKRYLGKGVTQAVNNVKNIIGPKIEGMDPTQQKDIDFLMRELDGTENKGNLGANAILGVSLAVAKAGARSKGVPLFQHFADLIKNDKLVLPVPAFNVINGGSHAGNALAFQEFMILPTGAGSFSEAMAMGCEVYHHLKGVIKKKYGQDATNVGDEGGFAPNIQSNREGVELLMLAIEKAGYSGKIEIGMDVASSEFYTDDGRYDLNFKNKSSTDAPLTGAQLGQLYKDLAKEFPIVSIEDPFDQDDWENYQAFTAAVGKDVQVVGDDLLCTNPKRIAKAVELSACNALLLKVNQIGTLTESVQAVSDAKKAGWGVMTSHRSGETEDSYIADLAVGLSTGQIKTGAPCRER

SEQ ID NO: 26172 - protein, 473 aa, Saccharomyces cerevisiae
MFQRSGAAHHIKLISSRRCRFKSSFAVALNAASKLVTPKILWNNPISLVSKEMNTLAKNIVALIGSGHPVLNKVTSYYFETEGKKVRPLLVLLLSRALSEIPMTERNHLKIDKSDVPEDPIYSKPSQNQLFQRPASSISPLHILHGIKPLNPLTKGPEPLPEETFDKQRGILPKQRRLAEIVEMIHTASLLHDDVIDHSDTRRGRPSGNAAFTNKMAVLAGDFLLGRATVSISRLHNPEVVELMSNSIANLVEGEFMQLKNTSIDADIDTIENGHKLLPVPSKKLEVKEHDFRVPSRQQGLQLSHDQIIETAFEYYIHKTYLKTAALISKSCRCAAILSGASPAVIDECYDFGRNLGICFQLVDDMLDFTVSGKDLGKPSGADLKLGIATAPVLFAWKEDPSLGPLISRNFSERGDVEKTIDSVRLHNGIAKTKILAEEYRDKALQNLRDSLPESDARSALEFLTNSILTRRK

SEQ ID NO: 26173 - protein, 434 aa, Heterocapsa triquetra
MAISKIHARQVFDSRGNPTVEVELTTEKGVFRSIVPSGASTGENEACELRDGGKEFHGKGVRDAVENVKTIIAPALIGKDVCDQEGIDKIMLELDGTENKSKLGANAILGVSMAVCRAGAAAKGVPLYQHINSLAGSPKMVMPVPCFNVINGGVHAGNYLAFQEFFLIPVGAATFEEAMQMGSETYHTLKGIIKTKYGLDSTAVGDEGGFAPAVQDPEESLKLLMEAIGAAGYDGKIVIGSDPASSEFWKGEENVYDLDFKNPNPKKENKRSREEMVATYVRYCETYPIALLEDPFAEEDFEGHAMLTQKVGSKVEIVGDDLYCTNSKRVAMGLEKKATNAMLLKVNQIGSVTESIAAWKLCVDNKWGVFVSHRSGETEDTFIADLTVGLGTGHLKTGAPCRSERLAKYNQLLRIEEESGLKFCGKAFRTPWDA

SEQ ID NO: 26174 - protein, 181 aa, Oryza sativa
  misc_feature (18)..(18): Xaa can be any naturally occurring amino acid
  misc_feature (36)..(36): Xaa can be any naturally occurring amino acid
  misc_feature (80)..(80): Xaa can be any naturally occurring amino acid
  misc_feature (151)..(151): Xaa can be any naturally occurring amino acid
  unsure (1)..(181): unsure at all Xaa locations
NRHYARAFRRLFVEDRQXYLRQAGLAVHSGLAFLQXRLQQSKILEMTLLAQQRDLQAKIPDIEKCLDIVATLQAKKALGXAITAAFCNYLQAIYSRAQIAGTRILCASWLGANVMLESSCARRPKPSCKTHLDNATASLQVLVADLQFLRXQQTITQVTIARVSNWARAPMAATSKLIPEH

SEQ ID NO: 26175 - protein, 121 aa, Zea mays
  misc_feature (7)..(7): Xaa can be any naturally occurring amino acid
  unsure (1)..(121): unsure at all Xaa locations
ACESATXQLRSTGDVKVREATLKRLGATHARAGVADAHFEVVKTALLDTIRDAVPDMWTPEMKAAWEEAYDQLAAVIKEEMKNAAAAEEQTKNAATAAEETTNAAAAEEETTNAAAAVDAS

SEQ ID NO: 26176 - protein, 497 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNTLYTVSEALETGMVSCNTGVFSDCSIPFGGVKESGFGREGSLYGIEDYTVLKTITIGNLPNSI

SEQ ID NO: 26177 - protein, 389 aa, Ostreococcus tauri
MSHEGKPITCKAAVAFAPKQPLEVVDVVVAPPQAGEVRIKIMFTALCHTDAYTLDGFDSEGKFPCVLGHEAAGVVESVGSGVTSCKPGDRVIPCYQAYCADISENPCEHCLHPKSNLCQAVRAWTGRGVMKTDEKPRFTLARDGSEIFHFMGTSTFSEYTVVHEVAVAKVNNDAAPLDKVCLLGCGVSTGWGAVHNTAGVEAGSTVAVFGLGAVGLACIEAAVEAGARQIIGVDTNDEKEAIARQFGATDFVNPTKFPGKDTQSVIVEMTNGGVDYSFECVGNVNVMRSALECCRKGWGTSVIVGVAAAGTEISTRPFQLVTGRTWKGTAFGGYKSRVAVPKLVEKVMSGGDKANLDKYITHRMKFEQINEAFDLLHAGKCLRCVLSMD

SEQ ID NO: 26178 - protein, 324 aa, Oryza sativa (japonica cultivar-group)
MGECGGGEYRCWEELLPDALGLVFRNLPLREVLTVVPRVCKSWSRVVAGPYCWQEIDIEEWRQQQGKPEQLVRMVEMLVARSCGSCRRISVSGLPGDPLFSFIGDHARALRTLEIPRSEISDAAVESVAPRLPNVTFLDISSCTKIGARALEAFGKNCKSLVGLRRVMHPTDVAGKACQRDEARAIACTMPRLRHLEMGYMVIATDAVLDILARCRDLRFLDLRGCWAVDDKFLQERHPGLRVLGPGVDDCFENSYLEECSDYSDDSSIYSWELMEDDDDDYYAVGSDDEAIWDDGQGLENLEVRFYGGGFSESYAGFDWPPSP

SEQ ID NO: 26179 - protein, 815 aa, Gibberella zeae PH-1
MDESQLQQPRRTYLFGYPLQHSLAPLLHSTIFESLNVPWTYDLIESIDKNDFIPKLKASDCVGAAVTMPHKVAWINECDEVTDEGRAIGAINTVFIRKDEVTGERKYIGTNTDCVGVRESFLQNSPGITEKSKGKPALVIGGGGACRSAVYALYKWLGASEIYLVNRLKEEADAVIESFSGLEDGPKMTYISSLEQAKQLETPVLIVGTIPDFEPSTEGEILARDIVTELVQKEEKGVLLEMCYHPRIVTRLYSLAEDNRWKVIPGTEAMIYQDIANMVKNIFARPKDDSANPAPPEVYNWRIYALAASAALGSSMFGYDSAFIGGTLSLPSFQERFNLASETGTALASLKANIVSTFQGGCFFGVLLCYYMTEKLGRRWVLILCGIIFNLGAIIQLVADGKLSFIYAGRVLTGLAVGASSMIIPVYISESGPPAIRGRLIGIFEIFLQFSQIIGFWVNYGVNIHISPTSDVQWHIPFGLQLAPGTLLVICMLFQPESPRWLLNAGRTDQARKVLQRLRQLPADHAYLNWEIDTVLKQIEEEKSMGADRSFFAKLREVVGPTNRPRLLLGIALMFIQNMSGINALNYYSPSIFKSIGFTGTSVGLLATGIFGIVKASATGLYMIWGVDALGRRQSLMIGSTGAAIALFYLGIYSKLSGSFDVGMVPAEKTPGAYVAIVMVYIFAVFYAISWNGIPWIFCAEIFPMAIRSICLVFTTCAQWLGQFIIVYSTPYMMTDITYGTFLLFACSVVFGLFFAFFLVPETKGISLEDMDVLFSRKGMPRTWRRQTNDVIAQRRAGEEVYSKQGESVVHEEKV

SEQ ID NO: 26180 - protein, 507 aa, Oryza sativa (japonica cultivar-group)
MAFASILQLALCFLCFSIFSYNHIKSKRKNTAIPVCWPLIGMLPDLLANRHRIHDWITSLLTASQLNFRFTGPPSSNMRLFITCDPANVRHVFTSNFSNYPKGPDFTEIFDIFGDGIFNVDGDSWRRQRAKAQLLTCRPRFRAFVSRCSRAKVEKALLPLLAHFAATGESCNLQDVFMRLTFDTTTMVVSGADTGCLAISLPEVAFARAMDDATRVLLVRHIFPLSWWKLARRLGIGYERTMAEALRACDHFVNETIEKRRAEKAKGEADGSADLLSSYINDDDEEENASSSFLRDTTMNLISAGRDASAMALSWFFYLLTKNPCVVSKILEELDSVNGITTPDGMVTFDPDELRPLVYLHAALSETLRLYPPVPLEHKGVLAADALPSGHDVRPGDKIVVSLFAMARMEAVWGSDCRKFRPERWISKDGKLRYVPSYKFMTFSSGPRTCLGKDMAFVQLKAVAAAVVKNFEIEAMPGHVVEPALSIVLHMKNGLMVRVKRRHVLNN

SEQ ID NO: 26181 - protein, 518 aa, Bifidobacterium longum DJO10A
MNAEGSIEFHGRTAESLLDEFGSPLYLIDTDEVVARARHFVRAAAEAFNTSTTHVSFAGKAFLSKEVVRLVTEAGMFVDTCTMGEMKIALAAGVPGRRLVLHGNNKSDEEIALAIEQGFAKIVIDEPDEPERVAAIARRLGKRARVMLRVTVGVHAGGHEYISTAHEDQKFGVPLLAAGADAAVLDVLNALKDVTPAATNARISATHSPENGAEKTEKSERELHYDVKYPYDLSHEEVSDTDKALAAAMEAIADGPSIAVLKTILANQDVLELVGAHSHIGSNIHDADAFIHAAKRMMLLRKTLWATDAYILPEIDLGGGYSVAYTDGEDSMDIDVELTRLADAVNSTNRALGMPAPAISFEPGRYIVAPAGVTLYRVGAIKHVHLSDAKDSAGNPIAERVYVSVDGGMSDNIRPALYGADYTARLANRTGSAETMLARVCGMHCESGDIVVHEVQLPADLKRGDILAVPVTGAYGRTMASNYNQALIPAVVAVSESGAHVMLRRQTVDDLLNLDVSE

SEQ ID NO: 26182 - protein, 244 aa, Brassica napus
MVGGGVGGRGGNKAEANQLLVTSEKLLSSSDFQGAKASAIRACKSDPTLAEAADSILTICDVLIASEIRLGDSKLPDWYAALRLGRLAQNPEHVATQYRRLALLLNPSVNRFPLADQAFKVVSDAWHVLSDPSRKSLYDQEVQLSQLVQPQKQRFVWKPSQSTTNVVVAQQPPSVAQPPRRSDPMGTSFWTACPYCFVLFEYPKAYEECVLRCQDCRRAFQAVTIQKPPVEGKGEDVYFCSWSV

SEQ ID NO: 26183 - protein, 384 aa, Saccharomycopsis fibuligera
MSSTAGKSIFCKAAVAWDAKKKLSVEEIEVLPPKAHEVRIKVLNNAVCHTDAYTLSGVDPEGVFPAILGHEGAGIVESVGEGVSDIKVGDHVVALYTAECRKCKFCLSGKTNLCGSVRATQGKGVMPDGTTRFRSKDGKEIFHFMGCSTFSQYTVLADVSVAVVNPNAPFDKICLLGCGVTTGSGSVYNVAKVQADEKANTAVFGIGAVGLAVIEGLRLRNASKIIAIDVNDAKEEYARKWGVTHFINPTKLKEGETIVDKLIELTDGGCDYTFDCTGNVDVMRSALEACHKGWGVSVIIGVAAAGKEISTRPFQLVTGRVWRGSAFGGVKGKTQLPGFVDDYLKGDLKLDDYITGYRTLDDVNAAFDDLHKGDVIRTVIKLWE

SEQ ID NO: 26184 - protein, 534 aa, Zea mays
  misc_feature (359)..(359): Xaa can be any naturally occurring amino acid
  unsure (1)..(534): unsure at all Xaa locations
MGILGKGSGWCFCSRGAKLERIKSSLLAAKGAAIAAVSFPSGGGGGGAGGKGGSGFLIHRSLLLTTHGTIPSAAAAGAAEVRLSHGRLLARLVPQRFFITSSILDLTIVGLDVVDDDLSSHGQQPHFLKTCLNPSLDLGSTVLLLGHNRNDLAVGEGKVVIATDNLIKFSIDEVLWHPGSAGFDMHGNLAFMVCDPMKIAPSTPNGYASASSTAICTSKKDVPTQFGIPIPAVCEWLKQHWNGCLEDASKPMMTPARLTTCGERSGCSSLGRLRYIKTAEVEGGDVLSSSQMPPRPTWQHGACSSASAKISHGENDSIGSHSFHGQHEQSSKICKPHKEQATSLVDHSRSIRLPLPLKXMLPDDNKDEANSQAPHRTEPSNVQMNCGTLHNVAYHENCWSEVQSSSSPVVISEIGDGRDGFSSGEETMYSAETRESRNIPSPKEKKTGMVGRSQSLVNRSKWDSPKSVESSRGFPSKSQTFIPLRKPHLQAASISQKSQDYFSPTVSSNMKKRNLSQTPMKPRQRAQVTSKWIT

SEQ ID NO: 26185 - protein, 325 aa, Nostoc sp. PCC 7120
MSNPRVLCLGEVLFDCLADQLGLKLEQVKSWTAYPGGAPANVACALVKLGTPAGFIGAVGEDEPGNVLVKLLQEVGVDTTGVQRHSTAPTRQVYVVRDLAGDRTFAGFGQYDTSEFADTHLQAKQLPESVFQEADFLILGTLELAYPDSEKAIHRALELAEQYDLKIVLDVNWRPVFWHDENIARQKIQEIFKRVDFLKLAKEEAEWLFDTSDPGAITYRLGSIEGVLVTDGENGCGYCLGENEGKIPAFAVSVVDTTGAGDSFLAGFIHQLSEHGIHNLNDAETAKRIITYASAVGALTTTKAGAIASQPTAMEVETFLASNKI

SEQ ID NO: 26186 - protein, 103 aa, Saccharomyces cerevisiae
MSGRGKGGKGLGKGGAKRHRKILRDNIQGITKPAIRRLARRGGVKRISGLIYEEVRAVLKSFLESVIRDSVTYTEHAKRKTVTSLDVVYALKRQGRTLYGFGG

SEQ ID NO: 26187 - protein, 202 aa, Oryza sativa (japonica cultivar-group)
MAEPPSQSPAQTPPQAAQQQQQGPGKTPRNDIMACVAPLKAALLPCLPARDLQARRRSLQSSHEITWDFSDIDPAVSPSLLPLPPSFPRVDVERHARDFMEAAKKLQSYFISLQREDRPSTEEMLRKNLDEKLNCLSELLILGKAAAAKSSLKHALGWDIAIMEEELKTKSELIDKHKKLIEGWQKELKDQLGKHVTELERV

SEQ ID NO: 26188 - protein, 136 aa, Saccharomyces cerevisiae
MARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKKDIKLARRLRGERS

SEQ ID NO: 26189 - protein, 510 aa, Ostreococcus tauri
MTLTSTSSRIRVVRHAYERTASTLGGDDAFSSRTRDVFDAREALRRADEARVLASEIAGIAAGAGTPGVARTVSALESLTRLAVDSARNFDASKPPSGPEVIRRTFEALGATYVKLGQFIASAPSVFPKEYVDEFQKCLDATEPTDFETVKRTIERDLGRSIDDVFATIDREPLASASVAQVHRATLLGSNKEVVVKVLKPNVEDTLKADLSFVLIVSKVLQFLNPELSRTSLVDIVGDIRESMLEETDFRKEAANVAAFRRYLEDAGLTDIAKAPYVYDQFSNKRVMVMEYFSGVPLTDLEAIRSVTTRDPEQTLVNALNVWFGSVLAAESFHADVHAGNLIVCEDGRVGFIDFGIVGRISPSIWGAVQAFFQSTAARDYRRMALALVTMGATDGDVDIDKFAADLRRVYKTLDSIEPSVIVEQDDYTGAQRAAVAVDQQQVTELAADLIRAAEDNKIKLPRAFGVLIKQLIYFDRYVQLLAPDLEVIDDDRVAFVDAVAVEVKPKRIE

SEQ ID NO: 26190 - protein, 216 aa, Oryza sativa
  misc_feature (156)..(156): Xaa can be any naturally occurring amino acid
  misc_feature (177)..(177): Xaa can be any naturally occurring amino acid
  misc_feature (192)..(192): Xaa can be any naturally occurring amino acid
  misc_feature (199)..(199): Xaa can be any naturally occurring amino acid
  misc_feature (210)..(210): Xaa can be any naturally occurring amino acid
  unsure (1)..(216): unsure at all Xaa locations
TLLLRKRPKQRSAMGNSLPVESKFTDEKENDRIKYVVSSMQGWGEKMEDAHAAILNLDDTMTSFFGVYDGHGGAEVASYCAKRFHIELCNHEDYDSNLSNAMRSAFYSMDEDLQLSDAWRELVIPRNNGWMYFLKAAACTSICKATYTEPAYEGSXTACVVVIRGNQLIVGHAGDSXRCVLSRNGQASALSXDHKPDRXSLKEERVQNAXGGSWWA

SEQ ID NO: 26191 - protein, 265 aa, Coccidioides immitis RS
MDFTPAHSQMKLRSSHIHSLLDLSKQAPAILRNPPGSHLFPLTLFSKPETPELWANYENLLVACLATKDDKCALDCLQRMTTRFGPANERVMGLRGLYEEALAENEAALESILRGYDLVLKDNPVNVLSQPILKRRVALLRSMARNTDAISALVEFLDAFPTDADAWCELSSLYECQGLHAQAIFCLEEALLVVPNAWNLHARLGEMLYKSTVLSSNTEAALRVLAESVKRFCRSIELCDGYVRGYIGLQLLGEVHYKHTPAMSL

SEQ ID NO: 26192 - protein, 1127 aa, Gibberella zeae PH-1
MSTTPHQDDETNFTRSPYTPSTRAGTPKGLSEYSNAPTPKTPKSRTYSPDAIRRVTEYAPDASVALIGMRGSGLSTLAVLASSTLGFRVLDADQYFYKVTGLSRAAYKAAHGISKYRQEELQLIRTMLFDNPTGAIIVCGPGAVEGKGKEWLTEFAKEHLVIYILRDAEDIQRHLRVFDLDTIRNLIHRATPAYRRLSNFEYYNTSDTSLQKSDTSPTRGDLSPSALALKNVEKDFLNLIHGIVRRDDSYGKYKARHSLSCLPLISRSYTYALSIPLTTLTSVVSELRDIDIEADAVEFTIPMSTLCEDEHGLDDMTADRISRQVSVVRKNIYIPIIYHVNSYDMQQVNVDEYFRLLDHGLRLGAEYLCVDLAFDTAKIQTLISSRGQTKIIGHYSASDNGDDGWDSPKQWAMVQRAHTLGCDILRVCKKATSLADNFAAQHFVHRVKASQQYTIPIIAYNTGHLGRMSCYSNSILSPVTHLLIRNLAPDCPSNSLLTVKEAQKATFASFLLDDQFFGIYGNNTSQSLSPAMHEAAFKLLGMPHHYNIYTKDSMDDLFEMVKNVKFGGASITAPFKTAVIPRMDFLSDEAKAIGAVNTMICLKAPTMDSLLDRNTSGPTVALFGENTDWIGIHTCVQRNLSPINAVRRRTTGLIVGAGGMARAAAYAFLRLGIKAIVVYNRTRSKAEELIKQFKSQGSSTNRHDEASFPGSERTSQSPDRMVDPVFKILDSKKDKWPEDLSLPTIIVSCIATKDVDGTCSVDTSLPEDWLSSPTGGVVIEIHISQMLALSGKGSVQQFQILLYIFNYHHVMVANDNYPLGQGHGGCQMSTSKDMNDTSSNLPQVMDKKQFFIFGHNISHSLSPTLHNAGFQELGLPHHYQIHESENVDQSVELIINSPDFGGASVTFPHKLQIGKLLHSVSEQGQNIGAINTVVVQERDGQRVLYGDNTDWIGIRRCILKSGSQDFTSSSALVLGAGGAARAACYAIKTLGFRELIVVNRTLSKAEALASKFSELKTRAFRTLDEAEKVGDADIRLIVACIPADDLGEDRVPSGLFSKLGQGVLVEMAYRPQVTGMMKVAQRHSGWKVYRGVDVLEEQAYAQFELWTGKQAPVETMRSAMQARVASA

SEQ ID NO: 26193 - protein, 191 aa, Zea mays
MQRGDPLVVGRIIGDVVDPFVRRVPLRVAYAAREVSNGCELRPSAIADQPRVEVGGPDMRTFYTLVMVDPDAPSPSDPNLREYLHCMLQHTYCQDLVYILHLVRLVTDIPATTGVSFGTEVVCYESPRPVLGIHRVVFLLFQQLGRQTVYAPGWRQNFSTRDFAELYNLGLPVAAVYFNCQRESGTGGRRM

SEQ ID NO: 26194 - protein, 695 aa, Burkholderia thailandensis E264
MVNHKTGSNMNRRDLIKFLSFAASGTAFAGLVRSTLSSPAASSITASPRTLDAGIGISSPQAVRAAAPVLPQKDTAAGRIARAGFLATQRLSYIWTEHVPTASGIPLALVTPQDLPTIEWLIKFIAIVVGVIENFLGSAPATAVALWRDQFAKIRVDLLSLENLYSDLTHDPNLQDPVAIAQAASIQAALIALLANVGVLSKDIISRLGEIVSNHDTRSEENFKALFSTFPLPDISAAYQRDDHFASLRVAGQNPVLIKRISGLPSKFPLTNAQFQQVMGPADNLVSAAAENRLYLLDYVDNGLLATSRAVAKPLTGIGYSYAPIALFALPRGGASLVPVAIQCDQDPATNPLFLPADPSQESAYWAWQMAKTVVQCAEENYHEMFVHLARTHLVTGAICVATHRNLASTHPLYALLMPHFEGTLYINELAALTLLPPLMFIDTLFAAPIQQTQQMVASDRLAFDFYDHMLPNDIEMRGVGAANLPDYPYRDDGLLIWNAIAEWAKAYVDVYYKSDQDVVDDYELRSWAADIIANGKVKGFRPVRSKAQLIDVLTMIIFTASAQHAAVNFSQSDFSTYAPALSALLSAPAPTSAVGKSKADWLKMLPPLVSGIERVAIYEILAGVQHSALGQYRSNVFPYRPLITDPAITGSNGPLEHFRQALGDVESQINARNSIRKTPYEYLLPSRIPASTNI

SEQ ID NO: 26195 - protein, 593 aa, Oryza sativa (indica cultivar-group)
MEVAGMRKASSHASMAAAAADPDDFDLTRMLNHRPRINVDRQRSFDDRSLAELSISGTASRGGGGGGYPAMMESYESMYSPGGGLRSLCGTPASSTRLSFDPHPLVFDAWDALRRSLVCFRGQPLGTIAAVDHSSDEVLNYDQVFVRDFVPSALAFLMNGEPEIVKNFLLKTLLLQGWEKRIDRFKLGEGAMPASFKVLKDAKRGGAERLVADFGESAIGRVAPVDSGFWWIILLRAYTKSTGDLSLAETAECQRGIRLIMNQCLAEGFDTFPTLLCADGCCMIDRRMVIKRFDFGQNQTALNLIKMGVYGYPIEIQALFFMALRCALLMLKPDAPEGKETMDRVATRLHALTYHMRSYFWLDFQQLNDVYRYRTEEYSHTAVNKFNVIPESIPDWVFDFMPSRGGYFVGNVSPARMDFRWFALGNFVAILASMATPEQAAAIMDLIEERWEDLIGEMPLKISFPAIESHEWEFVTGCDPKNTRWSYHNGGSWPVLLWLLTAACIKTGRLKIARRAIELAEARLARDGWPEYYDGKLGRYVGKQARKLQTWSVAGYLVAKMMVEDPSHLGMISLEEDRAMMKPVLKRSASWTV

SEQ ID NO: 26196 - protein, 305 aa, Gibberella zeae PH-1
MASQDQESRTLHLVGIGVGHSIAPPMHNHIAKSLGLPWTFYATECATLDELMDLARKDTTAGLVVTMPYKNAILPRLDILDDLSTTIGACNNVYRDWEDPKKLHGTNTDWRGIKGCLLEKGDKPGVPVLNKPALIVGAGGASRAAVYALNSYFKSSVIYVLNRDAQEVEDLVKDSQKLSPVPKIVHVKEGDAQNLETPYYVVGTVPDLEPKTPEELAVKASLEEFLSRPEKGVLLDMCFKPRRTRMIKLAEEKGWPTVEGTHVIGYQIEEQWRLWAGPDKVKKLDKEGAWKVLMAGAESSAGINF

SEQ ID NO: 26197 - protein, 328 aa, Penicillium chrysogenum
MSVSSSTFFAPPPPGWLNYTLLWNLSHIDPFSPRNSTVLPPGTYWGQYQDITKSNTQLSVAERLWVAWYAWVQNDVLATGIMSFLIHELFYFGRSLPWIFIDSLDFFNRYKIQSSKVPSLREQWDCAKFVLLSHFTVELPQIWLFHPMAQFFGLSTSIPFPSPWTMTYQIAIFFVMEDTWHYFFHRALHWGPLYKAIHKVHHQYSAPFGLAAEYASPIEVMILGFGTVSSPILWCAFTGNLHILTMYIWIVLRLFQAVDAHSGYEFPWSLHHFLPFWAGADHHDLHHEKFIGNYSSSFRWWDYLLDTDYTPDALKRRREQKVKAKKTQ

SEQ ID NO: 26198 - protein, 380 aa, Geobacillus stearothermophilus
MAKRDYYEILGVSKNATKEEIKKAYRKLSKKYHPDVNKEPDAAEKFKEIKEAYEVLSDDQKRAHYDQFGQADPNQGFGGFRSDDFDLGGFSGFGGFEDIFNTFFGGGRRRNPNAPRAGADLQYTMTLTFEEAAFGKETDIEIPSEETCNTCHGTGAKPGTKPETCPHCHGAGQISTEQSTPFGRIVNRRTCPYCGGTGQYIKEKCTTCGGTGRVKRRKKIHVKIPAGIDDGQQLRVAGQGERGLTVGRREIYILSFMWSRMSFLNVTAMIFIAKCRLRLRKLRLGMKSKSRPFTGKLKLKIPAGTQTGTRLRLKGKGVPNVRGYGYGDQHVIVRVVTPTKLTEKQKQLLREFDQLGGSSMHHEPHDRFFDKVKKAFKPES

SEQ ID NO: 26199 - protein, 423 aa, Magnaporthe grisea 70-15
MAITKIHARSVYDSRGNPTVEVDVVTDTGLNRAIVPSGASTGQHEACELRDGDKSKWGGKGVTKAVENVNNIIGPALIKENIDVKDQSKVDEFLIQLDGTPNKTKLGANAILGVSLAVAKAGAAAKKPYVLPVPFMNVLNGGSHAGGRLAFQEFMIVPSAAPSFTEAMRQGAEVYQQLKGLAKKKYGQSAGNVGDEGGVAPDIQSAEEALELITAAIEAAGYTGKMNIAMDVASTEFYKEDEKKYDLDFKNPDSDKSKWITYEELAAMYSDLCKKYPIVSIEDPFAEDDWEAWSYFYKTQDIQIVADDLTVTNPLRIKKAIDQKAANALLLKVNQIGTLTESIQAAKDSFADGWGVMVSHRSGETEDVTIADIAVGLRAGQIKTGAPARSERLAKLNQILRIEEELGSNAVFAGESFRKAINM

SEQ ID NO: 26200 - protein, 384 aa, Ralstonia eutropha JMP134
MSEAQAIATPKPKKSVALSGVTAGNTALCTVGRTGNDLHYRGYDILDVADACEFEEIAHLLVHGKLPNKAELAAYKTKLKSLRGLPANVKAALECVPASAHPMDVMRTGVSVLGTVLPEKDDHNTPGARDIADQLMASLGSMLLYWYHYSHNGRRIEVETDDDTIGAHFLHLLHGKKPSALWERAMHTSLILYAEHEFNASTFTGRVIAGTGSDMHSAICGAIGALRGPKHGGANEVAFEIQKRYDTPDEAQADITRRVENKEVVIGFGHPVYTVADPRNQVIKETARNLSKDAGSMKMFDIAERLETVMWDIKKMFPNLDWFSAVSYHMMGVPTAMFTPLFVIARTSGWAAHIIEQRIDNKIIRPSANYTGPENLTFVPIEKR

SEQ ID NO: 26201 - protein, 277 aa, Oryza sativa (japonica cultivar-group)
MSPPSGGGKRGRDPEEDVYVDNLHSHKRYLSEIMASSLNGLSVGDSLVDNIMESPARSENTSYFRDEIISQYSPMSEDSDDYRCYDTQLPNGSQTDAMVSPSTSPMSSPHRFQKPQSGLLSANPYPLPSCSLSSVVCSNPRRGSENEGRFPSSPNDMCHGGDLRKTALLRSVQMRVQGPHAYELSFCGRQEQEHAHDHEDEHQHEHLEGLEGAERSSSHRETISDGVSYQMPENSYGRPEHDIDYIEDCTPHGCLSDLKFKQEDKDCSKLTSMDKNR

SEQ ID NO: 26202 - protein, 289 aa, Sulfolobus solfataricus P2
MKENISALVTPYDDKENINTEALQQLLDFLIKKGIKDFWVLGTSGEFNMLSQDERILVVSKIREMVKGKIYVGVNENSTRNSLILAKKYYDLGVDYIFSVPPIYHKPSEKGLISYFSELRNAIDLPLFIYNIPSFTGYNVPLHIIEKLAREYVLDGMKYSTTDFVSFLKYLKALKGVNKNFKVFIGEDRMILSALILDTDGAVSGISNLVPELVTNLFLEFDRGNIQRAIEIQRILNKLVDVVSLGDYPSGIKIGLRYRGINVGSVRKPLLEDSRAEGEIYNVLKELGI

SEQ ID NO: 26203 - protein, 488 aa, Oryza sativa
  misc_feature (205)..(205): Xaa can be any naturally occurring amino acid
  misc_feature (349)..(349): Xaa can be any naturally occurring amino acid
  unsure (1)..(488): unsure at all Xaa locations
MGRRSGGRKLPFFASNASTSSSTKRTRSARRLPSLTRPRASSSPSPASPSPPPPSASHPAPPSPPLAVSPAGAGKVGKKKAGARLWMRLDRWGVSETLHLDKGSIIRRAGLPPRDLRILGPVFSDSSSILAREKAMVINLEFIRAIVTADEILLLDPLTIDVIPFVEQLTHHLPLKNLVCGNGQPGGDDHGEKHDDSPGDQVPRXLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLXDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWGSNHPEAAVCLLCREIADESLNFMDNTE

SEQ ID NO: 26204 - protein, 528 aa, Arabidopsis thaliana
MGNCCSHGRDSADNGDALENGASASNAANSTGPTAEASVPQSKHAPPSPPPATKQGPIGPVLGRPMEDVKASYSLGKELGRGQFGVTHLCTQKSTGHQFACKTIAKRKLVNKEDIEDVRREVQIMHHLTGQPNIVELKGAYEDKHSVHLVMELCAGGELFDRIIAKGHYSERAAASLLRTIVQIVHTCHSMGVIHRDLKPENFLLLNKDENSPLKATDFGLSVFYKPGEVFKDIVGSAYYIAPEVLKRKYGPEADIWSIGVMLYILLCGVPPFWAESENGIFNAILRGHVDFSSDPWPSISPQAKDLVKKMLNSDPKQRLTAAQVLNHPWIKEDGEAPDVPLDNAVMSRLKQFKAMNNFKKVALRVIAGCLSEEEIMGLKEMFKGMDTDSSGTITLEELRQGLAKQGTRLSEYEVQQLMEAADADGNGTIDYGEFIAATMHINRLDREEHLYSAFQHFDKDNSGYITMEELEQALREFGMNDGRDIKEIISEVDGDNDGRINYDEFVAMMRKGNPDPIPKKRRELSFK

SEQ ID NO: 26205 - protein, 681 aa, Ostreococcus tauri
  misc_feature (1)..(2): Xaa can be any naturally occurring amino acid
  unsure (1)..(681): unsure at all Xaa locations
XXPFLGQGGAMYRSFAFLSAAAPCALLMSPLVYVAAIGAMARRGVLIRGGLTLDALAEVGAVALDKTGTITTGQMTCTRVTRFENGAQHQTSPSAASKALAYAVTLEGGSSHPIARAVTQAAQGVVLPDVGAVSSYKVVAGSGVEGTIEGKRARFGSSAFALELCEEGADECLAEVIAQEGEILSVLAVEGEGPALFTFSDTLNSQAPAAVESLRNGKCRRAWWQPPDESHGMEVIMLTGDNQTSAETMAEAINLKQENVYAGLTPSQKLGLVETLRERVNSRKYSRVAMVGDGINDAPALASADVGVAIASTPSDAAASVADVLLVTKDTSGGIAQLPELFRIAQSTRAVLRQNIALAVVSIVGSAIPALIGAFPLWLAVILHEGATVMVALNSVRLLVTFGRQPLSKSTTLVLTAFTVFCCLGAAYTLCSEAIAIWFSTVHVTHWIGVSMAFKSAWAGLLAGCLHTLTGPDHLAALTPLTVGPSRAQNALMGALWGFGHNTGQILFGCIFILLRDKLPLNMDLIGQWGQGIVGLTLVIIGAMGFWESVGGHSHSHSHSHSHDGHSHSHGDASVPMKRDTNFISWTYITGTIHGLQPDSLFLLLPAMTLPRVEAISFLATFFIGTIFAMGTYTYCIGAGTAALEKNNPKFVSYIARGSSAVALGFGVLFIISAVFGLELV

SEQ ID NO: 26206 - protein, 1474 aa, Gibberella zeae PH-1
MASRSTESLPDSGHENGSTSNHSSFAPQHSTGSTYGQPSISQANTMIMDEQDRQELHRLATGISQHRRQSVSSLASTIPVVEERDPALDPTNKAFDLSKWLPSFMHRLRDAGVGPKSAGVAFKDLSVSGTGAALQLQKTLGDVILGPLRIAQYLRSGKKEPKMILHRFDGLLQGGETLIVLGRPGSGCSTLLKTMTGELQGLSVSENSIITYNGVSQKDMMKEFKGETEYNQEVDKHFPYLTVGQTLEFAAACRMPSNAETVLGMSRDEACKSATKIVMAVCGLTHTYNTMVGNDFIRGVSGGERKRVSIAEMMLAQSPMAAWDNSTRGLDSATALKFAAAIRLASDYTGSCNALAIYQASQAIYDLFDKAVVLYEGRQIYFGPANKAKAYFERMGWQCPRRQTVGDFLTSATNPQERKARPGMEKSVPRTAEEFERYWHNSQEYKTLREEIERYQGRYHVDNRSEAMAPLRERKNLIQEKHVPRKSPYIISLGTQIRLTTRRAYQRIWNDIVATATHTITPIIMAVIIGSVYYGTEDDTGSFYSKGAVLFMGVLINGFAAIAEINNLYAQRPIVEKHASYAFYHPAAEAISGVAADIPIKFVSATVFNIVLYFMSGLRREAGAFFLYFLISFISTFVMSGIFRTLAAVTKTVSQAMTLAGPMILALVIYTGFMIHVPQMVDWFGWIRWINPIYYAFEILVANEFHNRNFECSTFIPAYPQLIGDSWICSTVGAVAGQRTVSGDDFIETNYEYYYSHVWRNFGILITFLVFFMAVYFTATELNSKTSSKAEVLVFQRGRVPAHLESGVDRSAMNEELAVPEKDAQGTDTTTALEPQTDIFTWRDVVYDIEIKGQPRRLLDHVTGWVKPGTLTALMGVSGAGKTTLLDVLAQRTSMGVITGDMFVNGKPLDASFQRKTGYVQQQDLHLETSTVRESLRFSAMLRQPSTISTKEKEEWVEKVIDMLNMRDFASAVVGVPGEGLNVEQRKLLTIGVELAAKPKLLLFLDEPTSGLDSQSSWAIVAFLRKLADAGQAILCTVHQPSAILFQEFDRLLFLAQGGRTVYFGDIGENSRTLLNYFERQGARACGDDENPAEWMLEIVNNARSSKGEDWHTAWKASQERVDVEAEVERIHSAMAEKAPEDDAASHAEFAMPFIAQLREVTIRVFQQYWRMPNYIMAKLVLCTVSGLFIGFSFFNADSTFAGMQNILFSVFMIITVFTAVVQQIHPHFITQRELYEVRERPSKAYSWKAFLIANVVVEVPYQIVTGILMFGAFYYPVIGIQGSARQGLVLLFMIQLMLYASSFAQMTIAALPNALTAASIVTLLVLMSLTFCGVLQPPNELPGFWMFMYRVSPFTYWLGGIVATILAGRPIDCSEDETSTFNPPSGTTCGEYMAEYLKLAPGRLQNPEATQECQYCALVNADQFLANSKIYWGERWRNYGLVWAYVAFNIFIAVLSYYAFRVKKWNLGKKKRA

SEQ ID NO: 26207 - protein, 822 aa, Caulobacter crescentus CB15
MTQATPKLRLVVIGNGMAGCRAVEEVLKRDPDRYAVTIFGAEPRVNYNRIMLSPVLAGEKAFEDIVINDEAWYRDNGITLHAGRAVTAIDLAARKVFAEGGLEIGYDKLILATGSDPFRLPLPGGDLKGVVTFRDLDDVNAMLAASAEPDARAVVIGGGLLGLEAAYGLARRGMAATVVHLMDVLMERQLDESAGYLLREALADRGVETVLGAHSEEIVGADGQVTGLKLKDGRVLPCDLLVMAVGIRPNTTLAKAAGLTVNRGVAVDDAMRTSDPDVFAVGECVEHRGQCYGLVAPIWEMCRALAQALTDGEGAYQGSVLSTRLKVSGVDVFSAGKFAGGEGCEDIVFRDAARGVYKRVVIEDGKVAGAVLFGDAADGGWYFDLMKAGADVAGIRETLIFGQAITEGLSGLDPSAAVAAMPDTQEICGCNGVCKGAITSAITAQGLTTLDDVRAVTKASASCGSCTPLVEQVLKLTLGDGFQAQTGPKPICKCSPKTHGDVRRAIVDQGLKSMPAVMQALEWSTPDGCASCRPALNYYLLCAWPGEYRDDKQSRYINERVHANIQKDGTYSVVPRMWGGMTSPAELRAIADVAEKFAIPAVKVTGGQRIDLLGVKKDDLPAVWADLNAAGMVSGHAYAKGLRTVKTCVGSDWCRFGTQDSTGLGMRLEKFLWGSWAPAKVKLAVSGCPRNCAEATCKDFGVVCVDSGYEIHIGGAAGLHIQGTQVLTRVATEDEAVWVIAAAMQLYREEGWYLERVYKWMDRVGLESIRAQVTDPDQRRALYDRFVYSQRFARIDPWAERVAGRHNEEFTPMSRRMEFVPA

SEQ ID NO: 26208 - protein, 181 aa, Zea mays
  misc_feature (67)..(67): Xaa can be any naturally occurring amino acid
  unsure (1)..(181): unsure at all Xaa locations
MALNLCISPNCKWVSSPASLDSASSLRSSLGSCFGNINIASVSLSTSRSLSLRRSGSVSVRSSLETXGPTVTVGQVTEVNKDTFWPIVKAAGDKTVVLDMYTQWCGPCKVMAPKFQELSEKYLDVVFLKLDCNQENRPLAKELGINVVPTFKILKDNKVVKEVTGAKYDDLVDAIDKVRSS

SEQ ID NO: 26209 - protein, 288 aa, Glycine max
MAAEVYYQAIGTLQSHSYLNNLNHHQKHQNNLVTLVSRDFISSNGLSTRRSNCTGQRNCSVIRSLASQTSVVDPVLSPSRSNASDTYKKSNEAALILIRHGESLWNEKNLFTGCVDVPLSKKGIDEAIEAGKRISSIPVDVIFTSALIRAQMTAMLAMTQHRRGKVPIMMHNESEQARSWSQVFSEDTKKQSIPVIAAWQLNERMYGELQGLNKQETADRYGKEQVHEWRRSYDVPPPNGEGLEMCAERAVAYFRDQVCGSLEFCNLAISLSSFSPFMLFFMVYDYNS

SEQ ID NO: 26210 - protein, 124 aa, Zea mays
MVRVSALNDALNALTNAERRGKRQALIRPSSKVIVKFLTVMQRHGYIGEFEIVDDHRSGKIVVNLLGRLNKTGCISPRFDVSVDGIEQWCNNLLPSRQFGYLVLTTSLGIMDHEEARKKGTGGK

SEQ ID NO: 26211 - protein, 623 aa, Streptomyces collinus
MSGIAGWVDFERDLTPEAPTVRAMAAALAHRGPDGFGEWIEGHAALAHRRLSLIGSEHAGQPAIVESEAGSPVAVLTLDGSVTNAVELRRELAAKGHRFTGDGDAEVALHAYLEWGAAFPERLEGLFALAVWDVRRQELLLVRDRLGVKPLCYFLTPSGVVFGSEPKALLAHPAVRPVVDADGLRELFAHSRKPGTGVFRGTREVLPGHTMTVRAPGTGHRRYWSLPARPHTDSLETTVATVRRLLSEAVATHLRADVPVGAMLSGGIDSSALTALAAHRRRAEGAGLRSFSVNFSGYAENFEPHPTMRATPDAPYAALAAEHIGTEHTEILLDTAALADPGTHAAALRSQDAPSPLGDMDVSLLLFFEALRGAGITAVLSGETADEVFNGYFWAYDPGHSNSTTFPWVSFERGHDAAAGGLGCSLVDRTLRKELDFMDYADQHYRDALTEVPQVAGESPAERRAREVTYLALTRWAPTHLDRADRMSMAHGVQLRPPFCDRALVEYVYNVPAELKRVNGQEKSLLRAAVADLLPERVLNRPKSAYPTVQEAAYGEFVRHRFEDVAADRTAPVAPLLDAEATRVALGAAAAPSGAFAWVERASMEMVLQLNTWLSEYGVELRV

SEQ ID NO: 26212 - protein, 224 aa, Mycobacterium tuberculosis H37Rv
MATHSHPHSHTVPARPRRVRKPGEPLRIGVGGPVGSGKTALVAALCRQLRGELSLAVLTNDIYTTEDADFLRTHAVLPDDRIAAVQTGGCPHTAIRDDITANLDAIDELMAAHDALDLILVESGGDNLTATFSSGLVDAQIFVIDVAGGDKVPRKGGPGVTYSDLLVVNKTDLAALVGADLAVMARDADAVRDGRPTVLQSLTEDPAASDVVAWVRSQLAADGV

SEQ ID NO: 26213 - protein, 631 aa, Gibberella zeae PH-1
METQFPLNRYRAGGGHPSGQRNGIEETLEESFLSHYTQLFNKYAGADGKWRRDQIGLFMHHVQAENPNGLAAYLTDNEELNLHELIKYLTSPCGNILEMAAPQDLSWPLNNYFISSSHNTYLTGNQLSSDSSAEAYKDALLRGCRCIEIDVWDGEEKWKPGFEDDDGDDDGNNREVGAEQKKIGLRQRAFIKFGRWAMNKFDPVDPDGRTFDDRLGDCIHAEPRVLHGFTMTKEVSFRNVCETVREYAFTTSELPLIVSLEVHCSPLQQNTMVDIMKETWSDYLLGEPECDPAHLPSPHELRKKILIKVKYVPEDKTESDASDDGSLLEVVTEGNEKKTKKVKAPKITSRLSRLGIHTRGISFKSLDEPEATMPNHIFSLSEDAASAIQRRLPKALFSHNRRYLMRTYPHGMRVDSSNYDPVLFWRAGVQVVALNWQSWDVGMILNEGMFMGSDGYILKPKGYCHEGHSNDDDVLIPSKTLERLAITVVAAQNLPLLKSTDDPAKFIPYVKIGFHTEPNAFSAMTDEDQSPEKMKQVGYSGQTCKSKGTSPSFNEETIEFLNVQGVVPELSFLSFRVMNDVPGPDVMAAWACVRLDRLRLGYRFLRLLDKDGMPSKGILLMKVTMREVSTS

SEQ ID NO: 26214 - protein, 445 aa, Haloarcula marismortui ATCC 43049
MSKTPPGPKGEPLFGSSRTYARDPFRFISALERAYGDVARFDMGPMDTVMLCDPTAIERVLVSEADRFRKPDFQGDALGDLLGDGLLLSEGETWEQQRKLANPAFSMARLSGMADRITGHAEDRIADWSHGDVIDAEQSMTRVTLDVILDLMMGVELSEQRVQTIEEQLLPLGQRFEPDPIRFAMPQWMPMPDDAEFNRAVRTLDEVLDDIIEVREDSLGTDEDGPMDFLSVLLRARDDGNQSPEQLRDEMMTMLLAGHDTTALTLTYTWFLLSEHPEVEQRVHEELDDVIGDDRPGMEHVRELDYLEWVIQEAMRLYPPVYTIFREPTEDVTLSGYEVEAGTTLMVPQWGVHRSERFYDDPETFDPERWKPERASERPRFAYFPFGGGPRHCIGKHLAMLEAQLITATTASQYRLEFQGETPLELLPSLTAHPRQKMSMRVQER

SEQ ID NO: 26215 - protein, 139 aa, Gloeobacter violaceus PCC 7421
MNAVQELFDQSIQRYEAGEAADVLLPVFREIAEKQPKNGPALTCLAWLYLLNSEAPKALKVAKQATKLAPADAQAYVNLSLAMLETGQKGVREPIERAQQVCQLDPKQAEEVRKNFEEGLKRRPEWKELTKVRNWLFES

SEQ ID NO: 26216 - protein, 355 aa, Metarhizium anisopliae
MSRSNPPNAGGSRKISFNVSEQYDIQDVVGEGAYGVVCSAIHKPSGQKVAIKKITPFDHSMFCLRTLREMKLLRYFNHENIISILDIQKPRGYDTFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPTPEEFFDFDKHKDTLSKEQLKQLIYQEIMR

SEQ ID NO: 26217 - protein, 197 aa, Thermobifida fusca YX
MSRIGRVERATNETKVFVEVNLDGTGAADISTGVGFYDHMLHQIAKHGLFDLTVRTEGDLHIDAHHTMEDTALALGAAFREALGDRSGIRRFADAKVPLDEALAEVTVDISGRPYLVHSEPEGMAPMIGRDYDTTMTRHIFESFVAQARITLHVHVPYGRIPHHIVECQFKAVARALRSACERDPRVTGVPSTKGTL

SEQ ID NO: 26218 - protein, 524 aa, Mycobacterium tuberculosis H37Rv
MSIADTAAKPSTPSPANQPPVRTRAVIIGTGFSGLGMAIALQKQGVDFVILEKADDVGGTWRDNTYPGCACDIPSHLYSFSFEPKADWKHLFSYWDEILGYLKGVTDKYGLRRYIEFNSLVDRGYWDDDECRWHVFTADGREYVAQFLISGAGALHIPSFPEIAGRDEFAGPAFHSAQWDHSIDLTGKRVAIVGTGASAIQIVPEIVGQVAELQLYQRTPPWVVPRTNEELPVSLRRALRTVPGLRALLRLGIYWAQEALAYGMTKRPNTLKIIEAYAKYNIRRSVKDRELRRKLTPRYRIGCKRILNSSTYYPAVADPKTELITDRIDRITHDGIVTADGTGREVFREADVIVYATGFHVTDSYTYVQIKGRHGEDLVDRWNREGIGAHRGITVANMPNLFFLLGPNTGLGHNSVVFMIESQIHYVADAIAKCDRMGVQALAPTREAQDRFNQELQRRLAGSVWNSGGCRSWYLDEHGKNTVLWCGYTWQYWLTTRSVNPAEYRFFGIGNGLSSDRATVAAAN

SEQ ID NO: 26219 - protein, 576 aa, Oryza sativa
  misc_feature (549)..(549): Xaa can be any naturally occurring amino acid
  unsure (1)..(576): unsure at all Xaa locations
MAATSAVTTTTGARWRSWAFANMGTLLAHFGSLSFFLGPLLAAYAPRRLLLTYFNLFLRRRARRLLNAVDPYITVDISECPAAARYYSRYDPVDARDTTYDEAKAYLSATCSSEARELHAEGAEEGDGLVISMRDGQDVADEFGGATMWWSSVAAEQQAAPPPPQGAAERRCLRLTFHMRHRRLVVDEYLPHVRREGREVLFSSRRRRLYTNNKMSEYASYSDEKAWSYVDFDHPTTFETLAMEPAKKKAIMDDLDAFRRSREFYRRTGKPWKRGYLLHGPPGTGKSTMVAAMANYLDYDIYDVELTVVGNNNNLRKLLIETTSKSIIVIEDIDCSLDITGDRAARRSRPPPSYRDGHDRRSSDVTLSGLLNFIDGLWSACGGERIVVFTTNHLDKLDPALIRRGRMDMHIEMSYCGFEAFKTLAKNYLDVDAHHLFDAVEELLRDVNLTPADVAECLMTARRSGSDDTSCLEICVDELKKRAEERAKEEAEAKAREEAEAKAMAEFEEKAKEKALAKAKAVVDAAAAAAAAAATTATAKPNATKEEEXKEEEEEEEEEEEDSQEESSADTGQFTE

SEQ ID NO: 26220 - protein, 471 aa, Oryza sativa (indica cultivar-group)
MGAFLLFVCVLAPFLLVCAVRGRRRQAGSSEAAACGLPLPPGSMGWPYVGETFQLYSSKNPNVFFNKKRNKYGPIFKTHILGCPCVMVSSPEAARFVLVTQAHLFKPTFPASKERMLGPQAIFFQQGDYHAHLRRIVSRAFSPESIRASVPAIEAIALRSLHSWDGQFVNTFQEMKTYALNVALLSIFGEEEMRYIEELKQCYLTLEKGYNSMPVNLPGTLFHKAMKARKRLGAIVAHIISARRERQRGNDLLGSFVDGREALTDAQIADNVIGVIFAARDTTASVLTWMVKFLGDHPAVLKAVTEEQLQIAKEKEASGEPLSWADTRRMKMTSRVIQETMRVASILSFTFREAVEDVEYQGYLIPKGWKVLPLFRNIHHNPDHFPCPEKFDPSRFEVAPKPNTFMPFGNGTHSCPGNELAKLEMLVLFHHLATKYRWSTSKSESGVQFGPFALPLNGLPMSFTRKNTEQE

SEQ ID NO: 26221 - protein, 338 aa, Glycine max
MGKVKIGINGFGRIGRLVARVALQRDDVELVAVNDPFITTDYMTYMFKYDSVHGHWKHHDVTVKDEKTLLFGDKAVTVFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFIGDSRSSIFDAKAGIALNKNFVKLVSWYDNEWGYSSRVIDLLVFVAKKSL

SEQ ID NO: 26222 - protein, 375 aa, Phytophthora megasperma
MEDDIQAVVIDNGSGMCKAGFAGDDAPRAVFPSIVGMPKHLGIMVGMNQKDAYIGDEAQAKRGVLTLRYPIEHGIVTNWDDMEKIWSHTFYNELRVAPEEHPVLLTEAPLNPKANRERMTQIMFETFNVPAMYVNIQAVLSLYASGRTTGCVLDSGDGVSHTVPIYEGYALPHAIVRLDLAGRDLTDYMMKILTERGYSFTTTAEREIVRDIKEKLTYVAMNFDEEMEKAARSSTLDKSYELPDGNVIVIGNERFRTPEVLFKPSMIGRECTGVHECAFQTIMKCDVDIRRDLYNNVVLSGGSTMFPGIGDRMTKEMTKLAPTAMKVKIITPPERKYSVWIGGSILASLATFQHMWISKTDYDESGPSIVHRKCF

SEQ ID NO: 26223 - protein, 368 aa, Zea mays
RKEIYYEPEEVKAAIVTCGGLCPGLNDVIRQIVFTLETYGVKNIVGIPFGYRGFFEKGLKEMPLSRDVVENINLSGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMHASLSSGQIDVCLIPEVSFTLDGEHGVLRHLEHLLNTKGFCVVCVAEGAGQDLLQKSNATDASGNVILSDFGVHMQARGKKHFKDIGVPADLKYIDPTYMVRACRANASDAILCTVLGQNAVHGAFAGFSGITSGVCNTHYVYLPITEVITTPKHVNPNSRMWHRCLTSTGQPDFH

SEQ ID NO: 26224 - protein, 251 aa, Triticum aestivum
MATQTMKAVNYQGPYKVTVEDVELPKLEHPDDVIVKVTTAAICGSDLHMYEGRTAAQPGITFGHENMGIVEQLGEGVTLLKKGDRVVMPFNVADGRCRNCEEGKTAFCTGVNPGFAGGAYGYVAMGPYRGGQAQYIRVPYADFNALKLPAGKEHEADFILLADIFPTGWHGVEISGFRSGESVAVFGAGPVGLMAAYSAVLRGASRVFVVDRVPERLQAAEKIGCTPIDFSQGDAVDLIIRPMGELIDLPM

SEQ ID NO: 26225 - protein, 892 aa, Caulobacter crescentus CB15
MADGSAALTATRTACPYCGVGCGVIGATAAGARAVAISGDEAHPANHGRLCSKGTALGATVSLAGRLLEPTIQGRSASWDEATALVARRFRETIARHGPDSVAFYVSGQLLTEDYYVANKLMKGFIGSGNIDTNSRLCMASAVVAHKQAFGADLVPGCYEDLDLANLVVFSGHNAAWTHPVLFRRMEAAKARGQKHVVIDPRRTDTAEGADLHLALAPQSDVRLWNGLLADLIRRGAVDMDFLRDHVDGYAAVITSLAEDDQSPAAVAADCGLALADLQTFFDLFAAHPRTVSLFSMGANQSAQGVAKGLAIINAHLATGRIGKPGACPFSITGQPNAMGGRETGGMANTLAGHMDFSPEERDRVARFWGAPNTARAPGLKAIDMFEAVRDGRIKALWVMATNPAVSLPASGAVREALERCPFVVVSDCVETDTTAFADVKLPALAWGEKDGTVTNSERRISRQRTLFPPPGQARADWRIIAEVARAMGFDGFGWPHAASVFREWARLTAYENKGRLLNLEGLTRLDPQAYDALEPVQWPVDTEGRGRARLFEDGRFQTANGRARLVPVRPRGPAEATSDKFPMALNTGRIRDQWHTMTRTGLAPDLCRHAPEPYVEVHPDDARAVGLTEGALARVMTTRAEAVAVAKLSDRQRRGSLFMPMHWTDAFAPAGRANALVAPMTDPSSGQPEFKHTPARIGAYRETWRGFFLAREPALIVDPGLVWRRIPRDACHQHEFAGRGDRAQRATLRKRLVRALTGEIVAYEDAATGALREAWIRDDRLVAVLYMTEAGRLPPRDWLADLFAAPLTPETRATLLHGFPPGAPVDKGPMVCACLKVGGKAIEAAIIGGASTADAVGAATGAGTNCGSCRPEISRMIRAFTDAKQETADVL

SEQ ID NO: 26226 - protein, 375 aa, Thermomyces lanuginosus
MEEEVAALVIDNGSGMCKAGFAGDDAPRAVFPSIVGRPRHHGIMIGMGQKDSYVGDEAQSKRGVLSLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHTVPIYEGFALTHAISRIDIAGRDLTDYLMKILAERGYSFTTTAEREIVRDIKEKLCYVAFDFEQELQTAAQSSTLEKSYELPDGQVITIGNERFRAPEALFNPAVLGHESGGIHETTFNSIIKCDVDVRKDLYGNIVMSGGTTMYPGIADRMQKELTALAPSSMKIKIIAPPERKYSVWIGGSILASLSTFQQMWVSKQEYDESGPSIVHRKCF

SEQ ID NO: 26227 - protein, 344 aa, Glycine max
MGASSDPTQDGSDEQQKRSEIYTYEAPWHIYAMNWSVRRDKKYRLAIASLLEQYPNRVEIVQLDDSNGEIRSDPSLSFEHPYPPTKAIFIPDKDCHRPDLLATSSDFLRVWHISESAVELKSLLNGNKNSEYCGPLTSFDWNEAEPRRIGTSSIDTTCTIWDIEKETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHQASVNAIAWAPHSSCHICTAGDDSQALIWDLSSMGQPVEGGLDPILAYTAGAEIEQLQWSSSQPDWVAIAFSTKLQILRV

SEQ ID NO: 26228 - protein, 996 aa, Nostoc sp. PCC 7120
MVLQVQTSTYEAKTQEIARQLLGATQENRSFFASLRDQMRWDDKLLAWAMSNPGLRVQLFRFIDTLPALHSKAEIAAHLQEYLGDESVELPAALKGMLNFANPDSVPGQVAATTVSTAVETLAHKYISGENIKQVIKTVERLRKEKMAFTIDLLGEAVITETEAQSYLERYLELIAQLTEASKNWGTIAAIDEADGEQLAKVQVSVKLTAFYSQFDPLDAKGSEEKVSDRIRILLRRAKELGAAIHFDMEQYAYKDLTLNILQKILLEDEFRQRTDIGITIQAYLRDSEQDARNAIAWLKQRGYPLTIRLVKGAYWDQETIKAAQKHWPQPVFNDKAATDANFEAITQLLLENHQYVYSAIGSHNVRSQALAMAIAETLNVPRRRFEMQVLYGMGDKLAKALVDRGYRVRVYCPYGDLLPGMAYLIRRLLENTANSSFLRQNLENRPVEELLAAPKVDLAQAKVHSPEAFPQGKHFVGAADTDYAEEEDRTKAARAFAVVRGELGKTYLPLINGEYVQTAEVIDSVNPSNFSEVIGKVGLISVEQAEQAMQAAKAAFPGWRRTSVKERAGILRRAGDLMEQRRAELSAWIVLEVGKPVKEADGEVSEAIDFCRYYADEMERLHQGINYDVDGETNRYIYQPRGIVVVISPWNFPLAIACGMTVAALVTGNCTLLKPAETSSVITAKLTEILVEAGIPKGVFQYVPGKGSQVGAYLVSHPDTHLIAFTGSQEVGCRIYAEAATLKPQQRHMKRVIAEMGGKNAIIVDESADLDQAVVGVVQSAFGYSGQKCSACSRVVVVEAIYDAFIHRVVEATKSLNIGEAELPSTQVGPVIDANARDRIREYIEKGKAESQVALELSAPNHGYFVGPVIFGEVPPHGTIAQQEIFGPVLAVIKAKDFAQALAIANDTDYALTGGLYSRTPSHIQQAQEEFEVGNLYINRNITGAIVARQPFGGFKLSGVGSKAGGPDYLLQFLEPRTITENIQRQGFAPIEGAE

SEQ ID NO: 26229 - protein, 377 aa, Volvox carteri
MAEEGEVSALVCDNGSGMVKAGFAGDDAPRAVFPSIVGRPRHTGVMVGMGQKDSYVGDEAQSKRGILTLRYPIEHGIVTNWDDMEKIWHHTFFNELRVAPEEHPVLLTEAPLNPKANREKMTQIMFETFNVPAMYVAIQAVLSLYASGRTTGIVLDSGDGVTHTVPIYEGYALPHAILRLDLAGRDLTDYLMKILMERGYSFTTTAEREIVRDIKEKLCYVALDFEQEMATAASSSALEKTYELPDGQPITIGNERFRCPEVLYNPSLIGMEAVGIHDTTFNSIMKCDVDIRKDLYNNIVLSGGTTMFPGIADRMTKEITALAPSAMKIKVVAPPERKYSVWIGGSILASLSTFQQMWIAKSEYDESGPSIVHRKCF

SEQ ID NO: 26230 - protein, 141 aa, marine gamma proteobacterium HTCC2080
MATERTLSIIKPDAVGKNVIGEIYTRFESAGLRIVASRMMQLSDTTAGGFYAEHKGRPFYDDLVKFMTSGPVVVQVLEGEGAIAKNRDLMGATNPQEAAAGTIRADFATTIDANAVHGSDSPESAAREIAYFFAANEVCER

SEQ ID NO: 26231 - protein, 463 aa, Mycobacterium tuberculosis H37Rv
MSPQQEPTAQPPRRHRVVIIGSGFGGLNAAKKLKRADVDIKLIARTTHHLFQPLLYQVATGIISEGEIAPPTRVVLRKQRNVQVLLGNVTHIDLAGQCVVSELLGHTYQTPYDSLIVAAGAGQSYFGNDHFAEFAPGMKSIDDALELRGRILSAFEQAERSSDPERRAKLLTFTVVGAGPTGVEMAGQIAELAEHTLKGAFRHIDSTKARVILLDAAPAVLPPMGAKLGQRAAARLQKLGVEIQLGAMVTDVDRNGITVKDSDGTVRRIESACKVWSAGVSASRLGRDLAEQSRVELDRAGRVQVLPDLSIPGYPNVFVVGDMAAVEGVPGVAQGAIQGAKYVASTIKAELAGANPAEREPFQYFDKGSMATVSRFSAVAKIGPVEFSGFIAWLIWLVLHLAYLIGFKTKITTLLSWTVTFLSTRRGQLTITDQQAFARTRLEQLAELAAEAQGSAASAKVAS

SEQ ID NO: 26232 - protein, 470 aa, Gibberella zeae PH-1
MAPSTIADFQDVPCHQAYTPIKPIHREGALMHRSLVQHPYMVESAQGIELKLSTGQTIIDGCGGAAVALIGHGREEVIHAITEQARKVSYVHTQSYTTAPAEELANVLLQGNPYGLEKAFFVGSGSEAVESALKLARQYHYEKGGLEKVHIISRRQCYHGNTMATMSISTNIARRAPYHGFLYPNVSHVSPAFAYHYKDSSESEDQFTARLLVELEEEFLRVGPQKVAAFIAETVVGATSGCVAAPAGYFQGVRALCDKYDVVMILDEIMCGIGRTGTFFAFEQEGVVPDITTVAKGLGGGYAAIAGVLIHKRVVDVLRQGSAAFNHGHTYQAHPISCAAALAVQRIVRRDNLVERCAEMGLVLEKMLKEDLSGCRSVGDIRGRGLFWGVEFVKDRQSKQPFDPAAKFGLLVQQLAFEKGVALYPGGATIDGVKGDHILLAPPFTVTEGSGGGGKNSLLGLTTAHKNMTI

SEQ ID NO: 26233 - protein, 361 aa, Synechococcus sp. WH 8102
MGQDLAVDTAPIGSAAAGPHAERLSNLVTAKRATVDRETGLELFRDMTLGRRFEDKCAEMYYRGKMFGFVHLYNGQEAVSTGVIGAMKRQHDWFCSTYRDHVHALSAGVPAREVMSELFGKETGCSKGRGGSMHLFSKEHHLLGGFAFIAEGIPVALGSAFTSRYKRDALGDASSNAVTAAFFGDGTCNNGQFFECMNMAQLWKLPILFVVENNKWAIGMAHDRATSDPEIWRKAASFGMAGEEVDGMDVLAVRAAAQRAVERARAGEGPTLLECLTYRFRGHSLADPDELRAEQEKQFWAQRDPLKALERDLCEANLVSSDELRSIEKEIDAIVQDCVEFALSAPEPDPTELTRYIWAED

SEQ ID NO: 26234 - protein, 382 aa, Ehrlichia canis str. Jake
MSKSDYYELLGVSKNATSEEIKKAYRKMALKYHPDTNPGNKEAEEKFKELSEAYDVLIDQDKRAAYDKYGHNAFDGAAGRGGFDFNSGFSGDFSDIFNDLFGGGFGSRGGRGSSRRSEGAAGSDLRFDVEITLEDSFNGKKVPISYVTYVKCSSCSGSGSEGSAKSVQCNTCHGAGSVRTQQGFFTIERTCHVCNGEGEIIQNKCKKCSGSGRVRDEVNLLVTIPKGIESGNKIRLNGKGEAGYRGARSGDLYVYSNIQKHKFFTRSGPDLYCTVPIKMTLAALGGHIEMPSIDGTWTKVKVPEGSQSGDKLRLKEKGMPVINSSKRGDMYIQITVETPVKLTKKQKELLQKFDDEPNVDCNPQSTGFFQKVKSFWKDIRSN

SEQ ID NO: 26235 - protein, 208 aa, Synechococcus sp. WH 8102
MRDILISSTVCVLCLLLALVSQLVAPSTVDAAAVDAAAATSTAATASVVAKTTSAVAARPSFELDPEDPNPTLFAMAPDTNQADASALGGPLDAPDTQITASGLKIIELQVGEGAEAASGQTVSVHYRGTLENGKQFDASYDRGTPFTFPLGAGRVIKGWDEGVDGMKVGGKRKLVIPPDLAYGSRGAGGVIPPNATLVFEVELLDAK

SEQ ID NO: 26236 - protein, 430 aa, Enterococcus faecalis V583
MLFGTAKMNRENHLEIGGCDTVKLAQKFGTPLFVYDVAHIRAQARGFKQTLNQLGIKNKVVYASKAFSCLAIYQVLKEEDIACDVVSGGELFTALKGGMEPAEIEFHGNNKTPEELRYALDNKIGTIVIDNFYEIDLLEELLATRNQTQKVLFRVSPGVDAETHDYILTGQEDSKFGFDVASGQATEALVRLLSNPSFDVQGVHCHIGSQIFAVEGFLAAVEKMFTILEDWRQVHQFTARVLNMGGGFGVQYTQQDEPLAPATFVEKIVYSLKGHCEQLGYPLPELWIEPGRSLIAEAGTTIYTVGAQKEVPGVRHFVSVDGGMGDNIRPALYQAVYDGFLANRDGHDSVKEVTVVGKYCESGDVLLRDILLPEVKAGDLLAISSTGAYGYSMASNYNRNPRPAVVFVEDGQAKLVARRETYEDMTTLDC

SEQ ID NO: 26237 - protein, 116 aa, Thermobifida fusca YX
MSGSPPQLDPEIAARLKRTPDGLVPAIVQQYDTGEVLMLAWMDDEALRRTLTTRAATYWSRSRGEYWVKGATSGNTQRVVSVSLDCDGDTLLVKVDQTGGACHTGDRTCFDADRLL

SEQ ID NO: 26238 - protein, 134 aa, Glycine max
MTGTGSPCGACKFLRRKCVRGCVFAPYFCQEQGATHFAAIHKVFGASNVSKLLAHLPVSDRCEAAVTISYEAQARLQDPIYGCVSHIFALQQQVVNLQAQLAYLKEQAAQSCLNGTINENPNEKLLEKSSAALP

SEQ ID NO: 26239 - protein, 469 aa, Azoarcus sp. EbN1
MNAQEVMKMIQENEVRFVDLRFTDTRGKEHHVGLPVSAFEEDHFEHGHPFDGSSLAGWKGIQASDMILLPEAGSAYIDPFFDETTVVLTCDVIEPSDGKGYDRDPRSIAKRAEAYLKSTGVGDTAFFGPEPEFFIFDSVEWSVDMSGVYSKIISEEAAWSTADKFEGGNTGHRPRIKGGYFPVPPVDSLNDIRAAMVLALEACGVPVEVHHHEVANAGQCEIGTKFSTLTKRADWTQVLKYIVHNVAHQYGKTATFMPKPIVGDNGSGMHVHQSIWKDGQNLFAGNGYAGLSEMALYYIGGIIKHARALNAITNPGTNSYKRLVPHYEAPTKLAYSARNRSASIRIPYVANPKGRRIEARFPDPLANPYLAFSALMMAGLDGIQNKIHPGDPADKNLYDLPPEEDAKIPTVCTSLDQALEYLDNDREFLTRGGVFSNDFIDAYLALKGEEVDRMRITTHPVEFDMYYSL

SEQ ID NO: 26240 - protein, 492 aa, Mycobacterium tuberculosis H37Rv
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFDQLEIKTILHRLLRRYRLELSRPDYQPRWDYSAMPIPMDGMPIVLRPR

SEQ ID NO: 26241 - protein, 220 aa, Helicobacter pylori
SLSLDYSKNRLNDTTLKLLFELANDCSLKEKIEAMFKGEKINTTEKRAVLHTALRSLNDTEILLDNMEVLKSVRSVLKRMRAFSDSVRSGKRLGYTNQVITDIVNIGIGGSDLGALMVCTALKRYAHPRLKMHFVSNVDGTQILDVLEKLSPASTLFIVASKTFSTQETLTNALTARKWFVERSGDEKHIAKHFVAVSTNKEAVQQFGIDEHNMFEFWDF

SEQ ID NO: 26242 - protein, 392 aa, Prochlorococcus marinus str. MIT 9301
MSQVNLSDRALSIEPSLTLQISAKANQLSAEGVDICNLSAGEPDFDAPKEVIEATSKAIFDGFTKYGPAAGNLDLRKAIANKLQIQNDLNYEFENVMVTNGAKQAIYNLFQVLLNTGDEVIIPSPYWLSYPQMVRLAGGKPIFTNSSAEDGFKINIEDLKSKISSKTKFIIINSPNNPTGRVMSKEELLQIADLARENPNINILSDEIYELILKKEFKHYSLSSLANDLKNRIFIINGFAKGWAMTGWRIGYLVGPKDVIKASSALQSQSTSNVCSFVQKGALEALKINNEFFSMINSHYDQRRRILYEGLNNINGIYIEEPNGAFYAFPKLPNSSITSVDFCNKALQDYGLVVVPGKAFGADQCIRISCAASEIKIKDGLQRIEKAISEYY

SEQ ID NO: 26243 - protein, 587 aa, Debaryomyces hansenii CBS767
MSKSQLFISLQSSQKLDTSSMTQSVVSEPRRLVLNKIIGGFKFEKVEDRPTPSEVYNWRVYGTALLASSAAIIIGYDGGFIGGTVALPSFKSEFGLDKMSESEAGDIISNVISVFHAGCFFGALISYPFSFYLGRRLSLIISATAITIGSAIMLAALSKNGLGPIYAGRVIAGLAVGFSTNLTPVYLSEISPPAIRGRVIALYEIGWRVGDLVGFWINYGIDSHMGPSKTQWFIPFAVQLIPSGIFFAGSVIMKESPRWLYSVGKHDQAIKNLKWFRNLPEDDEYMVYEVNQVKESIESQKLHIGLKLWDPFKQVFFKDHKILFRLLITCSLFLFQNFLGIQSINYYSPIIFANLGVKGTNATLFSTGMFGVVKFVCTFIYILFIVDTFGRRKAFMVSSTVCSICFWYIGAYLKVNDPSQPGVQAGPGGTAAIVMMYFWIASFILAWSGGPFVVGSEVFDQNIRSFVQAINAAISWIPIFIMSRFTTKMIDKMEYGIYFFFASLAALSVPFVFFCVPETKGIALEDMDKIFDRSLPARKAHKVVLGQVRANAISQLEGHRGLYKMDTNKSNEIQNIEDLELMVKNEK

SEQ ID NO: 26244 - protein, 578 aa, Ostreococcus tauri
  misc_feature (537)..(543): Xaa can be any naturally occurring amino acid
  unsure (1)..(578): unsure at all Xaa locations
MSGDAHAHAHAHADGNDDVEFGASHAHDGLKPHRHERLYGPGSFAKRRKGSTVRGQTFADRAYTVGIGGPVGTGKTALALALCRALRDAYDVTCVTNDIFTKEDGEFLIANDALGDANRIRAVETGGCPHAAIREDISSNLNAVEELTAAYPNCDLCLMESGGDNLAANYSRELADYIVYVIDVCGGDKIPRKGGPGVTQADLLVVNKCELADAVGASLDVMERDAKIQREDGPVVMAQVKKGVGVREIARHILADWSERTGRAEKPFNPHPPRRAPRPRVVIARPPIATTRWRRVFPCASMHRAFAGDPAARRACAIAALDVTRAAGTSTVTRCYAEYPVKILTPKRGIDSACDCAWAYAVNMGGGLVSGDASGATIRVDDECALAMATQGTQKVYKHDTRRWNDDVKTREGDDAWKVGETTSALYASVGQGGLLALLPDPTQVFADAVFRQTQTIDMHENGSCVCVDWITAGRIGYGNERWAFERADVRTRVTVNGEPVVVEATRLEASSRVSLNSDVSLGMRMGAANVFASLIXXXXXXXFFAADTESVQDVLRSLLAPLASQLGAPPYDERGGS

SEQ ID NO: 26245 - protein, 327 aa, Haloarcula marismortui ATCC 43049
MSTTARPMPVTERAPESVTVQRDIPFHEVDGETLTLDLYDAAAASGPKPVAVLVRGGAFTSGDKGEFARHALDLAADGFLVIEPQYRLAPEWTFPAALVDVKAAIEWARTEGESYGADTSRVVGVGHSAGANLIVLAALTADEPGFEPELYPGASSALSAAVGYAGVYDFHALDTATDVPAGEGHRAYLGGGPDDEPAAYDLASPVGQVNTDAPPTLLLHGSEDDVVPPSQSELLADALGPMTDVVHETVPSDHGFPFHGAQYDDVYERTVEFIRRIGTDSPDTDGPRGAGDDTGLPGGDLSGPTDRISDLGSGDVHGSDRRDGPGF

SEQ ID NO: 26246 - protein, 222 aa, Synechococcus sp. WH 8102
MLISILTGFAAGAVHVVGGADHLVAMAPFSLRKPMPALRAGFAWGAGHSAGVVILALISIGLKDLVHVETMSSWAEFLVGVALLVVGALAVRTAFGLELHSHEHHHEGDQPHQHLHLHVRGQSNHRRHAHAASGLGLLHGLAGASHLLAVIPALALPPVAAFGYLMAYLCGSIAAMVAVVAVVSFLTLRSGARLLPWLVGGTGALSIVTGAIWLQKTSAAIF

SEQ ID NO: 26247 - protein, 484 aa, Zea mays
MANIRALLVGLSRARGSLAEAGRCASTRPSILASLGAHYKIPMPARWFSSTGLPPHLVVGMPALSPTMNQGNIAKWRKQEGDKIEVGDVICEIETDKATLEFESLEEGYLAKILAPEGSKDVQVGQPIAVTVEDVEDIKSIPADTSFGGEQKEEQSTESAPQNKVVNVSEQSSTVSRISPAAKLLIKEHGLDTSSLRASGPRGTLLKGDVLAALKSGINSSSTKEKKSPAQPSSQPTRDSQSQASSISQKDDTYEDIPNSQIRKVIAKRLLESKQTTPHLYLSKDVVLDPLLAFRNELKELHGIKVSVNDIIIKAVAIALRNVPEANAYWNNDKEETQKCDSVDISIAVATEKGLMTPIIRNADQKTISAISAEVKQLAEKARAGKLAPNEFQGGTFSISNLGMYPVDHFCAIINPPQSGILAVGRGNKVVEPVVDSDGTEKAAAVTKMSLTLSADHRVFDGQVGGKFFTELALNFSDIRRLLL

SEQ ID NO: 26248 - protein, 470 aa, Zea mays
MEFTESFKQTGPCSFSPDSRFLAIAVDYRLVVRDVLSLKVVQLFSCVDKISSVEWAPDSEYILCGLYKRPMVQAWSLSQPDWTCKIDEGPAGIAYARWSPDSRHILTTSEFQLRLTVWSLVNTACVHVQWPKHGSKGVSFTKDGKFAAICTRRDCKDYINLLSCHSWEIMTVFAIDTVDLAGVEWSPYDSAIVVWDSLLEYKVLIYSPDGRCLFKYLAYESGLGVKTVAWSPCGQFLAVGSYDQAVRTLNHLTWKTFAEFSHAGYIRSPCNAAIYKEVDDPWQLDMSELCLSEGLSRNMPDNGAENGTEGGGSRVKYAVMDVPITLPSLKPAFDKPNPKQGIGMLSWSSDSHYFFTRNDNMPTVLWIWDICRLELAAVLVQKDPIRAAAWDPTCTRLVLCTESPHLYMWTPSGACCVNIPFLNFRIVDLKWSSNGSCLLLKERESFCCATIISALPEEEPDHSDDTSEDE

SEQ ID NO: 26249 - protein, 348 aa, Debaryomyces hansenii CBS767
MLLLVSFATKRGFSTGCNTARSTISKRTFGFSSSWSQGSSHQGGSASAAANNFAAASANLMPYNITVAYQPKDREESNLFKSKNHKPSPAQKSPTGEDNLFVSEKSKDGYIALGVADGVGGWSEAGYDSSAISRELCASMKTIFEQQKEHADLTPKGLLADAFKEIQDSPKVEIGGTTACLGILTPDYKLKVANLGDSWCGLFRGYKLINETNFQTHNFNTPYQLAKIPFQIVRQAELEGRRYIIDTPDRADEYSWDLQKDDIIMFATDGVTDNVIPNDIELFLKDKLEQQPKVDLADISQSFVEEVVKVSKDVNFPSAFAQELSRLTGQKYLGGKEDDITVVLVKVT

SEQ ID NO: 26250 - protein, 420 aa, Synechococcus sp. WH 8102
MVDAADSKSAGHWSWGFKSPGSHPEAVMNTYNRFPLTLVRGRGCWVWDDQGRRHLDAVAGIATDTLGHSDRALRRSLGRQLRRLQHVSNLYRIPEQDALATWLVQHSCADSVFFCNSGAEANEAAIKLARKHGHLKRGIDRPRILTASASFHGRTLAAVSATGQPRYHQGFEPMVEGFDYFPYNDIHAFESLLERHEANGPAVAAVLLEPLQGEGGVHPGDAGFFQRLRHLCSERNILLILDEVQVGMGRSGRLWGYEQLGIEPDAFTLAKGLGGGHAIGALLVNAKADVFEPGDHASTFGGNPFACTAGLTVAQEIQRRGLLRNVEERGQQLQQGIQGLVARYPQLLQGVRGWGLLQGLVLHQDCGVTAPQLAKAAIEQRLLLVAAGATVLRMVPPLVISANEVRQLLRRLDATLAELV

SEQ ID NO: 26251 - protein, 404 aa, Zea mays
MTFLFPAKNQQGTMEGRPSAPARVSMFRRLMVRVTPAERLAGDGKEREKDERPPASGAGAEAEVGSVGLDKMVLSFMEDSAAAAERPPRGRCSSCFNGNNQDGSDDEDFDFLPSASAPAAAPAAAGDALELLKGLVQCASTPERNLLADASRIAERCGSGSGSGSGRKKADVRRAVADGLRALGYDAAVCTSRWDRTPSHPAGEHEYIDAVVEPGAGAGAGAAARVRVVVEVDFRSEFEVARPTKAYRAALQALPPLFVGSPERLGRVVGVVADAARQSLRKRGLHFPPWRKREYMRAKWLSPHARSSSSSADRTPAPATPVSAAAFSGEFELRFDEKEKPKAADYGGGIPGGEDDGAGKEVTVVVSPTPTPWRAEELGAASKLSPQAKRKVVTRLASLLPLAS

SEQ ID NO: 26252 - protein, 445 aa, Zea mays
MATRSLTSALPLSRTPRVPSHRPSLRRLQTLTRALTSSSPQAMASSPTPKKVLVPIANGTEPMEAVITIDVLRRAGADVAVASVEPGATSVAASWGIKLTADALLADLADDEFDLISLPGGMPGSSTFGECKVLEKMVKKHVEKGKLYAAICAAPAMTLGTWGLLNGLKATCYPSFIDKLPSEVHAVESRVQIDGKCMTSRGPGTAMEYSVILVEQLYGKEKAKEVAGPMEDLNITFQVMRPQHGVEFSMKEVNSTSWNVGETPNILVPIANGTEEMEATMIIDILRRAKANVVVASLEDKLEIVASRKVKMIADVLLDDALKEQYDLILLPGGLGGAEAYAKSDKLMDLIKKQAEANRLYGAICASPAIALEPHGLLKGKKVTSYPAMWNKLADQSECNNRVIVDGNLITSQGPGTSMEFSLAIVEKLFGRERALELAKSMVFI

SEQ ID NO: 26253 - protein, 425 aa, Brevibacterium linens
MSITQNGISTRSVHSGANPESHTGSVVAPIFQTSTFMMDTPGQTRAGFDYARTGTPNRSDLEDVLCELENASFAAAVNSGTSAEVAVFSALLGPGDEIIIPRDIYGGTYRLLKNEYERWGISIRTVDLTDTEALAAAISAKTAIVWVETPSNPGLDIVDIAETAKLAHAANAILAVDSTFATPILQRPIELGADVVIHSTTKFINGHSDVIGGAVLAGDGSTCPRAAKVVERLESYLASVGLGIAPFDAWLTRRGIKTLPVRMAKHCENAQAVAQWLESRPEIAEVYYPGLPSHPGHEVAKKQMSGFGGVVSFRTDTEARALSLVKSTKLITLAESLGGVESLIDHPATMTHLAVADCELSVSPTFIRLSLGIEDIADILADLDAALASTVQTPDGVSSDAEALGAEVPIADPSPSTLQHPVATV

SEQ ID NO: 26254 - protein, 256 aa, Brassica oleracea var. botrytis
MGRGKVELKRIENKINRQVTFAKRRNGLLKKAYELSVLCDAEIALLIFSNRGKLYEFCSNPSGMAKMVEKYRKHSYATMDPNQSAKDLQERYQDYLNLKSRVEVLQHSQRHLLGEEIAGIGVDELEQLECQVDTSLRQIRSTKARSMLDQLSDLKSKEEMLLETNRDLKRKLEESDAALNQTLWGASSSAEHSQQQQEGMTSYHANPLSQEVGFFRPLQGNVALQMSHYNPGVPNASNSATTSQNVINGFFPGWMV

SEQ ID NO: 26255 - protein, 184 aa, Brassica napus
MGYWKSKIVPTMKKLFERSPANKDVVAEASKTPAFDDSKEAINKEIEDKKTELEPKVLDIYEATSAELKALVREPKEDGLTKHSAEVNKFLEALVEIGFPGSKDACELSSTSSGPVTFIFEKVCVFLPVEEKSREVENVEEVAKTEEPSKEEDTKPAKEDEIITTAEKEKETVEEKKEEVLPAV

SEQ ID NO: 26256 - protein, 239 aa, Oryza sativa (japonica cultivar-group)
MSKLCQSACKAAKSLLSATAAASSPRTSLLAEGRNAALATLTNLGRKTLPTAYAYSYHHNSSAAAAGWLAAIPAAVYMLQDQEAHAAEMERTFIAIKPDGVQRGLISEILSRFERKGFKLVAIKLVVPSKEFAQKHYHDLKDRPFFNGLCDFLSSGPVLAMVWEGEGVIKYGRKLIGATDPQKSEPGTIRGDLAVVVGRNIIHGSDGPETAKAEIGLWFEPRELVSYTSNEEKWIYGVN

SEQ ID NO: 26257 - protein, 742 aa, Oryza sativa (indica cultivar-group)
MNTMLQLGVSLLLLAAKHTIATAAVPSPQCQSRCGDVDIQYPFGIGANCSLAELFNVECKVQHGISKPFIGNVEVLNISLSRSTLRVLNGISTFCYNASGLMGGVHFRFNAKNTPFRFSDVYNKFTVIGCNTLAYIADDGGTGYQSGCFSQCRDLSGLVDGSCSGMGCCQTTIPRGMYYYNVTFDKRFNTSQISRFGRCSYAVLMEAASFNFSTTYINTTKFNGTNGGRVPMVIDWAIREKSCDIAKQNMTSYACLSSNSECVASTNGPGYVCNCSHGYEGNPYLPDPHGCHDVNECDRNPWPCPSGGVCHNTEGGYRCSCRKGRKFSKSSNTCIPDIGLIIGVIIGFIVLMIIAFCGQLVIQRRKLTKIKKEYFRQHGGMILFESMKSKKGLAFTVFTEAELIHATNNFDKSRIIGQGGHGTVYKGTVKDNMLVAIKRCALVDERQKKEFGQEMLILSQINHKNIIKLLGCCLEVEVPMLVYEFVPNGTLFELIHGKNQGLQISFSTLLRIAHEAAEGLHFLHSYASPPILHGDVKTANILLDENYMAKVTDFGASILAPSDKEQFVTMVQGTCGYLDPEYMQTCQLTDKSDVYSFGVILLEILTGQVPLKLEGPAIQRSLSSVFLSAMKGNNLDSVLVSDIKGQESMELIGGLAELAKQCLDMCGANRPSMKEITDELGRLRKLSLHPWVQVDAEMETENLLGGPSTINSGLEIETSSTGYLGEERENLPMNPGSTYYAR

SEQ ID NO: 26258 - protein, 151 aa, Prochlorococcus marinus str. MIT 9211
MVAERTFLAIKPDGVQRGLVGEILSRFERKGFKLIALKQLIPSRALAEQHYGVHRERPFFKGLVDFITSGPVIAMIWEGEGVILGARKLIGSTKPLDADPGTIRGDLAIDIGRNVIHGSDGPETASFEIGLWFESSELSDWNPSDQLWRVE

SEQ ID NO: 26259 - protein, 410 aa, Zea mays
MARHFKYVILGGGVAAGYAAREFAKQGVNPGELAIISKEPVAPYERPALSKGYLFPQNAARLPGFHTCVGSGGERLLPEWYSEKAAETFTYETLLIATGSSVIKLTDFGVQGAESNNILYLRDIADADKLVAAMQAKKGGKAVIVGGGYIGLELSAALKINNFDVTMVYPEPWCMPRLFTAGIAHFYEGYYANKGIKVVKGTVAVGFDADANGDVTTVKLKNGSVLEADIVIVGVGGRPLTRLFIGQAADEKGGLKTDAFFETSVAGVYAIGDVATFPLKLYNEQRRVEHVDHARKSAEQAVRAIKAKESGESVAEYDYLPYFYSRSFDLAWQFYGDNVGDDVLFGDNDPASAKPKFGSYWVKDGKVVGVFLEGGSAEENQAIARVARAQPPVADVQALKQEGIDFASKI

SEQ ID NO: 26260 - protein, 533 aa, Haloarcula marismortui ATCC 43049
MKREMLTTDFIDRAADIYDDVTGIVAHDGTEYTYAEVNERVNQLAHALSDRGVSKGSRVALLAPNTHYFIETLYATNKLGAVFVPLNYRLDPAKIEYILNDCEAATVIADYDFAEKVQPVRDDIPAETFIGYEPDRIDGEWEAYSGILDGQPTAEPDRPEMAEDDDASINYTSGTTGDPKGVVRTHRTESWHSLVLNQHMEIRDDDTYLWTLPMFHCNGWGHTYAITGTGGTHVCQRTFDAADTFRRVREYDVSFMCGAPTVLNKLIQHYRANDGDVVTQGDRDVRIATAGSAPATATIERVEDEFGWRIIHIYGLTETAPIITTSNSPRRIAERGRELKVKQGSETLCTDIRIVDEDGTDVPRDGATIGEVVVQGNQVMDRYLNKPEITEEAFNDRAEGYFHTGDLAAWDEDGMIQIMDRRKDIIISGGENISSIELEDELYDHPGVLKAAVIPTPSEDWGETPMAIVVPTADSDATEQDILEFLRERVASYKVPAGIDFRDSLPETATGKIQKYELREEYWQEQERMIGQE

SEQ ID NO: 26261 - protein, 74 aa, Triticum aestivum
  misc_feature (47)..(47): Xaa can be any naturally occurring amino acid
  misc_feature (59)..(59): Xaa can be any naturally occurring amino acid
  unsure (1)..(74): unsure at all Xaa locations
MAPAVMASSATTVAPFQGLKSTAGLPVSRRSGSAGLSSVSNGGRIQXMQVWPIEGIKKXFETLSYLPTPLYGGL

SEQ ID NO: 26262 - protein, 514 aa, Ipomoea batatas
MGNRTSRHKHGEKHRSEAGSHQTHIEYTKSPGQGAGLPVRPPSIPKSVSKSDAILGKAYEDVRAHYSLGKELGRGQFGVTYLCTEIRTGKQYACKSISKKKLVTKGDKDDMRREVQIMQHLSGQPNIVEFKGAYEDANSVYLVMELCAGGELFDRIIAKGHYSERAAASLCRSIVNVVHTCHFMGVMHRDLKPENFLLSDKTENAALKATDFGLSVFIEEGRVYKDLVGSAYYVAPEVLGRKYGKEADVWSAGVMLYILLSGVPPFWAETERGIFNAILKGELDFQTKPWPSISSIAKDLVRGMLAPDPKRRLTAAQVLEHPWMREDGEASDRPLDSAVLSRMKQFRAMNKLKKLALKFIAENLSEEEIHGLKAMFTNIDTDNSGTITYEELKKGLAQLGANLTEAEVKQLMEAADVDGNGSIDYIEFITATMHKHRLEREENLYKAFQYFDKDSSGFITRDELETAMKEHGIADAATIKEIISEVDADHDGRINYEEFCTMMRSGTKQQAKLF

SEQ ID NO: 26263 - protein, 173 aa, Zea mays
MMLANKLGGLLKNATSSKSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFRSSGGGYGGGGYGGGYGGGSGGYGGGGSGDYGGGSGGYGGNYGNRAGGAMGVWWNM

SEQ ID NO: 26264 - protein, 396 aa, Arabidopsis thaliana
MEAVLLCSKLVPRAASLEGNQKFSFRHLNKHLKCNSLRADSRDTPLLRGFEAIKSPSIWSCAPFPVRKGSWVPPRCSISSSTVSDSDNPFLSQFRTFSFGSMVKKVRELKVKPMDVVKLTLLLSILTVAAKKTLTLVLDPFFWMYFSWTWLFWPWFIAVGLAGYGIYYFRKHWLGEANAFEQLGIVTSVFTWLTLVPPAYFNGYLEGWPYVFFLAYHYFFFFNVSVRKRLYGDYYARTHDPKWDVNTPLWSRILFGVGIMVGHWLAAFEGPELHRLPGGWANVGIWILIVITMLMHYDSTLYLARYSEKVVVPTAVVQFGPYRWVRHPIYASTMLLFAAYCTALRAPLSLLFLLAVCLVYYNKKAKMEEELMVESFGQSYSDYADKVRHKFIPFVY

SEQ ID NO: 26265 - protein, 154 aa, Haloarcula marismortui ATCC 43049
MSEHERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEAELVDWDQIDSSWLYE

SEQ ID NO: 26266 - protein, 331 aa, Cicer arietinum
MSNKIWPPPPSNNPYEYLKIHHNPNDTLTRNLVDPHTSPSSNTTLPINVLTKDLTINQSHQTWLRLFLPKNSTNPNQNNKLPLIIFFHGGGFILLSAASTIFHDFCVELADTVEAVVASVEYRLAPEHRLPAAYDDAMEALTFIKSSEDEWLQNYVDFSTCYLMGNSAGATIAYNAGPMCNLKKVNDFEPLKIQGLILSQPFFGGTQRSESELRLENDPVLPLSVGDLMWELALPIGVDRDHKYGNLTAENDLDEKFDKIKDQGWRVLVSGNGGDPLVDRYKELVELMEKKGVEIVKDFEEEGFHGIEFFEPSKAKKLIGLVKGFISSFVV

SEQ ID NO: 26267 - protein, 217 aa, Fulvimarina pelagi HTCC2506
MTDQNGRGSNPKLFGQPWVFVRGVPAMKFLPPEGPPEVAFAGRSNVGKSSLINALLGQKGLARTSNTPGRTQELNFFVPDGFGGETTELPPIAIVDMPGYGYAQAPKEKVDAWTELVFDYLRGRPTLKRVFVLIDARHGIKANDEEVLKLLDKAAMSYQIVLTKIDKIKPTGVPKLIAATEEAIRKRPAAYPGILATSSEKRSGLDELQAALGMLAE

SEQ ID NO: 26268 - protein, 254 aa, Symbiobacterium thermophilum IAM 14863
MQLFSLEGRVALVTGAGRGIGRALALGLADAGADVVCLARTGSEVEAAAEEVRARGRRALAVTADVTSQAQVTEAVEAALDRFGKIDILVNNAGINIRKPALEVAEADWDRVVQTNLKGPFLVAQTVGRHMCERGYGRIINVASVGGAVALRTGVAYGASKAGLMHMTRILAMEWARYGVTVNGIGPWYFRTPLTEKLLQDEQYVAEILARTPMRRIGDLAELVGPVVFLASDASSYVTGQVLMVDGGMSVYGF

SEQ ID NO: 26269 - protein, 1059 aa, Leuconostoc mesenteroides subsp. mesenteroides ATCC 8293
MPKRQDISKILVIGSGPIVIGQAAEFDYSGTQAALSLKEEGYHVILVNSNPATIMTDAEIADKVYIEPLSIDFIERILRKERPDAILPTLGGQTGLNMAKDLSEAGILDELNIELLGTKLSAIEEAEDREEFKALMERLNEPIPESIIATTLEESLNFADTHGYPVIVRPAYTLGGTGGGIAQTHEELSEITANGLELSPVTQVLIERSIAGYKEIEFEVMRDANDNALVVASMENFDPVGIHTGDSIVTAPVQTLSDREVQMMRDAALKIIRALKIEGGVNIQMALDPDSYKYYIIEVNPRVSRSSALASKATGYPIAKMAAKIAVGLTLDEIINPVTGTTKAEFEPALDYVVFKIPRWPFDKFSTADRRLGTQMKATGEVMAIGRNMEEAMLKAVRSLEIGAIGLDDITYKDLSDDELLAALMPARDDRLFMIADLLRRGVSIETIHDKTLINEFFLDKVLHVIEIEQDLASHVGDIDQLQYAKKNGFADETIAKIWGKTAADIRTLRKDKKIKPVYKMVDTVAAEFESATPYYYATYEQENESIISTKKSVLVLGSGPIRIGQGVEFDYATVHAVKAIQRAGYEAIIMNSNPETVSTDFSISDKLYFEPLTLEDVLNVIDLENPVGVVVQFGGQTAINLAQPLLDNGVNILGTSVEDLNRAEDREAFDQVIKELALPQPVGKTATTVDCALAAAQSIGYPVLIRPSYVLGGRAMEIVSSDDELQDYMQRAVKVSNDHPVLIDSYLVGQEAEVDVLSDGETAVIPGIMEHIERAGVHSGDSMSVYPPQYLSQKVQDEMVQASINLAKAMNTIGLMNVQFVIHENTAYVIEVNPRASRTVPFISKVTHLPLAQLATRVMLGEKLSEMGFETGLVPNDDMVHVKAPIFSFTKLPDVDSLLGPEMKSTGEVMGSDINLSKALYKAFIASNIKVPRYGNVLFTVADDDKEEALELAKRFNDLGFALFATAGTGAYLSDNDLPVEVLDKISESDNNAVAALRQQKVQVVINTTQADDRAESDGRLIRNAAIENAVPLFTALDTVSAFLEVLESRSFTVKEMH

SEQ ID NO: 26270 - protein, 506 aa, Hordeum vulgare subsp. vulgare
MAFFLLLCILVSVAIVSYAHHAIRRRRQGCAHGRHEQAALKLPPGSMGLPYVGETLQLYSQDPSVFLSSKQKRYGEIFKTHLLGCPCVMLASPEAARFVLVSRAHLFKPTYPRSKERLIGPSALFFHQGDYHLRLRRLVQGPLGPEALRKLVPDIEAAVRSTLAAWADGDVASTFHAMKRLSFDVGIVTIFGGRLDERRKEELRRNYAVVEKGYNSFPNSFPGTLYYKAIQARRRLNGVLSDVVHERRERGEHGDDLLGCLMRSRAGGDDADDEGALLTDEQVADNVIGVLFAAQDTTASVLTWIVKYLHDRPKLLEAVRAEHAAIHEANDGGRRPLTWAQTRSMTLTHRVILESLRMASIISFTFREAVADVEYKGFLIPKGWKVMPLFRNIHHSPDYFQDPHKFDPSRFKVAPRPNTFTPFGSGVHACPGNELAKLEMLVLIHHLVTGYRWEVVGSSDDVEYSPFPVPRHGLLARVRRDDGVCAGRKGCPTDEDDNYDDDEVIV

SEQ ID NO: 26271 - protein, 555 aa, Cichorium intybus
MTSLTDVCSLNCCRSWSSLPPPVSGGSLTSKNPRYLITYSPAHRKCNRWRFRCSIAKDSPITPPISNEFNSQPLLDCVIVGAGISGLCIAQALATKHASVSPDVIVTEARDRVGGNISTVERDGYLWEEGPNSFQPSDAMLTMVVDSGLKDDLVLGDPTAPRFVLWGGDLKPVPSKPADLPFFDLMSFPGKLRAGFGALGFRPSPPDREESVEEFVRRNLGDEVFERLIEPFCSGVYAGDPSKLSMKAAFGKVWNLEQNGGSIVGGAFKAIQDRKNSQKPPRDPRLPKPKGQTVGSFRKGQAMLPNAISTRLGSRVKLCWKLTSISKLENRGYNLTYETPQGFESLQTKTIVMTVPSYVASDLLRPLSLGAADALSKFYYPPVAAVSISYPKDAIRADRLIDGQLKGFGQLHPRSQGVETLGTIYSSSLFPNRAPPGRVLLLNYIGGATNPEILSKTEGEIVDAVDRDLRTMLIRRDAEDPLTLGVRVWPRAIPQFLIGHYDILDSAKAALSSGGFQGMFLGGNYVSGVALGKCVEAAYDVAAEVMNFLSQGVYK

SEQ ID NO: 26272 - protein, 548 aa, Prochlorococcus marinus str. MIT 9211
MKFCLDVFSSLTLCRFLFDMSSDSLLKSQRSPSIVILDFGSQYSELIARRIRETEVYSIVLSYSTSAAELRKLAPKGIILSGGPSSVYTASAPLSDPEIWDLDIPVLGVCYGMQVMVQQLGGHVTAAVGKAEYGKAPLHVDDPTALLTNVESGSTMWMSHGDSVDKLPRGFVRLAHTSNTLEAAIALHTKRFYGVQFHPEVVHSTQGMVMIRNFVYNICCCQPDWTTSTFIDEAISTVRSQVGDKKVLLALSGGVDSSTLAFLLKRAIGDQLTCMFIDQGFMRKGEPEFLMEFFDQKFKINVQYINARERFISKLQGISDPEDKRKVIGREFIRVFEEESERLGPFDYLAQGTLYPDVIESSGTNLDPKTGERIAVKIKSHHNVGGLPKDLQFKLVEPLRMLFKDEVRKVGRALGLPEEIVGRHPFPGPGLAIRILGEVTDEKLNCLRDADLIVREEINRAGLYHEIWQAFAVLLPVCSVGVMGDQRTYAWPIVVRCVSSEDGMTADWSRLPDSLLQIISNRVVNEVKGVNRVVLDITSKPPGTIEWE

SEQ ID NO: 26273 - protein, 394 aa, Ehrlichia canis str. Jake
MLRSHDFTFCNMKKIQDFSCSGKTVLLRADLNVPMDNGVVLDDTRIVRLTTTIKYLLSNDAKIVIMSHYGRPKSYDKEFSLKFLIEYLNKIFTTNVIFIDGVIGDYVEQTIQSASLGSILLLENLRFYAEEETNDLAFAKQLALLADIYVNDAFSCLHRKHASIDAITRLIPSFIGFNFQEEMKYLNCVVSNSEKPVAVIVGGSKISTKIHMLKNLTKKVDFLIVGGAIANNFLLSQGLKIGRSLYEELEKDLVKEIMDLAKRHECKIIVPVDYVVAKNSIYGKSSIKDNDTIESDDVILDIGPQTINIVTATVNKCRTILWNGPCGMFEKEQFSKGTFSVANLLAKLTKAGKLKSIVGGGDSICAIKLSGLSNDDFTYISTGGGALLHFLSIA

SEQ ID NO: 26274 - protein, 377 aa, Zea mays
  misc_feature (131)..(131): Xaa can be any naturally occurring amino acid
  misc_feature (157)..(157): Xaa can be any naturally occurring amino acid
  misc_feature (180)..(180): Xaa can be any naturally occurring amino acid
  unsure (1)..(377): unsure at all Xaa locations
MEVETPAQAQGTTHVAGTTRTLRNPLLVVNFVLMVVGSAGGPLFLRAYFLHGGARKWLSALLQTAGFPLLLVPLCVSFSRRRRRRPRRPDDGAPAMAPFFLMTPRLLAASAAIGLMTGLDDLLYAYGLAYXLAVSTSSILISTQLAFTAAFALLLVXRKRFTAFSVNARGRCSAPGAAMXLGMNAGGDRPAGVSPAQYGAGFAMTLGAAALYGLLLHAMELSQAQARAGTAAAVTYTLVIEMQLVIGLTATVFSAVGMLANHDLHAIPGEAREFDLGRSGYYLLLAGSAATYQCFFLGTIGAVFFGSALLAGVVMTVLIPVTEVLAVVFFHEPFNGTKGVALALSLWGFVSYFYGEVQTSKAHHLPDKPTNVERLDP

SEQ ID NO: 26275 - protein, 386 aa, Zea mays
  misc_feature (191)..(191): Xaa can be any naturally occurring amino acid
  misc_feature (239)..(239): Xaa can be any naturally occurring amino acid
  misc_feature (289)..(289): Xaa can be any naturally occurring amino acid
  misc_feature (295)..(295): Xaa can be any naturally occurring amino acid
  misc_feature (307)..(307): Xaa can be any naturally occurring amino acid
  unsure (1)..(386): unsure at all Xaa locations
EMRTCGVPPAASSFNILLSCLGRARRVKEAYRILYLMREGKAGCSPDWVSYYLVVRVLYLTRRILRGKRLVDAMLESGVLPTAKFFHGLIGILCGTEEVDHALGMFKLMKRCELVDARIYDLLIEKLCRIGRFEIGRELWDEATNSGLVLGCSQDLLDPLKTEVFRPICPAQRLSPQNYKRLAWKKKVTAXWSQKGHCYLSLKEEVGSVGSSCITKARRLGVPTPVLYAVDPLLHTLTXYVDGLSVKDILLGFGSDGVNEERLDDISITQIGNVVGKLHDGGLVHGDLXTVTINXVVLIDFGLSFIXIIPEGEDKAVDLYVLERALISMHSSRGDVVRRLHKLASKLSFADYMHTLIPLFGDFILGRPMTYTGYGYISSQQYWIHQ

SEQ ID NO: 26276 - protein, 524 aa, Oryza sativa
MALKSPVDFAGSITSGQKDPCCFGVPGCNPRCVRYNKKSRTCRLVTRAISVDRPQLDFSDSDWKKQFQEDFDRRFSLPHLKDVIDVEPRPTTFSLKSRTPLENVNGSMQGSWNGYVNDDDRALLKVIKFASPTSAGADCIDPDCSWVEQWVHRAGPRKQIYFEPQYVKAGIVTCGGLCPGLNDVIRQIVLTLEKYGVKNIAGIQHGFRGFFEDHLAEVPLNRQVVQNINLAGGSFLGVSRGGANISDIVDSIQARRLDMLFVLGGNGTHAGANLIHEECRKRKLKVSIVGVPKTIDNDILLMDKTFGFDTAVEAAQRAINSAYIEAHSAFHGIGLVKLMGRSSGFITMHASLSSGQVDICLIPEVPFTLDGPNGVLQHLEHLIETKGFALICVAEGAGQEHLQQSNATDASGNMILGDIGVHLHQKIKAHFKEIGVHSDVKYIDPTYMVRAVRANASDAILCTVLGQNAVHGAFAGFSGITTGICNTHNVYLPISEVIKSTRFVDPNSRMWHRCLTSTGQPDFH

SEQ ID NO: 26277 - protein, 250 aa, Schizosaccharomyces pombe
MARKFFVGGNFKMNGSLESMKTIIEGLNTTKLNVGDVETVIFPQNMYLITTRQQVKKDIGVGAQNVFDKKNGAYTGENSAQSLIDAAITYTLTGHSERRTIFKESDEFVADKTKFALEQGLTVVACIGETLADREANETITVVVRQLNAIADKVQNWSKIVIAYEPVWAIGTGKTGTPEEAQEVHAEIRKWATNKLGASVAEGLRVIYGGSVTGGNCKEFLKFHDIDGFLVGGASLKPEFPTNIVNVHSL

SEQ ID NO: 26278 - protein, 521 aa, Zea mays
MATAMMTMRRAAALGARHIPPAAAFSRHMSADASAAMEKIRAAGLLKTQGLIAGQWVDAYDGKTIEVQNPATGEVLANVSFMGSRETSDAIASAHSTFYSWSKLTASERGKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSELTPLTSLAAADLALQAGIPAGALNVVMGNAPEIGDALLQSTQVRKITFTGSTAVGKKLMAESANTVKKVSLELGGNAPCIVFDDADIDVAVKGSLAAKFRNSGQTCVCANRILVQEGIYEKFASAFIKAVQSLKVGNGLEESTSQGPLINEAAVQKVEKFINDATSKGANVMLGGRRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGVDEYLELKYICMGNLG

SEQ ID NO: 26279 - protein, 169 aa, Oryza sativa (japonica cultivar-group)
MAANGSNVVSRGAVRFTEEQEALVLKSWAIMKNDSAHIGHRFFLKIFEVAPSARQLFSFLRNSDVPLEKNPKLKIHAMAVFVMTCEAAAQLRKTGRVTVRDTTIKRLGSTHFKNGVSDAHFEVAKFALLETIKEAVPASMWSPAMKGAWGEAYDHLVAAIKQGMKPAAA

SEQ ID NO: 26280 - protein, 265 aa, Ralstonia metallidurans CH34
MRPQKIFITGASSGIGQALARAYAEQGAILGLVGRREDALRAFAGTLPNPGAVRVYAVDVRDVDAMGVAAADFLANVGCPDVVIANAGVSVGTVASEREDLEVFRTVMDTNWFGTLTTFQPFLGPMREQPPGADGWRGTLVGIASVAGVRGLPGGGAYSASKSAVIKLLESLRLEQAREKIRVVTIAPGYIRTPMTSHNPYRMPFLMDAEVFAQKAVRRIAAGSRFAVIPWQMGVVASLLHLMPRWLYDALFARAPRKPRRPRDA

SEQ ID NO: 26281 - protein, 362 aa, Synechocystis sp. PCC 6803
MSQTYNVTLLPGDGIGPEIMAVAVAVLGKVADQFGFAFNFQEALIGGAAIDATGQPLPEATLAQAKDSDAVLLAAIGGYAWDNLPRSQRPETGLLAIREGLGLFANLRPATIFPQLIDASSLKREVVEGVDIMVVRELTGGIYFGKPKGIFETETGEKRGVNTMAYTVGEIDRIAKVAFETARKRRGQLCSVDKANVLDVSQLWRDRVMAIAVDYPDVELSHLYVDNAAMQLVRSPRQFDTIVTGNLFGDILSDIAAMLTGSIGMLPSASLGSDGPGLFEPVHGSAPDIAGQDKANPLAQVLSAAMMLRYGLDQPQAADRLEDAVKKVLEQGYRTGDILSPGTQLVGCRQMGEQLLSILDEM

SEQ ID NO: 26282 - protein, 344 aa, Synechococcus elongatus PCC 7942
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREAYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 26283 - protein, 395 aa, Porphyromonas gingivalis W83
METTQLSPLRKSIVGVQFLFVAFGATVLVPLLVGLDPSTALFTAGIGTLIFHLVTKGKVPIFLGSSFAFIAPIIKATEMYGLPGALSGMVGVALVYYLMSALVKWQGVRVIQRLFPPVVIGPVIILIGLSLAGAGVDMAQSNWILATISLATAVLVTMLAKGLFKLIPIFCGIVVGYVIAVVFYEVDLNPVREAAWLSLPQFSFPKFSLPPILFMLPVAIAPVIEHIGDVYVVNTVTGKDFVKDPGLHRTLLGDGLACMVAGLLGGPPVTTYSEVTGAMALTRVTDPMVIRIAAVTGIVFSAVGKVSALLKSIPPAVLGGIMLLLFGTIASAGIANLVNHKVDMSRTRNIIIVSITLTLGIGGAVVSFGGFTMAGIGLAAIVGVVLNLILPQEQE

SEQ ID NO: 26284 - protein, 507 aa, Arabidopsis thaliana; identical to SEQ ID NO: 1155

SEQ ID NO: 26285 - protein, 618 aa, Wolinella succinogenes DSM 1740
MCGIVGYSQNHPQAIQEMLQSIRHRGPDDLGIYCDEGFSLGHTRLSILDLSHAGHQPMEFEHLVIVFNGEVYNFRAIQKELLGLGYTFFSDSDTEVILKAMHCWGEKAVDKFIGMFAFALWDKRKEELLLYRDRVGVKPLYYYFEGGELLFASELRAITAIKPNLALSQAGLYEYFQFGYISSNLSIHQAIHKLPAGHYLRFKAGKIEVKPYWSIHTFLEMPPFEKSEEELIDELEELLVDAFKLRMVADVPVGVFLSGGIDSSLVAAILQKHHGHIHTFTIGFENPRYNEALYAKGVAEHLGTEHTERILSAEEAREILYRFPEVYDEPFGDSSGIPTLLVSKVAKESGVKVVLSADGGDEIFCGYERYPIAHSLSRKILSLPYPLRAFAGRAMESFGAKRAGYLFKVRNLEHKFNQLSEMLRAKDLEEFYELLVHNSKNYEIKELLGETFPPKSRAFKVGERIHPMQGMMSWDYERYMVDDILVKVDRATMFHSIEGREPLLDHRIAEFAARLPFNMKFREGKTKYILRKVLERYLPKEMIERPKMGFGIPMFEWFSQDLRSLFETHFTPERLKSSGVLNPSYVLRELGKLQRGEPVNVNKLWLILVFLMWQEKAR

SEQ ID NO: 26286 - protein, 202 aa, Triticum aestivum
  misc_feature (101)..(101): Xaa can be any naturally occurring amino acid
  misc_feature (162)..(162): Xaa can be any naturally occurring amino acid
  unsure (1)..(202): unsure at all Xaa locations
VDFQNKFVQKSRLLPVRNSRDIVDPRVRPRPAHRAPPGPDPRPPAATMATAKAAGDEPALGIPYNPAQAQGSYYYPPDPYAAGRVPPNAIYAGAPKGVPLXHTMFRDTPAPFHCQSCGDAGVTSVRSKPSVASVVACMMPFFLSVCFLCPSMDCLWNKQHYXPSCGKNGGLSFKKERSRALWCGTQPSLGPKSKAFGRCPGF

SEQ ID NO: 26287 - protein, 332 aa, Escherichia coli
  misc_feature (1)..(1): Xaa can be any naturally occurring amino acid
  misc_feature (85)..(85): Xaa can be any naturally occurring amino acid
  misc_feature (97)..(97): Xaa can be any naturally occurring amino acid
  misc_feature (117)..(117): Xaa can be any naturally occurring amino acid
  misc_feature (121)..(121): Xaa can be any naturally occurring amino acid
  misc_feature (252)..(252): Xaa can be any naturally occurring amino acid
  unsure (1)..(332): unsure at all Xaa locations
XGSSHHHHHHGSTKYALVGDVGGTNARLALCDIASGEISQAKTYSGLDYPSLEAVIRVYLEEHKVEVKDGCIAIACPITGDWVAXTNHTWAFSIAEXKKNLGFSHLEIINDFTAVSXAIPXLKKEHLIQFGGAEPVEGKPIAVYGAGTGLGVAHLVHVDKRWVSLPGEGGHVDFAPNSEEEAIILEILRAEIGHVSAERVLSGPGLVNLYRAIVKADNRLPENLKPKDITERALADSCTDCRRALSLFCVIXGRFGGNLALNLGTFGGVFIAGGIVPRFLEFFKASGFRAAFEDKGRFKEYVHDIPVYLIVHDNPGLLGSGAHLRQTLGHIL

SEQ ID NO: 26288 - protein, 359 aa, Triticum aestivum
  misc_feature (139)..(139): Xaa can be any naturally occurring amino acid
  misc_feature (147)..(147): Xaa can be any naturally occurring amino acid
  misc_feature (204)..(204): Xaa can be any naturally occurring amino acid
  unsure (1)..(359): unsure at all Xaa locations
MAKFGEGDARWIVQERADGANVHNWHWAERDCLDWSRALLSKLLAGLPVLSGEGGLTLRTTTLDKLDGEAYVNIRKGKVIPGYELSLTLAWEADATTESGVVKVTGTAEVPYLADENADEDPELRITVRGDDGPLARRXAKDAFIAXGKPLVITKIRDYVAAMANGGPAKDEIDSKKISTKAAPAAGGAAVAPAPYIEGNSSAXQAPAAKEKKANGKDKEGFKTIEMTEKFNCRSKDIYEILMDDNRWKGFTQSNARISKDVGGQFSLFDGSITGVNEELQEGKLIVQKWRFGSWADGVHSTVRLVFDEPESGVTTIKLKQTDVPEEDRYGNSTVVENTERGWKELIFQRIRAVFGFGV

SEQ ID NO: 26289 - protein, 965 aa, Pseudomonas fluorescens Pf-5
MITLFDPATDIDLNAVDFGTPARDSQVQVSLNIDGRSISVPQGTSVMRAAALMGTTIPKLCATDSLEAFGSCRMCLVEIDGMRGYPASCTTPVSEGMVVHTQTPKLATLRRNVMELYISDHPLDCLTCSANGNCELQTVAGQVGLREVRYGYDGANHLDDQKDTSNPYFDYDPSKCIVCNRCVRACEETQGTFALTISGRGFESRVAAAGGDNFLDSECVSCGACVQACPTATLMEKSVVQMGQPERAVITTCAYCGVGCSFRAEMKGDQLVRMVPDKNGQANHGHSCVKGRFAWGYATHPDRITKPMIRKHISDPWQEVSWDEAVSYAASELRRIQFKYGRDSIGGITSSRCTNEETYLVQKLVRAAFGNNNVDTCARVCHSPTGYGLKQTLGESAGTQSFDSVMQADVILVMGANPSDAHPVFGSQLKRRLREGAKLIVIDPRRIDLVDSVHARAELHLALRPGTNVAMLNALAHVIVTEGLVDQEFVSARCEPEAFALWSAFVSRADNSPEVLGAICGVPAADIRAAARLYATGGNAAIYYGLGVTEHSQGSTSVMGIANLAMATGNIGREGVGVNPLRGQNNVQGSCDMGSFPHELPGYRHISNQAVRQQFEQAWNVTLQADPGLRIPNMFEAALGGSFKGLYCQGEDIAQSDPNTQHVTAALSAMECVVVQDIFLNETAKFAHVFLPGSSFLEKDGTFTNAERRISRVRKVMEPLGGKADWEGTLALAAALGYPMHYSHPSEIMDEIARLTPTFTGVSYASLDRHGSLQWPCNDAAPDGTPTMHIDEFVRGKGRFMLTGYVPTDEKVNGRYPLLLTTGRILSQYNVGAQTRRTDNVAWHAEDRLEIHPTDAESRGINEGDWVGIGSRAGQTVLRARVTERVAPGVVYTTFHFPESGANVITTDNSDWATNCPEYKVTAVEVSRVYHPSEWQKRYQAFSEEQHRLLDKRGRSRGGKAEVRR

SEQ ID NO: 26290 - protein, 340 aa, Prochlorococcus marinus str. MIT 9211
MTLRVAINGFGRIGRNFMRCWLSRGSNTGLEVVGVNVTSDPKTNAHLLRYDSILGELKDTEIGYTDDNFIINGKEIKCFSDRNPLNLPWKDWGVDLVIESTGVFNTYEGASKHLAIGAKKVILTAPGKGDGVGTFVVGVNADQYNHSDFNVLSNASCTTNCLAPVVKVLDQTFGINKGLMTTIHSYTGDQRILDNSHRDLRRARAAAMNIVPTSTGAAKAVALVYPEMKGKLTGIAMRVPTPNVSAVDIVFEAGCSITAEDINAAMKTASEGSMKGIIKYGDLPLVSSDYAGTNESSIIDTDLTMAIGNNMGKVVAWYDNEWGYSQRVVDLAEIVAKNWK

SEQ ID NO: 26291 - protein, 223 aa, Ralstonia metallidurans CH34
MSDAIAQLFRNNREWVDRVNAEDPTFFTRLANQQAPEYLWIGCSDSRVPANQILGLAPGEVFVHRNIANVISHSDLNALSVLQFAVDVLKVRHVTVVGHYGCGGVKVALKRERVGLADNWLRHVQDVADKHAGYLGTVLREDDAHTRLCELNVIEQVNNVCQTTVLQDAWARGQAVTVHGWVYGVSDGLLRDLGMAASNNDELHAQIAAALRQYGDPPQASIR

SEQ ID NO: 26292 - protein, 259 aa, Synechococcus sp. CC9605
MQSKSQPEQITKTVVGVTTVFIGGIALISSVFVVPAGEVGVVTTLGKVSKTPREPGLNLKLPFIQATHNFSVRTQVIPEKFSTLTKDLQVIEATATVKYAVKPGEAPRIYSTIATDDSAIYARVIQPSLLKSLKSVFSKYELDTIATDWNNISTLVQESVSNELSKFDYVAVKGLDITGLKIAEEYRAAIEQKQIAQQQLLRAKTEVQIAEQEALKFQTLTRSLNDSVLYKLFLDKWDGKTKVVPPIRGGSTPPVIVGQ

SEQ ID NO: 26293 - protein, 379 aa, Hordeum vulgare
MATAGKVIKCKAAVAWEAGKPLTMEEVEVAPPQAMEVRVKILFTSLCHTDVYFWEAKGQIPMFPRIFGHEAGGIVESVGEGVTDVAPGDHVLPVFTGECKECPHCKSAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNAVRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINTAFDLMAKGEGIRCIIRMDN

SEQ ID NO: 26294 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGYSTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 26295 - protein, 355 aa, Streptomyces fradiae
MKALVLAGGSGTRLRPFSYSMPKQLIPIANTPVLVHVLRNLRELGVTEAGVIVGNRGPEISAVLGDGAEFGMRVTYIPQDAPRGLAHTVAITRDFLCDDDFVMYLGDNMLPDGVVDMRGGIHRPSAGGQVVVYKVPDPRSFGVAELGPQGEVLRLVEKPRDPRSDMALVGVYFFTAAIHDAVAAIEPSARGELEITDAIQWLVSSGADVRASQYDGYWKDTGNVEDVLECNRHLLDGLGARMDGTVDAASVLTGEVVIEPGAKVVRSRIMGAAIIGAGTVVQDSHVGPHASIGRRCTVTDSRVENSIALDEASVTGVRGLRNSLIGRSASVGGTGQENERYRLVVGDHTRVEVAA

SEQ ID NO: 26296 - protein, 377 aa, Prochlorococcus marinus str. MIT 9211
MADFYDLLGVSRDADADSLKRAYRRLARQYHPDINKEPGAEERFKEIGRAYEVLGDPQKRATYDQFGEAGLGGSAGMPDMGDMGGFADLFETFFSGFGGASSSGARSQRRGPQQGDDLRYDLTVDFQQAVFGQETEIKIPHLETCDTCNGSGAKPGTGPTACSTCGGAGQVRRATRTPFGSFTQVAECPACNGSGQLIANPCSSCGGQGVKQIRKKLRINIPPGVDTGTKLRVSGEGNAGLRGGPSGDLYVFLKVKSHPKLRRDGLTIHSEVNVSYLQAILGDTIEVDTVDGPTNIEIPIGTQPNAVLTLDNKGIPKLGNPVARGNHCILVKINLPTRLTEDEKTLLEQLATYHSAKGVQHHHHKSGLFGKLFSNNE

SEQ ID NO: 26297 - protein, 534 aa, Frankia sp. EAN1pec
MNESPRASYGSTGAHPGYDPVLVIDFGAQYAQLIARRVRECHVYSEIVPWDMPVAEILARRPAALILSGGPKSVYSPGAPRVDPALFAAGVPVLGICYGHQVMAQALDGTVARTGTAEYGATRLRVDDPGVLFDGLPTSQQVWMSHGDSVTAAPPGFRVTASTPSTPVAAFEDPTRRLYGVQFHPEVVHSERGMDVLRHFLLVGAGCRPSWTMINIVEEAVTAVRAQVGNGRLICGLSGGVDSAVAAALVQRAVGDTLTCVFVDHGLLRAGEAEQVERDFVASTGVDLVHVKAADRFASALAGVTDPEQKRKIIGREFIRVFEESARELDARAEAEGTHIGFLVQGTLYPDVIESGSPTAAKIKSHHNVGGLPDDLQFDLVEPLRTLFKDEVRRLGEELGLPEDIVWRQPFPGPGLAVRIIGEVTPERLEIVRAADAVVRDEIRRAGLDREIWQVFAVLLADVRSVGVQGDERTYGFPVVLRAVTSEDAMTADWARLPYDLLERISNRVVNEVGQVNRVVYDITSKPPGTIEWE

SEQ ID NO: 26298 - protein, 341 aa, Ashbya gossypii ATCC 10895
MVLFKRTKTVSDGDWDVKNLIAVRKPIIEPAPGCVPRAEEPLTAEEEQKYKEVLQHFQLPELQLPTTEKHATEARVLSMEEKAWLTRECMIRYLRASKWVVRDAINRITMSIGWRREFGISCFGEENGDSLLAATVSDENETGKEVVLGYDREARPILYLKPGRQNTKTSHRQVQHLVFMLERVIDMMPSGQHQLALLIDFSDHEDVPKVSGNSKTPPISVGKEVLHILQTHYPERLGKALLTNIPWLAWTFLKMIHPFIDPLTREKLVFDQPFVNFVPEEQLDKLYGGLLDFTYVHEQYWPSLLQRTRENRAHYMARFRELGGHIGLSEYALRAHGDKST

SEQ ID NO: 26299 - protein, 387 aa, Debaryomyces hansenii CBS767
MVSDGEFTRTQIFGTVFEITNRYTDLNPVGMGAFGLVCSAIDKLTGQNVAVKKIMKPFLTSVLAKRTYRELKLLKHLRHENLITLDDIFLSPLEDIYFVTELQGTDLHRLLTSRPLEKQFIQYFTYQILRGLKYVHSAGVIHRDLKPSNILINENCDLKICDFGLARIQDPQMTGYVSTRYYRAPEIMLTWQKYDTEVDLWSVGCILSEMIEGKPLFPGKDHVHQFSIITELLGSPPPDVIETICSENTLRFVQSLPHRDPIPFSERFAQCSHVEPEAIDLLAKMLIFDPKKRISALDALSHPYMEPYHDPTDEPVCEVKFDWSFNDADLPVDTWRVMMYSEILDFHQIIGAGANGTTQEQMAQIQQEGIQAPSSQYQQTNQEQKVE

SEQ ID NO: 26300 - protein, 325 aa, Ehrlichia canis str. Jake
MTNEFNNTLLQLKSLIQQDLDAMEILISQHSDKHIALITEIIHHLIKSGGKRIRPIIFFIICKMLNCTNENKILIAAAIEFIHNATLLHDDVIDESDLRRGKKTSNFIWGNKASILVGDFLLAISFQWLIECKNLNILSILSQTSNTIVVGEIQQMLSSHNINISKEKYIEIISAKTASLFGATCESAAHLAQVNLQESKALKSFGNNFGIAFQIMDDILDYTASNAQFGKKLGNDLSTGKTTLPVIIAYQNATPEEKKFWDQISVNQNLEQAISYIKSHNAIEKSLEIATAYIDQAKACLTIFSESNYKMCLNKLLDCILYRGY

SEQ ID NO: 26301 - protein, 490 aa, Ehrlichia canis str. Jake
MLQKHKKLDILSVFKLGNLIMFLSTEDTLNYIKKNAINFIDLRFTDSNGRWHHITRSAETTDAQVLLTGINFDSSSISGWQSIEKSDMILLPDISTAFVDPFSAQSTLVIICNIVDPYNQSQYAKDPRYTAQKAYEYMLSTGIADKCYFGPEVEFFVFDNVQFYTGMYDSYFKIESAEHDISYQRREFSNNNHRPRVKGGYMPTPPIDSLHDIRSEMLTMFKEVGITPLIHHHEVAASQCEVGFQYDELLASADNVQKCKYIVHGVTSSYGKTATFMPKPVIKDNGSGMHCHQSLWKDNVNLFVNSDGNISDTCLYYIGGIIKYGKAINAFTNPSTNSYKRLVPHFEAPTWLTYSYENRSAAIRIPYVPQNDVNAKRIEVRFPDPLANPYLCFSAQLMAGLYGIQNKIHPGPAIDKNLYSLNKAELQQLSSVANSLEDSLESLDKDREFLLAGNVFTNDQIDSYINLKTLEVKDLQLHPHPIEFINYYSS

SEQ ID NO: 26302 - protein, 399 aa, Leuconostoc mesenteroides subsp. mesenteroides ATCC 8293
MKGTPLMTKNINKNVHNTGLSGIRLVSNFIKKPVNEVIQLTVGEIDLPTPFATKQAGIKAIEQDHTKYTDNMGILALRRIITEYAQEFYSEPYNPVTEVLVTVGASEGIDLAIRALVNPGDEVILVSPGYTAYTQAVTLAGGVPVVVDTRSSNFRLLPNQLEEVISEKSKLVILNYPNNPSGVVLSSQELVELANVIKRHDLYVLTDDVYNRLVYDQDFAPSIASVPDMKERTLVLNGLSKSHSMTGWRIGYLLGPECLIHELYKIHQTDVGCASSISQEAAMTALTVDRDNPSEIVPIFRERRDYVLKRLDEIGISYIKPEGTFYVFANIEKFGMTSLDFVKFLIETVDLAVVHGSAFTEFGEGFIRISYAMDLSILKEALDRFQAAVAKLNNQKSLS

SEQ ID NO: 26303 - protein, 521 aa, Ashbya gossypii ATCC 10895
MGFLIAYVFNLSPCSGDEMFETIGLAIIHFEGLNTNRVSKCNQNWHQESKQVAMELIQKVSQGLWELENCDTVNSVVVLGKEYPPVPEQRQEERHENGVNMFQHIFTRQGRWNEEFLADVHTRLHFTYRTRFVPIPRHPNGPSPMSISVMLRDNPLNVIENVLNNPDCFQTDIGWGCMIRTGQSLLANALQRACLGRDFRIDDNAANEHELRIIKWFEDDPKYPFSLHKFVQEGFSLSGKKPGEWFGPSATSRSIQALVAKFPACGIAHCVISTDSGDVYMDEVEPLFRADPSAAVLLLLCVRLGVDVVNEVYWEHIRHILSSEHSVGIAGGRPSSSLYFFGYQDEHLFYLDPHKPQLNLASYQQDLDLFRSVHTQRFNKVHMSDIDPSMLIGILLNGKDDWQLWQQHIASSQIIHLSDSKPVDLMLDHQLESAILGDRYLSEDGQGPSSKVDTGDYIDVGSFVPCTDSSCKINESEDEYQDVKCKNQRIVVVGETTTNGSPEVEVEKVLVEKETIPVRSK

SEQ ID NO: 26304 - protein, 387 aa, Spinacia oleracea
METSMACCSRSIVLPRVSPQHSSALVPSSINLKSLKSSSLFGESLRMTTKSSVRVNKAKNSSLVTKCELGDSLEEFLAKATTDKGLIRLMMCMGEALRTIGFKVRTASCGGTQCVNTFGDEQLAIDVLADKLLFEALNYSHFCKYACSEELPELQDMGGPVDGGFSVAFDPLDGSSIVDTNFSVGTIFGVWPGDKLTGVTGRDQVAAAMGIYGPRTTYVLALKDYPGTHEFLLLDEGKWQHVKETTEINEGKLFCPGNLRATSDNADYAKLIQYYIKEKYTLRYTGGMVPDVNQIIVKEKGIFTNVISPTAKAKLRLLFEVAPLGFLIEKAGGHSSEGTKSVLDIEVKNLDDRTQVAYGSLNEIIRFEKTLYGSSRLEEPVPVGAAA

SEQ ID NO: 26305 - protein, 359 aa, Wolinella succinogenes DSM 1740
MLNIYDYTLEELKRRLHPPFRAKQLYHWLYHRYEEEFEKMHNLSKEIRQKLTQDYSATLTKVVREEVSEDGSRKYLFQTHDGLTYEAVLLKMKEKKEDEEGRIVEGEKYTICVSSQVGCKVGCSFCFTAKGGFVRNLSAGEIVYQIVALKRLNALAPEKRVNIVYMGMGEPLDNFENLIQAIRILSELDGLSISTKRQTISTSGIAPKIEKLGALDLGVQLAISLHAVDDELRTRLIPMNKAYNIASIIEAVRRFPIDSRKRVMFEYLVIKGVNDDEKSAKTLLKLLNGIKSKVNLIYFNPHEGSEFERPLESKMVAFQKYLTDRGLLCTIRESKGIDISAACGQLREKIIKEENCGNR

SEQ ID NO: 26306 - protein, 351 aa, Propionibacterium acnes KPA171202
MKAALVEQYHEPLAIRDIPEPAHDSDGVVVEVKACGVCRSDWHGWQGEWPGFTGGSLPHIFGHEFVGLVSDIGNNVSRYRVGDRVIVPFTLGCGHCEYCRSGHSNVCPTVSMPGFSYDGGFAQYVTVPDADANLVKLPDAVDFTDAAGMGCRLMTAYHGIVEVGQIHPGDWLVVYGAGGVGLSATLVATSAGANVIAVDIADDKLALARKVGAIATINSRETDPVEAVRELTDGGADKSVDALGISETLHNAVNSLRSRGTHIQIGMTAEGPVGDVALTINDLIAKEIDFRGSFGMPAVEFRYLLNQVAAGKMKPGQLVTKTIALSEVNDALTAMSTYNTVGTTVITDFTR

SEQ ID NO: 26307 - protein, 687 aa, Xanthobacter flavus
MTAHAAALAAADAPAPVDRSPGALGWPVTAALRALAMDGVEQAKSGHPGAPMGMAEIAAVLWREHLRHNPADPSWPDRDRFVLSNGHGSMLIYALLHLTGYDLPIAELKRFRQLHSRTPGHPELGMTPGVETTTGPLGQGLANAVGMAIAEKTLAAQFNRPGLSIVDHRTFVFLGDGCLMEGVSHEACSLAGRLGLGKLVAFYDDNGISIDGKVEEWFPDDTPARFAAYGWHVIRNVDGHDPAMLRDAVEAALSETGKPTLICCKTTIGRGAPTKEGHQDTHGAPLGAEEIARTRAAMGWDHAPFEVPEDIYALWDARRSGAARQSAWDARMEAYERAYPAEAAEFRRRLKGDLSPAFAATYAAALKATVEKAETVATRKASQLALAALAPAVPEFLGGSADLAHSNLTTFPGAVPITRDPAGNQIFYGVREFGMSAIANGIALHGGFIPFVATFLVFSDYARNAMRMSALMGQRVIYILTHDSIGLGEDGPTHQPVEHVESLRLIPNLDVWRPADTVETLAAWHAALTRTNGPSAFILSRQNLPCWPRDAAQIEGIEAGAYVLRESEGLARAVLVATGSEVKLAAAAADLLDTAGIPTRIVSMPCRERFEALTETERAALFPKGVPVVAVEAGVTRGWRGLSGTRADGIIAIGIDRFGESAPEKDLWPLFGFTPEAVADAVRRAVG

SEQ ID NO: 26308 - protein, 695 aa, Oryza sativa (indica cultivar-group)
MEIVDKIAEPKEPLMVTGRKVQSLEAPIPIKASWKGKSSQQQQQQQQDEKDFPADGEESFLSLDSSDEGGRSSFSGASHPLEPIDMDLMKTVYVAIDEEKSEQPVCLVRGVSAKGPFIDDLSICVTGMKANAVVGAGGADGLAEEMKVPGAAVPSLATARSSQATEAVSLPPDSEEKDCVWDASLPPSGNVSPHSSIDSMGVVTAMNTMSSCTSTYKSEAVSSEPVPTMERNCGSVKGSVRGDSLESAKTSMSRASDSSGVSDDSSWSNITGGASKPHKGNDPRWKAIHAVRTRDGVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQRQAGKHFSEYAARFYAAEVLLALEYLHMLGVVYRDLKPENVLVRDDGHIMLSDFDLSLRCAVSPTLIRASAFDSDPRRAGGSFCVQPVCMEPTSVCIQPACFMPKLFGQKSKKKTKKTRSELGPSATTMPELVAEPTSARSMSFVGTHEYLAPEIIKGEGHGSAVDWWTFGIFLHELLYGKTPFKGSGNRATLFNVVGQQLRFPESPSTSYASRDLIKGLLVKEPQHRLGVKRGATEIKQHPFFEGVNWALIRCSTPPDVPRPVEAELPVKYGVAEAIGSNSKRMVGADMKSGGKYLDFEFF

SEQ ID NO: 26309 - protein, 124 aa, Triticum aestivum
VTYRTVCTKKQAGTGSGIPGISSTHASAPLGGVVTFEYQRKVAKELQEYFKKKKLEETNQGPFFGWLAKNEIANGRWAMFGFAVGMLTEYATGSDFVEQLKILLSNFGICGFGLTPPVGRGCSV

SEQ ID NO: 26310 - protein, 1658 aa, Photobacterium profundum SS9
MEIKVWDGGLQAQEIRAIDKIKDAFCKPKLTNDRPQRGGSMQDQLRSIGGSTMFPWKGYAGFRYVDRTGKEGEFDLVIVTHCNILIIELKDWNHGDVKSYGDKWFKNDKDMGRSPVSVTQNKVYLLKDKLTKVKHKLTSRKLPWVDFFVVMCGNASFKNISEKDRKHTISLKQFLEFADEDKFNERFRPFDNTKTLNQDFDILDKVFGEEFTAPKQISVNGYTEDTLIFDKHPTKLYKEYLAKSDSSKQDEALLRVWNFNNFKGVKGGTPEGRYHIVSREREVLGYIKHQNHDLYKHCLRSLTNIQKDDVTTEFNEVFELPPSHSRFNEFIGKFGKNFSDTDRVNLVKLLVAKFADLHKIKVAHRDLADHSLWISPGKEIALSNFISAYHQPAGTVGDYREQLSVSDAELESGLSPFQNDVKALGVICWHILADLRISKVSLVQLNDKLTSSEDWYGCVLYDAIEAKRFLDAGELFDALKLAEPSSEGSFDFDDSELEPFRQNVNHSRQYREDDDFIVETDEKEVYVSDGLMVKAWLNVNPSVDESSLSYKVLHFLKRLEKIASVNPPYFPCIREYGIATKSSSLFLVTDKAEGEHWDECFAGSKEKLAVIDKLIEAVEHLHGLGLYHGDLQPKNILLYRGIQDIQLSLIDTPDFSQDGKEPKSPRYSPENIDGCTGFERDNFAVMRLSCEMLGIEWGTPSEEFAALTEAVKVELEDFNAGFRDLFRFKLALKPVASTSNIPVVITSKGEFEEVTIYPDNGELYVHVEKSKQNETDVIVNFYGIGGRVGVVYTSIEKGFIVGFKPAQRDSHRRSDIEKCQLVLDFPIQIKSGSVMELSQLTKKIAGNEAFNRTVETVLRPEEEPKLDGLTAQLKSAFEAIDNDKDTPDKLTISTEILWKAVLETETEAYPYIEVVGGALSVKDTDDELVLPYASDVDVLGSFTKTDIVEALQVKGDEEVRLGEVRIKQSALNEIRLHKFGFKAKSLDDGDQIFFRTRADKASYVKRKAALERILDHESVVSYLAHYFDPDCDTGATQYGVEVTEGDFARYDREDEYGNQISLNSQQRAAFSKLVNNGPLSLLQGPPGTGKTEFIAAFVHYLVEKQNVKNILLVSQSHEAVNTAAERIRKHCIRLETPLDVVRFSNREGAVSTGLKDVFSSAIIAEKRELFRAESKYRVEALAQALGLQKEFLSSVVEAELTLFKQVETLSKSLEVIQKQQLEEDEQNILKKNVISLDAAIRESLLNIYSLDYPEDKDVRDAKQDIIDYLCDQYSVSPDEAKRAVALAAVSRDMLDVLETERVNYEEFFARSRQLVTGTCVGIGQRHLGIADNQYDWVIIDEAARSIASELAIAMQSGKRVLLVGDHKQLPPLYSDAHKRALALKLGIADKEIDVDSVLQSDFARAFESPYGMQSGASLLTQYRMAPPIGNIVSSTFYKGELKNGDREIPDIYSDAPEALQSVVTWLDTSKLGQKCYHSEDRGVSIYNRAEADIIINLLKKISNKPDFVASLKNNVKKGDAAIGVICMYGEQKRIIRQKFKEIEWQDDFKELVKIDTVDSYQGKENRIIVLSVTRSSKDKKPKFLKTPNRINVAISRAMDRLLIVGSTHMWTGHNQPLPLGRVLDFISNKSSEEKSDLGMQSPNYQVLKIDKNLEEVEK

SEQ ID NO: 26311 - protein, 701 aa, Synechococcus sp. CC9605
MPQRALSGIHPGSPWPLGSSLTRRGVNFVLAAPGADRIELLLYSNSNDRSPERVIELDVRRHRSGNYWHVEVEGVGEGCCYGYRVFGPLAPGGHGFRPSKVLLDPAARAISGWDVYDRVLATGLSPNAHTCLKAVVCERDLFDFQAHPRPRHSWQRTVIYELHVGGFTRREDAGVAAANRGTYLGLIEKLPYLKELGITAVELLPVFCFDPADAPPGRDNVWGYSPLSWFTPHHGYCSSSNPLQARHEVRQLVAACHDAGIEVLLDVVYNHTTEGNRHGPTLSWRGCADDVYYHQNDDGDYLDVSGCGNSIAANAPISTQLILESMRCWALELGVDGFRFDLGIALSRGNQLKPLNDPPLFTAMGADPQLSDLKLVSEPWDCGGLYRLEDFPAKRIGTWNGHFRDGMRRFWKGDDHSTWTLAQRFKGSPDLYDGKPVALGRSVNFITAHDGFTLADLVSYNRKHNLANGEDNRDGENHNNSWNHGIEGPSSNPLVQTLRRRQQRNLLSSLLLARGVPMLLMGDEVGRSQGGNNNSWCQNSPLGWMVWDEDHCDLELKLFLQRLLRLRQALPQLFNPLVPPRESNRKSAPQPSEQRSDLWRQWHGVSLAKPDWAAWSRTTATSLHSGSRGALLWMGFNAYKESLSFELPIPASPWKRVIDTSLPSPQDFPAEPVNFSCMEIPLQSRSFVLLLAEEEISGLRL

SEQ ID NO: 26312 - protein, 426 aa, Propionibacterium acnes KPA171202
MATIEFIEAREILDSRGNPTVEVEMILDDGTQARAAVPSGASTGQFEAVELRDGDKKRYSGKGVLKAVENVNEKIAEEVLGCDASEQRIIDQIMIELDGSDNKGKLGANAILGVSLAAAHAAADCAELPLYQYLGGPNSHVLPVPMMNILNGGAHADSDVDIQEFMIAPIGAESFKQAYEWGAAVYHSLKKVLKDKGLATGLGDEGGFAPNLPSNAAALDLILDAIKAAGFEPGKDVALALDVAASEFFEDGKYTFEGQAKTSAEMIAYYEGLIAKYPLVSIEDPLDEEDWDGWAEFTKKLGEKIQIVGDDLFVTNPKRLAKGIETKAANALLVKVNQIGSLSETIDAVELAHRNGYRCMMSHRSGETEDTTIADLAVALSTGQIKSGAPARGERIAKYNQLLRIEEELGDSAEYAGASAFPRFQA

SEQ ID NO: 26313 - protein, 380 aa, Pisum sativum
MSNTVGQIIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCDLLRINTDRGVMLNDNKSRFSIKGQPVHHFVGTSTFSEYTVVHAGCVAKINPDAPLDKVCILSCGICTGLGATINVAKPKPGSSVAIFGLGAVGLAAAEGARISGASRIIGVDLVSSRFELAKKFGVNEFVNPKEHDKPVQQVIAEMTNGGVDRAVECTGSIQAMISAFECVHDGWGVAVLVGVPSKDDAFKTHPMNFLNERTLKGTFYGNYKPRTDLPNVVEKYMKGELELEKFITHTVPFSEINKAFDYMLKGESIRCIIKMEE

SEQ ID NO: 26314 - protein, 379 aa, Pennisetum glaucum
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHCKSAESNMCDLLRINTVRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDGWGVAVLVGVPHKDAEFKTHPMNFLNERTLKGTFFGNFKPRTDLPNVVELYMKKELEVEKFITHSVPFSEINKAFDLMAKGEGIRCIIRMEN

SEQ ID NO: 26315 - protein, 260 aa, Oryza sativa (japonica cultivar-group)
MAAMASLYRRVLPSPPAVEFASEEGKRLFSEALESGTLQGFFNLISVFQTQSEPAFCGLASLSVVLNALAIDPGRQWKGPWRWFDESMLDCCEPLDKVKAEGITFAKLACLAHCAGANVRSFRADQSTIHDFRHHLVRSASSQDCHLIASYHRKPFKQTGTGHFSPIGGYHAGQDMALILDVARFKYPPHWVPLPLLWEAMNTTDDATGLLRGFMLISRHTAAPSLLYTVLLCRVAEMKAGKAWRSIAWKMYPIFLRMRV

SEQ ID NO: 26316 - protein, 382 aa, Petunia x hybrida
MSSNTAGQVIRCKAAVAWEAGKPLVIEEVEVAPPQKMEVRLKILFTSLCHTDVYFWEAKGQTPLFPRIFGHEAGGIVESVGEGVTDLKPGDHVLPVFTGECQQCRHCKSEESNMCDLLRINTDRGVMIHDGQTRFSKDGKPIYHFVGTSTFSEYTVCHSGCVTKIDPQAPLDKVCVLSCGISTGLGATLNVAKPTKGSTVAIFGLGAVGLAAAEGARIAGASRIIGVDLNPSRFNDAKKFGVTEFVNPKDHGDKPVQQVIAEMTDGGVDRSVECTGNVNAMISAFECVHDGWGVAVLVGVPNKDDAFKTHPMNLLNERTLKGTFFGNYKPKSDIPSVVDKYMKKELELEKFITHQVPFSEINKAFDYMLKGESIRCMITMEH

SEQ ID NO: 26317 - protein, 245 aa, Prochlorococcus marinus str. MIT 9211
MSIFVGNLPFRAEQEDVIQLFAPFGEVANCSLPLERDTGRKRGFAFIEMADEAAESSAIEALQGAELMGRPLRINKAEPRGGGGGPRRGGYGGGGYGGGYGGGGQGGYGGGYGGGGGQGGYGGGGGQGGYGGGGQGGYGGGGGQGGYGGGGQGGYGGGGQGGYGGGGYGGGYGGGGGQGGYGGGGGQGGYGGDQDPGQRSSGAKGWEDRSYGSSDTSDRDENRSRRRRGAASETDETSDYGGAEG

SEQ ID NO: 26318 - protein, 471 aa, Nicotiana tabacum
MNVMRRLKSIASGRSSVSDPGGDSSIKRVKVEQEVDQRVVGETQMEERCTTIVPKEDMASTSKGTTTGSTSTMDTRPENSEFDELPKEMHEMKIKDEKADSHEDNLKDMEPAVVSGNGTETGQIIVTTVSGRNGQQKQTLSYMAERVVGTGSFGTVFQAKCLETGESVAIKKVLQDRRYKNRELQIMRTLDHPNVVKLRHCFYSTTEKNEVYLNLVLEYVSETVYRVSRHYSRMNQHMPIIYVQLYTYQICRALNYMHGVLGVCHRDIKPQNLLVNPHTHQLKLCDFGSAKMLVPGEPNISYICSRYYRAPELIFGATEYTTAIDMWSAGCVMAELLLGQPLFPGESGVDQLVEIIKILGTPTREEIRCMNPNYTEFKFPQIKAHPWHKIFHKRMPPEAVDLVSRLLQYSPTLRCTALEACAHPFFDPLREPNACLPNGRPLPPLFNFTAQELSGAPADLRKRLIPEHMRK

SEQ ID NO: 26319 - protein, 380 aa, Solanum tuberosum
MSTTVGQVIRCKAAVAWEAGKPLVMEEVDVAPPQKMEVRLKILYTSLCHTDVYFWEAKGQNPVFPRILGHEAAGIVESVGEGVTELGPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDIPSVVEKYMNKELELEKFITHTLPFAEINKAFDLMLKGEGLRCIITMED

SEQ ID NO: 26320 - protein, 541 aa, Pseudomonas fluorescens Pf-5
MRHFVLQVSRPVTKWRNAIVLNDLGFPSVGSPTLVARGSVTFWRNSCVRYKERPVGFFLRERMQTGWSYSFFVAKVLFMSGTQLSNDLEQGLKPRHVTMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNVAIWVFTLVITLLLTATNLFSVKNYGEFEFWFALIKVVAIIGFVILGLAAICGLLPNSQVSGVSHLVDTQGFMPNGMGAVLAAMLTTMFSFMGTEIVTIAAAESHNPGKQISKATNSVIWRIGLFYLVSIFIVVALVPWNDPSLAQVGSYQTVLDRMGIPNAKLIVDLVVLVAVTSCLNSALYTASRMLFSLGKRGDAPAAAKRTNASGTPYWAVILSTAAAFLAVFANYVAPAAVFEFLLASSGAIALLVYLVIAVSQLRMRHKRMAAGEKIAFRMWLFPGLTYAVIVFIVAVLGIMLFQEEHRVEILATGLLSVIVIAAGLMVARRRKAERNGALALN

SEQ ID NO: 26321 - protein, 380 aa, Trifolium repens
MSNTAGQVIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCNLLRINTDRGVMINDNKSRFSIKGQPVHHFVGTSTFSEYTVVHAGCVAKINPDAPLDKVCILSCGICTGLGATVNVAKPKPGSSVAIFGLGAVGLAAAEGARMSGASRIIGVDLVSSRFELAKKFGVNEFVNPKDHDKPVQQVIAEMTDGGVDRAVECTGSIQAMISAFECVHDGWGVAVLVGVPKKDDAFKTHPMNFLNERTLKGTFYGNYKPRTDLPNVVEQYMKGELELEKFITHSIPFSEINKAFDYMLKGESIRCIIRMEE

SEQ ID NO: 26322 - protein, 521 aa, Zea mays
MPGAVIVHHHTRYKTYPGEVTGIAIFSCFIASVAGCIFGYDIGLTSGLTSTEPFLVKFFPSIYEEMKRQVVVNQYCKFDSQVLTLFSSSLFLAATVATFFAGPMTRAFGRKWTLFAAASAYVVGACIGGVSVNFPMLLTGRVLVGSGVGISIQAAPLYISEVAPAQQRGMLNILFQLMITVGILTANMTNYLASKVSGGWGWRIPVTFGAIPAAVIALGALAIPDTPASLVERGDTATARKTLSQIRGVGDVREEFDDLAAASEDAKAVQCPWRELFFGGKYKPQLTFALLIPFFQQLTGINVIMFYAPVLFKTVGFKQNATLVSSVITGLVNVFSTFVAIATADKIGRRALFLQGGTQMIISQILVGTFIGLQFGMSGTGDISEQYAMCIVLFVCVYVAGFAWSWGPMGWLVPSEIYPLAVRSAAMSVTVAVNMFFTAFIGQIFLTLLCHLRFGLFYFFGAWVLLMTLFIAMLLPETKSVPVEEMAHVWKKHWFWRKFVIDTGNDARNAEMRKRIALEMS

SEQ ID NO: 26323 - protein, 449 aa, Pseudomonas putida
NMPEHAGASLASQLKLDAHWMPYTANRNFLRDPRLIVAAEGSWLVDDKGRKVYDSLSGLWTCGAGHTRKEIQEAVAKQLSTLDYSPGFQYGHPLSFQLAEKITDLTPGNLNHVFFTDSGSECALTAVKMVRAYWRLKGQATKTKMIGRARGYHGVNIAGTSLGGVNGNRKLFGQPMQDVDHLPHTLLASNAYSRGMPKEGGIALADELLKLIELHDASNIAAVFVEPLAGSAGVLVPPEGYLKRNREICNQHNILLVFDEVITGFGRTGSMFGADSFGVTPDLMCIAKQVTNGAIPMGAVIASTEIYQTFMNQPTPEYAVEFPHGYTYSAHPVACAAGLAALCLLQKENLVQSVAEVAPHFEKALHGIKGAKNVIDIRNFGLAGAIQIAPRDGDAIVRPFEAGMALWKAGFYVRFGGDTLQFGPTFNSKPQDLDRLFDAVGEVLNKLLD

SEQ ID NO: 26324 - protein, 403 aa, Ehrlichia canis str. Jake
MPIEILMPALSPTMKNGTIRKWYKSEGDIIKSGDIIADIETDKAVMEFEYTDEDGIIGKIFFAEGSKDIAVNQLIALIAVDEHDLVNVQSYKKRDDVSQNNSNALQVNQQVVSSNEEVLVNQSNVSERIKISPLAKKIAADLCVDINLIKGTGPYGRIIKADVLDAASQKKEHVSSSPMSFTEISSMRRVIAERLVYSKQSIPHFYVSIDCIVDDLLKLRLEINAENSDTKVTVNDFIIKAVAMSIKKFPEINVSWSDDKIVVFHNVDISVAVSIDSGLITPIIFNADKKSLLEISSEVKTLASKAKSGKLRSEEFQGGGFTISNLGMFGIKEFCAIVNPPQSCIMAVGCSEKRAIVVDDQISISNVITITLSVDHRVIDGVLAAKFLSCFKSYLEKPFLMLI

SEQ ID NO: 26325 - protein, 571 aa, Magnetococcus sp. MC-1
MHIAIVDDSPDDRLLLMRILSKAGYSTLQLHDSGEAFLQTLGLTPTDTASIAPFNPPHTSLPDIIFMDVMMPDMDGLSVLRQLKANPPTQNIPVIMVTGNDRPRDLAHAFEEGATDYITKPIRRVELLARLRSIIKLERAMQQVRSSEKRLRDLTASLGEGLLSVDNAQRIIFLNPAGEKLLEYSESALHLTTLNEQLIPHTCGSLHDQQSADHMLAALRGETEQISGETLFRTRTGKLIPISFNAAPILDGHFLSGGVLSFRDIRDQREKEERLKLAAKIFNHSQEGLVVLDAERIIVDVNPAFSYITGYTREEVIGRSPELLRSQRHDAAFYQSIWQQAENQGNWQGEIWRRRKNGEEFPEWLSLSIIRGENQQISHYIGLFSDITTRKIAEEKLKHQAHHDPLTGLPNRSLLEDRLQQAVSKARRYEGKIAVLYIDLDHFKPVNDNYGHEAGDAVLREISARIRYELRQSDTAARVGGDEFVAVLTEIREEHLVMGVAQKLIHAIQKPVNFGNESFQVGCSIGISLYPIHGNSITKLLKSADTAMYRAKQEGRNRFCVATLDKETQNP

SEQ ID NO: 26326 - protein, 455 aa, Haloarcula marismortui ATCC 43049
MSAVFSGGLTQAGGMSSTETVDSSAVSSGTISDYVEAMGPSWIAGAIAAGPATIASLVTAGGAFGYSLLWVVVLSAGAGALAQYLAMRLGLLTERGIVAVVEDHLGETWAWLLVGDAVLAAGVAQLVIMKTVATVSATVTGIDARIWGVVWALILAAGLAGGGYRFLELAAKILVLLVVVAFVASLFVVPIDAGAAVAGLVPSVPSGSALVAAGILGGAVHITLITMHSYTMRARGWTREDYDLATVDVGASMLVAFGIYSLAIFLVTASVLTSGDLTTVGAAEALGPLVGDSARWLFLLGLWGAAVSTLGGNTIVPPFLLADKLGWGTTIEDNRYRGLLAAVALLSAPGAFIGGNVLGQLVLVLALGTVGTPFAIALVLYLLNSAAVPESNSLLANVGGLALIAVSGGLAANFVVEQLGGGVGPLSGFVLAFAIALGLAMAGLGGKFLREELLA

SEQ ID NO: 26327 - protein, 240 aa, Debaryomyces hansenii CBS767
MSCEDEHHNHGNGSGHNHGSGHGHLHVAPIPTNESQSLLSKIDLPHATALNLANPPDDLQKIFRSQEDKYQLKPIIKTDCDPQIIINIPFLNGSVKLFSLILRTNGDKYCPKTIKVWKNDKTIDFDNAHSKKPTYTITHPQVGVMLNDDEDVPDVLEDDGDFVEHYLPRHIFTGVQQLTLFIDDIYDDDEDESHLHYIELRGEFTELTKDPVITLYELAANPTDHKNLTASEATNYSLGN

SEQ ID NO: 26328 - protein, 359 aa, Symbiobacterium thermophilum IAM 14863
MQNVSVAVIPGDGIGNETVRAGRRVLDAAAELDGGIKFEYTEFEWGCAYYLRHGEMAPKGFLNTLANFDTILLGAVGYPGVPDHVSLWGLLLPIRRGFEQYVNLRPVRILRGVVSPLRGRNPGDVNFVCIRENTEGEYSNMGGRLHAGLPHEVVVQNTVFTRVGTERIIRYAYQLAANAPRKRLCGATKSNGINYTMPYWDEIFNEIGEREFPEVNRWLCHIDALAANFVLKPDEFDVVVASNLFGDILTDLGGAIMGSIGMAASANINPERRYPSMFEPVHGSAPDIAGRGIANPVGQIWSVSLMLEHLGRADLGKAVLDAVEDVLEEGRVRTPDLGGRNTTDEMTDAVIARLAQRLR

SEQ ID NO: 26329 - protein, 322 aa, Wolinella succinogenes DSM 1740
MNIDDIKQAKAVLQLEAQEMLRAAEGISTDFSKALDLMQFCRGKVIIMGVGKSGLIGAKIAATLASTGTPSFFIHPTEAMHGDLGMIGKEDVVLAISYSGESGELVAILPHLKRFGIPLITMSQNPQSSLSKVGDAFISIWIEREACPLNAAPTCSTTLTLALGDALAVCLMERRGFKECDFASFHPGGSLGRRLFVKVTDLMQSENLPLIPPHLPLKEAIVKMSDGRLGNAIIVDEEGRLTGVLSDGDLRRAMMREEFNLSAKAIDYATKNPKYCDDETILASEILRYIEENKIQLLVITDKEKRVKGAVHLHKLIEAGIK

SEQ ID NO: 26330 - protein, 223 aa, Zea mays
MASLLARQAAQALRARQTAQLGPAASAMQGHLRTYMNAGIPKRFKEDEEKEQLAKDLAKDWNAVFERSINTLFLTEMVRGLMLTLKYFFDRNVTINYPFEKGPLSPRFRGEHALRRYESGEERCIACKLCEAICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 26331 - protein, 373 aa, Hordeum vulgare
MATAGKVIKCKAAVAWEAGKPLSMEEVEDAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFLNERTLRGTFFGNYKPRTGLPGVVDMYMRKELELDKFITHSLPFSQINTAFDLMLRGEGLRCVIRSEE

SEQ ID NO: 26332 - protein, 379 aa, Zea mays
MATAGKVIKCRAAVTWEAGKPLSIEEVEVAPPQAMEVRIKILYTALCHTDVYFWEAKGQTPVFPRILGHEAGGIVESVGEGVTDVAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 26333 - protein, 403 aa, Glycine max
  misc_feature (188)..(188): Xaa can be any naturally occurring amino acid
  unsure (1)..(403): unsure at all Xaa locations
MASATLSVAKPALQANGKGFSEFSGLRSSSGFLPFSRKSSEDFHSVIAFQTYAVGSSGGYKKGVTEAKLKVAINGFGRIGRNFLRCWHGRKDSPLDVIAINDTGGVKQASHLLKYDSILGTFDADVKPVGSNVISVDGKEIKVVSDRNPANLPWKDLGIDLVIEGTGVFVDREGAGKHIQAGAKKVLXTAPGKGDIPTYVVGVNEYDYSPDEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNAAFRESADNELKGILSVCDEPLVSVDFRCTDVSSTVDSSLTMVMGDDMVKVIAWYDNEWGYSQRVVDLADIVANKWK

SEQ ID NO: 26334 - protein, 332 aa, Burkholderia pseudomallei K96243
MIMSSTATPSLSAAHLLAPIASDMEQVNRVIRQSLASDVLLINQIAEYIIGAGGKRLRPALLLLVAGALGENTNQKHVLAAVVEFIHTATLLHDDVVDESELRRGRKTANALFGNAASVLVGDYLYSRSFEMMVGVGKMRVMEILSEATTIISEGEVLQLLNMHDADVDEARYMQVIRYKTAKLFEAAARLGAVLAGADAPTEAAAAEYGRRIGTAFQIMDDWLDYAGTAESMGKNAGDDLREGKPTLPLIYLIERGTPEQSTLAREAIEHGGTDRFDTIFDAITRSGALDHTLECARQEAQAAAAAISSFPSSNFKESLLELCSYSTSRQS

SEQ ID NO: 26335 - protein, 1464 aa, Magnetococcus sp. MC-1
MSRSSIRVWPGNPFPLGATWDGRGVNFAIFSEHAERVELCLFGPDGFRETARISLSEYTNQVWHGYLPDVRPGQLYGYRVYGPYQPEHGHRFNHNKLLLDPYAKLLNGQLQWHEALFGYRYDDPLGDLSFSDLDSAPYVPKCVVVDTAFTWGGEQPPNVNWLDSIIYEMHVRGFTMQHPKVPQNQRGTFAGLCAPEVISYLQDLGISSVELLPVHASVDEWHLAQKGLSNYWGYNTLAFFVANPRFASGPDAIREFKTMVQVFHEAGIEVLLDVVYNHTAEGNHEGPTLSFKGIDNKAYYKLEPGYNRYYRDFTGCGNSFNLRHPKVLQLVMDSLRYWAGEMHVDGFRFDLTTTLAREADGHFDRHSGFLDAIAQDPLLSRKKMIAEAWDIGDGGYQVGNFPPGWGEWNDRYRDAIRRYWKGDKGMAGELASRLTGSSDIFNHNGRRPWSSINFVTAHDGFTLRDLVSYNHKHNSDNLEDNRDGRDANDSWNCGVEGASEEPAIRILRLRQMRNFLTSLLLSQGLPMLVAGDERGRSQNGNNNPYCQDNDISWVNWDEHDEEAKELLSFTRFLIKLRREHGVFHRHSFFNGQKITGLEVKDVVWLRPDGREMERCDWDNVHTLCLGMLLSGEAGEKFLSRYGDAQVDDTFLLLLNSHHEPLPFHLPEVEDGSGWTRLLDTMERGGGCDEPQPGIVNSYQMGGRSAVLFVLQRRERAVEVKPKPATSGDEHELLRQLAEAAGIDRGYWTVFGEWFDLPDASLRSFLGAMDLAADNQGQIRASLTRLEEEPWRRAMPPVVMCRYPCTGVDIAIVVGAEMVDEALEWVLVDEAGHIIPGKVVPSDMPLDGERLVDGQHLERRIFHLYQKLEVGYYRFELHGAGLPDGDFASMRLVVAPSRCYLPKALEKNDGRIWGFSPQLYALRSQRNWGIGDFEDLKQLVEITASHGGGIIGLNPLHTLFLTRPEQVSPYSPNSRHYVNPLYIAPEQVPEMESCEEAQIRLNSPGVRRLLNKLRESEMVDYVEVSALKLSIMRLLYGVFRDKHMTPDKSCVTSPRGLQFRAFVKAGGDALMRLAVFNALSVQFAQTGEDVGGWRSWPTPYRRPDSPEVRRFMQEQEEEVFFYLYLYWIADTQLQEAKASAQQQGMPVGLYADMALGVDPDGADFWNEQSAYAGDMRIGAPADLFNPKGQNWGLPPFDPRALRAQGYQPFIDALRNTMRHAGAIRLDHVMSLARLFWVPVGAPATEGGYVRYPVEDLLGLVALESQRNQCTVIGEALGTVPEGFREKLAENGILSYRLLYFERAEEGRFLQPHEFNTRSLVAATTHDLPTFSGFWEGVDLAVKEQLDLYPNEEMAVRFRGERVHDKMKLREALQQVGIPLTEQFEQADATPELIEAVYRMLARTPAHLLMVQLEDVLQQKEQVNLPGTVNEHPNWRRKLPADLEALVQDPRFKGLTKMLNSERPPL

SEQ ID NO: 26336 - protein, 380 aa, Solanum tuberosum
MSTTTGQVIRCKAAVAWEAGKPLVMEEVDVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNFLNERTLKGTFFGNYKPRSDIPSVVEKYMNKELELEKFITHTLPFAEINKAFDLMLKGEGLRCIITMED

SEQ ID NO: 26337 - protein, 616 aa, Prochlorococcus marinus str. MIT 9211
MNKELTDFIEAEGLQQYDPEAISAIYKKHPFRLIKRLWETLIPISLFLLGVGWEKLIGLLKNEEKARKRAKEFTDLLVDLGPAFIKAGQALSTRPDIVPRVVLEELAQLQDQLPGFESNLAMACIEEDLGIKKEEIFSNIEKEPISAASLGQVHKGTLLNGDKVAVKVQRPGLREQITLDLYIVRSIAIWLKNNIKLIRSDLVALIDELGRRVFEEMDYINEAENALKFRKLHSHNRNIAVPKIYKEITSKRILTMEWIDGVKLTELAAVKKLGIDPDRMIEIGVNCSLQQLLEHGFFHADPHPGNLLALEDGRLCYLDFGMMSDVTRKSRTGLIQAVVHLVNKNFDKLSKDFVELGFLSEEVDLEPIVPAFESVFSNALEMGVNKMDFKSVTDDLSGVMYKFPFQLPPYYALIIRSLITLEGIALSVDGDFKILGAAYPYFARRLMEDPDPQLRKSLKEMLFDGNTFRWNRLDELISSASKQADIDIENLLDKVLDFLFSEKGGVLRNELVEAIINKFDAITWNTVQSINKKLPIQIRSNSINSNQSDFMIEIEPIKKLVSILESLPGFNREIIIKKVPRILKEKDTRKMGIKIAKGITEKSMVRMIKLAAGVNQ

SEQ ID NO: 26338 - protein, 297 aa, Polaromonas sp. JS666
MPIDDADGLLAHIAAQVRPLLPQGQLPQYIPQLGRVDKMQFGMALLMLDGREAFVGDADVPFSIQSISKLFALMLALERVQVDQEAGATRNPFINAGALVVTDVLCSSFAQPELALLQTLRQSADDERVDIDQIVMRSERESCHRNAAIAHLLKSYGRICNSVDTVLDTYCRQCALTMNTRQIARCALPLAISGRLSAHRARERLSAVQRHSVTALMLTCGTYNAAGDFAARVGLPMKSGVGGGIVAVIPGVGSVCAWSPGLDGAGNSLAAGRAIELFAKHTGLSVLGSPARTFKAL

SEQ ID NO: 26339 - protein, 202 aa, Schizosaccharomyces pombe 972h-
MATELRRKLVIVGDGACGKTCLLIVFSKGTFPEVYVPTVFENYVADVEVDGRHVELALWDTAGQEDYDRLRPLSYPDSHVILICFAVDSPDSLDNVQEKWISEVLHFCSSLPILLVACKADLRNDPKIIEELSKTNQHPVTTEEGQAVAQKIGAYKYLECSAKTNEGVREVFESATRAAMLKHKPKVKPSSGTKKKKRCILL

SEQ ID NO: 26340 - protein, 487 aa, Frankia sp. EAN1pec
MSALTYQLYIDGAWRDSDGDGVLEVLNPATEEVIGAVPDGTVSDVDRAVAAARRAFDEGPWPTLSANERATALLRMADVMERRVDELKELSVREAGSTRALADTLQVSVPLHHFRDMAERVLRQFPFERAMLPTVGPTLAQGVVRREPYGVAALISAYNFPLFLNILKLAPALAAGCTVVLKPAPTTPLEAFVLGEMADEAGLPPGVLNIVSGGIAAGEALTTHPGVDIVSFTGSDTVGRLVYTQAAQSLKKVVLELGGKSANIITADVDLDLVVPTIVNGMTTHAGQGCSLLTRTLVHRSRLDELVGLVKQSLDHITVGDPADPATTMGPLISAAQRAKVESLISAGRAEGAQVAYGGGRPAHLDKGFFVEPTLFVDVDNSMTVARKEFFGPVGVVIAFDDDDEAVRLANDSEFGLGGGVWAQSPVRAYEIAKRLRTGMIYINGGGAGSSPHTAFGGYKQSGLGLERGEFGLEEFLLSKSIIWSAR

SEQ ID NO: 26341 - protein, 351 aa, Oryza sativa (indica cultivar-group)
MVVTIDLREEDEAAAAAAMKAIAGRSDEEVLAAVLARKGGPVPFLQAAIDAAAAAAATKAIAGRSDEEVLAAVLARKGGPVPFLQAAIDVAQRRSDLFLDPSAPGVVAEMAVEAQAKAEAEERRKRAKGEPRKAEEMLKEEEPMKAEEMLKEEEPMKADEMLKEEEPMKAEEMLKEEPRTPMREAGRDKVERAAVVERVRDPKPNAGNGLDLEKYSWTQERPEVTITIPVPQGTKSSLVTYEIMKNHLKVGLKGCSFIIDGELFEPVKVNDCLWTIEDGNTLSILLTKENQKEWWTSVIKGDPELDPRDMKVPELRDCDVEAKETIVRILSHGLPKAMNFCPVMHNRFSYH

SEQ ID NO: 26342 - protein, 514 aa, Arabidopsis thaliana
MDSGSKDIISNLPDALLCHVLSFLPTTEAASTSVLAKRWRFLLAFVPNLDLDNMIYDRPKMGRRKRLELRKSFKLFVDRVMALQGNAPLKKFSLRCKIGSDPSRVNGWVLKVLDRGVEELDLYIASEYEYPLPPKVLMTKTLVSLKVSGTDEFTIDVGEFFLPKLKTLHLSAISFGDEGGPPFAKLISACHALEELVMIKMMWDYWEFCSVSSPSLKRVSIDCENIDENPKSVSFDTPNLVYLEFTDTVAVKYPKVNFDSLVEASIGLRMTPDQVFDARDLVNRHHGYKRCKGANAADFMMGVCNVKTMYLSSEALEVLTFCCKKAIPVFNNLIHLTVETDERVDWESLPILLKNCPNLETLIFEGLHYGDLNQCFDKDYSFKDTNECYGDQGDTCQCKPWYGTPVWLSSSPVKILKVLKFGQISSYKDDMERQTDLIEHFLESMPNLEQVILFYDTTYDDDLKIVSTQLQMLEKVASPKCKIQVISDNISYSFTVYSSSSTKGLNFFKDTFPV

SEQ ID NO: 26343 - protein, 259 aa, Oryza sativa
MENNSVFNFWSLFCSFREEKNISVLALPSSMAVAIEAPFHILAVDHSLPDRKLIERLLKTSSFQGLAFVCVVTTVDSGSKALEFLGLHDHEDSPISTQSDQQEVAVNLIITDYCMPGMTGYDLLKKIEESSYLRDIPVVIMSSDNIPSRINRCLEEGADEFFLKPVRLSDMSKLKPHILKSRCKEHYQQEQNLQSNSESNNSSNPTSENSSSSTSSNSHKRKAVDEEILPHTKDQGIVDLASDWSFDTDFFSCFCLIGF

SEQ ID NO: 26344 - protein, 197 aa, Pseudomonas fluorescens Pf-5
MAERKASVERDTLETQIKASINLDGTGKARFDIGVPFLEHMLDQIARHGLIDLDIESKGDLHIDDHHTVEDVGITLGQAFSKAIGDKKGIRRYGHAYVPLDEALSRVVIDFSGRPGLQMHVPFTRATVGGFDVDLFQEFFQGFVNHANVTLHIDTLRGTNTHHQIETVFKAFGRALRMAVELDERMAGQMPSTKGVL

SEQ ID NO: 26345 - protein, 379 aa, Hordeum vulgare
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGLSTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIATFECVHDGWGVAVLVGVPHKEAVFKTHPMNFLNEKTLKGTFFGNYKPRTDLPEVVEMYMRKELDLEKFITHSVPFSQINTAFDLMLKGEGLRCITRTDQ

SEQ ID NO: 26346 - protein, 380 aa, Solanum tuberosum
MSTTVGQVIRCKAAVAWEAGKPLVMEEVDVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNFLNERTLKGTFFGNYKPRSDIPSVVEKYMNKELELEKFITHTLPFAEINKAFDLMLKGEGLRCIITMED

SEQ ID NO: 26347 - protein, 425 aa, Magnetococcus sp. MC-1
MADKSKNGVANLNEAIRQSLILVLAGGRGSRLKNLTDTEAKPAVPFAGKFRIIDFALSNCVNSGMRRVGVLTQYRAHNLIQHVQRGWGSFRAEFDEFVEVWPAQQQTAAESWYSGTADAVYQNIDLIESHHPKYVVILGGDHIYKQDYSVMLDHHITSGAQVTVACLEVPVAEAREFGVMDVDEQDQIVKFLEKPQTPPELPNRPGWALASMGIYIFDHELLVEQLERDALLEDSSHDFGKDLIPYLVPKVKVMAHRFSHSCVGLDGKKEPYWRDVGTLDAYWEANMDLTHVTPELDLYDPKWPIWTYQVQRPAAKFVFNDDSRRGYAVDSLVSAGCVVSGSAVERSLLFTDVRVNSYSFVSDSVILSHADIGRKCTLIKCIVGPNTVIPDGMVIGKDPQLDAQRFYRTEGGVTLVTQEHIDKLK

SEQ ID NO: 26348 - protein, 59 aa, Oryza sativa
MKPIANYFLPNLTDVCWDKCITGSIGSSFSNSEASCLSNCAKRFLELKMLTMQRVSSPR

SEQ ID NO: 26349 - protein, 276 aa, Streptococcus mutans
MKTDIEIAQSVDLQPITNVVKKLGIDFDDLELYGKYKAKLTFDKIKAVEENAPGKLVLVTAINPTPAGEGKSTITIGLADALNKIGKKTMIAIREPSLGPVMGIKGGAAGGGYAQVLPMEDINLHFTGDMHAITTANNALSALIDNHLHQGNELGIDQRRIIWKRVVDLNDRALRHVTVGLGSPINGIPREDGFDITVASEIMAILCLATNVEDLKERLANIVIGYRFDRSPVYVRDLEVQGALALILKEAIKPNLVQTIYGTPAFIHGGPFANIA

SEQ ID NO: 26350 - protein, 367 aa, Dehalococcoides ethenogenes 195
MAIKTESFILNIGPQHPSTHGVFRLRLILDGEVITDLEPVFGYLHRGIEKLAEGRTYLQDIPFTDRLDYLGSMTNNHAYVMAVEKLAGITVPERAEYIRVILDELQRIASHLAGLGFFLNDLGALQTPLLYMFREREKIVELFDMCSGQRLNYNYYRFGGFVQDLPEEFLPALKKLLDTLPGFIDEYEQLISTNEIVLIRTKGVGVLKRELAINSSAAGPVLRASGVNWDIRRNDPYSIYDRFEFDIPTAQNGDTYDRYMVRIREMRQSVRILRQAVKDLPEGEIMGKAPKLLKPPAGEVYSRIEGPKGELGFYLVSDGTDKPYRWRVRPPCLLNLSALKDMVVGWKVADLMAIFGSIDIVMGEVDR

SEQ ID NO: 26351 - protein, 798 aa, Ashbya gossypii ATCC 10895
MNIIRKFMESGSKPEVVSIPSGQLYLTRSRQSPKSSSECLYNDATVTVRACARYAYELVVRKQAEEELTPGAEDDDEDDGLSELSGQSTEDEWVFRLDETLRLHRRWNKSGELTVVWRNTKGDCGEKFQFVVNSDIPLGDVEDFLETVYRCEYEAKYRRLASEATEQDLKQFDFSYLANHDSAVFFSDDETEVREPEFLSAQMGALAISDDDSDEDPDLYEDALDEPQPRLHTNPPGVVRFLQYGDLSVYDPMTGRYALQERNVNVALLQDNKHRYVYIEGSEIILAVETLPEVNPFLEVGIRSFLFNYTHEGIVLSYKVKFKNAAAFTHFHLHWTIALWEMSTGQKWSDLSETEQNYILYSTSGKNEELDVFLEEPENQNDTLGDAQIGTDEQEEEEEEEAEGSNLLISSSSFGDDEYDERRAEREYEESTSNVGNKALAVGFKSDRTFVLRGDKIGVFKTSDADSLDFVTAINEVSDIKGNVLNPNSAMLYTEDRALILQDENHKERLFKMDLERGKVVEEWVAGGRDVLQIGPNKKFDQLTSEQTFLGIAPNSVFQMDPRLSGQNKVVSSSDYSYSSVRDLRSLCTTQLGYVAVGSNKGEIRLYDKLGKRAKTLIPALGEPIRHLCASADGKWLLATCKSSILLFDTEVKEGRNAGALAYQKSFSQGALPQCYVLKVDPSTAIYMQTETGAPIEFTKATFNTGLDTKEQTITTSTGPFAMVWPIKSILQGKKTPYVIKKYHSNVTEESFKFGSDRNVIVALKDDISMAKKKSFRAPSRAMLTKMGKQKSRKASKE

SEQ ID NO: 26352 - protein, 119 aa, Brassica napus
MEGAGDKTTSSDDGHLTSAAAFVQGGIQDPCDDACSICLEVFCDSDPSTLTSCKHEYHLQCILEWCQRSSQCPMCWQSISLKDPTSQELLEAVVQERSFRINPPRNATIFRHPTLGDFE

SEQ ID NO: 26353 - protein, 382 aa, Methanosarcina acetivorans C2A
MATKRDYYEILGLPKDASVEDIKKTYRKLALQYHPDRNKDPGAEDKFKEISEAYAVLSDTEKRAQYDRFGHAGIDNQYSAEDIFRGADFGGFGDIFEMFFGGGRRGGPMGPRRGSDLQYDLYITFEEAAFGVRKDIDIPRTERCSTCSGTGAKPGTSPKRCPTCGGTGQVRTTRSTLGMQFISTTTCSTCHGRGQIIESPCPVCGGAGRVRNKRTITVNVPAGADSGMSLRLSGEGDSGEPGAPSGDLYIIIHVMEHRHFKRVDYDVISELSITFTQAALGADVMVDTLYGKVKMNIPAGTQTHSVFRLRDKGIQRLHGHGKGDQLVRVIIKTPTKLNQEQKELLRQFENLSKGKKPQEEEKSKAEKHKKGIFEKVKDAFES

SEQ ID NO: 26354 - protein, 360 aa, Ashbya gossypii ATCC 10895
MSEWKVDPDNRRRLLQLQKLGGNKKCADCGAPNPQWASPKFGIFICLECAGIHRGLGVHISFVRSITMDQFKPEELERMEHGGNAQFHEYLAKHGVDQKLPQKAKYDNPVAASYKEKLTCVCEGKDWVEPDLSGAGGATLDRGSSEQASPGTATPNGGAEKLESRRATGPADEQKLRNENYFATLGKKNQTKPEHLPPSQGGRYQGFGNTPTPTNPNQARQGGTTADLSLDNLQKDPWGTLTKGWGLFSTAVTKSVEEVNESVIKPGVQHLQSSELSAEAQRAAQQFGQKFQETSSSGISAFSRWTKNLQQQYVQQSPGAPDQDSQYSRLFDSLESRSKDHSQLRAQKKGGEADTEWDDF

SEQ ID NO: 26355 - protein, 243 aa, Ashbya gossypii ATCC 10895
MHQPMELKQLTGEQAAALDAELMGPDVGYSLHQLMELAGLAVAQVVVRHWGAAQAKKKVLVLCGPGNNGGDGLVAARHLRLFGYDPVVYLPRLSAKQPFYAQLAKQLHFVGVPVLSEGDDWRAHLEPRDTLCVVDALFGFSFRPPLREPFASIVAELKRHEDDIPIVAVDIPSGWDVDAGPLTPSDLMPRVLISLTAPKRCSAHIDTGVTTHYVGGRFIPDALARRHGFDPFPYSGTDQILRI

SEQ ID NO: 26356 - protein, 174 aa, Rhizobium etli
ARKPSIVPIVEPECLMDGKPGDHNIDRCAEVTESTLQIVFEELAEARVSLEGMILKPNMVIDGKNARKASVAEVAERTVQVLKRTVPSAVPGIAFLSGGQTTEEATAHLSAINGFDLPWLVTFSYGRALQDSALKAWNGKPENVAAGQREFTHRAEMNSLAAKGSWKKDLEQAA

SEQ ID NO: 26357 - protein, 115 aa, Schizosaccharomyces pombe 972h-
MADLVDKPRSELSEIELARLEEYEFSAGPLSVLQQAVKNHDQVLINCRNNKKLLARVKAFDRHSNMVLENVKEMWTEKKRTASGKKGKAINKDRFISKMFLRGDGVVLVVRIPSA

SEQ ID NO: 26358 - protein, 229 aa, Wolinella succinogenes DSM 1740
MNTLLDGIDWEKHPLLPAIVQERGSGEVLMLAYMNQEALNLTLSTQVAHYFSRSKGRIWKKGESSGHIQKIHEIFLDCDSDTILLQVEQVGVACHTGRKSCFFQKVELDSSLSLTSEAPDTSALYGVVDRLYHELLARQGADPQSSYTAKLFSKGENTIGKKIVEEAAELSFAIKDSSESEIVYEAADLLYHALVGLAFRGIHPDKIKQELQRRQGVSGIAEKNSRKDS

SEQ ID NO: 26359 - protein, 381 aa, Wolinella succinogenes DSM 1740
MPIDLNEHLRKKNRTFNPDENRGEDRNDSEGKGKGGGFGGGGGGGGFQPPFQTPDLFKGMGKKAGFIYALIIAIVLIALTKPFTIINSGEVGIKVTAGKFDNIPLQPGLHFFIPVLQKIILVDTKVRIINFSSTEDMGIRGRSEGILSNDAISVLDARGLPVSIEITVQYKLNPLGAPQTIATWGLTWEQKIINPVVRDVVRNVVGRFPAEELPTRRNEIADMIDTLVRENVDRLDNSPVQLSSIQLREIVLPVKIKEQIERVQVARQEAERTRYEVERARQEAEKQVALAKGEADAKRINAQGLADATLIEAEAQSKANKSIAESLSARLLELRQIEVQGRFNEALKVNQDAKIFLTPGGSTPNLWLDTKDRQKSSSKGE

SEQ ID NO: 26360 - protein, 333 aa, Zea mays
MGGETHLSVQELAASLGALPPEFVRSEQDQPGATTYRGAAVPDAPVIDMSEPGFGARMAAAAREWGLFQVVNHGVPSAAVAELQRVGRAFFALPTEEKERYAMDPASGKIEGYGTKLQRDLEGKKTWNDFFFHVVAPPEKVDHAVWPRSLAGYREANEEYCRHMQRLTRELFEHLSLGLGLHGGAMAEAFGGDGLVFLQKINFYPPCPQPELTLGVAPHTDMSTLTVLVPNEVQGLQVFKDGQWYEAKYVPDALIVHIGDQIEIFSNGAYKAVLHRTTVNKEKTRMSWPMFVEPPGELVVGPHPKLVTEESPAKYKAKKYKDYQHCKINKLPM

SEQ ID NO: 26361 - protein, 416 aa, Triticum aestivum
  misc_feature (12)..(12): Xaa can be any naturally occurring amino acid
  misc_feature (18)..(18): Xaa can be any naturally occurring amino acid
  misc_feature (36)..(36): Xaa can be any naturally occurring amino acid
  misc_feature (399)..(399): Xaa can be any naturally occurring amino acid
  unsure (1)..(416): unsure at all Xaa locations
LPNLPCLLTVQXQWKKGXLLGSGTFGQVYLGFNSEXGQFCAIKEVQVISDDPHSKERLKQLNQEIDMLKKASHPNVVQYYDSDMTDDTLSIYLEYVSGGSIHKLLREYGPFKEPVIRSYTCQILAGLAYLHAKNTVHRDIKGANILVGPNGDVKLADFGMAKHISSFAEIRSFKGSPYWMAPEVIMNSKGYNLAVDIWSLGCTIIEMATARPPWHQYEGVAAIFKIANSKDTPEIPDIFSEDGRSFLKLCLKRNPASRATASQLMDHPFVQDHPAVRAAKDSALRNAFSAPADVKHTMSNRELPSRRSITPLRDIGVSARDFTGFSTTVPSPRTSSPIPVRTNMSLPVSPCSSPLRQFKQSNWSCLPSPPHPMLSSGAAAYNSSSYALNQARRMPDPWXQDGSLKLQSPYGSPKRF

SEQ ID NO: 26362 - protein, 128 aa, Zea mays
VNGGVLFGQGKKADDMGGVGGFDNQGVVVLWGQILKEQEGGFGKLEGTGGGPKHFALAVKEEFPLPPRLIEALEDHVGVPNSRFRGGQKGVAFLGKGPKGGGSGMGRFFFVVALGIFAVIVWFFVKFL

SEQ ID NO: 26363 - protein, 431 aa, Burkholderia cepacia
MAYHSTNPLLSRVVIVGAGQAAAAVAKTLRAEGHRGEIMMLGAERVGPYERPPLSKAWLSAENVPEIAALLEKSEAGQSDVDLRTGVNVTRIDRPSCTVHVDDGSEICFDRLVIATGGRARRLAVPGDASDQIAYLRTIDDALHIRRGLKAGKRLLLIGGGWIGLETACSARKLGVDVVLVEAAQRLCERTVPAIVGERLLGIQRSLGVDVRLGAGIEQLSKLPGGRYAASLSGVREEFDLVVAGVGMVANDELAAEAGLPCAGGVLCDVEGRTVDPHVFACGDVASFEHPSGPIGMRRLESWDNAQQQGAACARAILGKRAAAHPLPWFWSDQGDVNIQILGFPNATATPVVREGDGKATLVWLEEHAADEPAQIVAAVCINAPADMPILRRMWQKGVRVDRKTLAVQEVSLKSLLQRSAGAARNGGANT

SEQ ID NO: 26364 - protein, 286 aa, Dehalococcoides sp. BAV1
MQTIPDALFGIIGYPVSHSVSPAMQNAAFKHCKLNYLYLTIAAKPEDLQNVIASMRPLNIRGLNVTIPHKIEVIKYIDTLDPAAKKIGAVNTIVNENGQMKGYNTDFGGFVRLLEHNRIAPAKHRFALLGAGGSAHAISLAICTLGGHLTVLARQEEKAKDLAAKMCLRFKGKAQGLELNEANLEETLAESDIIVNCTPIGMGNLAGQSLISPRLLRPDLTVIDAIYNPCKTRLLEDAEKKGAKIINGLEMLVWQGAMSFEIWTSQKAPFRVMMKEAEMALDENEK

SEQ ID NO: 26365 - protein, 237 aa, Chlorobium tepidum TLS
MTAIAPTFFDLPVVWHNVLVMLLTIAYVFSVPLLMDWLVTNHGLPRDISRKITHICAGSVIVFLPLFRDGDWSHYLNITVFAVWTVLLIQKGLFAADDDQAVKTMTRTGDKRELLKGPLYFVIVAMICGTLYYKQFAGVLAMAILGWGDGLAPIVGTRMGKMKYKVFCERSVEGSIAFLAGSLAAGLFFVWLIVPQAFNPAKIAMIAVAATVIEALSPKEVDNILIPAEVIALAAVL

SEQ ID NO: 26366 - protein, 513 aa, Pseudomonas fluorescens Pf-5
MTTTPKPLVLMILDGFGHSESHESNAVYAAKKPVLDRLCASMPNGLISGSGMDVGLPDGQMGNSEVGHMNLGAGRVVYQDFTRVTKAIRDGEFFENPTICAAVDKAVDAGKAVHILGLLSDGGVHSHQDHLIAMAELAFKRGAEKIYLHAFLDGRDTPPKSAQSSIELLDETFKTLGKGRIASLIGRYFAMDRDNRWDRVAQAYNLIVDGQGQFNAATAQEGLQAAYAREESDEFVKATTIGEPVKVEDGDAVVFMNFRADRARELTRVFVEDDFKDFERPRQPKLAGFVMLTQYAASIPAPSAFAPGSLENVLGDYLAKNGKTQLRIAETEKYAHVTFFFSGGREEPFPGEERILIPSPKVATYDLQPEMSAPEVTDKIVDAIEHQRYDVIIVNYANGDMVGHSGVFEAAVKAVECLDLCVGRIVDALEKVGGEALITADHGNVEQMSDESTGQAHTAHTTEPVPFIYVGKRALKVREGGVLADVAPTMLKLLGLPKPAEMTGTSILVDPAH

SEQ ID NO: 26367 - protein, 300 aa, Prochlorococcus marinus str. MIT 9211
MKETKFSSITGKTSLVGVIGDPISHSLSPVIQNAALHKMNLDWCYLAIPCKPDNLESIIKCLSKINCKGLNITIPHKTNALKFCNHVSEIATKVGAINTLIPDNDDGWIGTNTDVEGFLKPLGLEKNWESRNAVILGNGGSARAVLLGLEKLKLAEIAIIGRKETSITNLINSLTSPNGNIKGLTQDSLQLNEYIKNADLIINTTPIGMLQTNNTSCIDSEIPFGEKIWDNLKPKTTLYDLIYNPRPTKWLEIGKEKGCIPIDGLEMLIQQGAASLRLWSGIEEIPIDIMRKSAKDHLLN

SEQ ID NO: 26368 - protein, 504 aa, Yarrowia lipolytica CLIB122
MDSDKDLIKRAVGNRAEISMSTTAQKRTIDWVDPHSAASTPRKLQSPRGGRSDLEKDTGIVQQEEAKRVETEQARDQNANKLALDDGSRVPDQGDTPTTTTTTTTTTTRQDKKSVEEGTKKDTAKDTPKDVEQKANSDDKADKNDSINEVNADDKIENKTSHKTHNTDNTDKPDVKTDDTKSDRSDSKPTNGHSKHGSTLSSSRTHSRSNSITSRPSSAKAESRGSSTPARSLSETPSSQPPPTYNTWKYSAKTITKASPSAKDGMPFREELMMRTKGINFLGNVAKLLQLPHMAVYTACTFFHRFYMRHSIKSKHPFEAAAVCIFLATKVEEANRHLRDVCICLVKVAQKDHRAVVDEQSKDFWRWRDCILYGEGYFLEILCFDLTLDSPFEHLSYYVKKLDIHHVKEVCKTAWEFVTDSCKTPLCLMFSTNTIALAAIYWAAKHHKIPIDYHKETKARGKQHWVECFDMTRNEVVYVVETFCDWYSILQRDFGLAASYPKLK

SEQ ID NO: 26369 - protein, 399 aa, Azotobacter vinelandii
MAIDIKAPTFPESIADGTVATWHKKPGEPVKRDELIVDIETDKVVMEVLAEADGVIAEIVKNEGDTVLSGELLGKLTEGGAATAAPAAAPAPAAAAPAAAEAPILSPAARKIAEENAIAADSITGTGKGGRVTKEDAVAAAEAKKSAPAGQPAPAATAAPLFAAGDRVEKRVPMTRLRAKVAERLVEAQSSMAMLTTFNEVNMKPVMELRAKYKDLFEKTHNGVRLGFMSFFVKAAVEALKRQPGVNASIDGNDIVYHGYQDIGVAVSSDRGLVVPVLRNAEFMSLAEIEGGINEFGKKAKAGKLTIEEMTGGTFTISNGGVFGSLLSTPIVNPPQTAILGMHKIQERPMAVNGQVVILPMMYLALSYDHRLIDGKEAVTFLVTMKDLLEDPARLLLDV

SEQ ID NO: 26370 - protein, 185 aa, Glycine max
FGSRIKDFASGEIKQASSLFDCDVQLDEYLIKSYYKTASLIAASTKGAAIFSGSDSSVTEKMYEYGKNLGLSFQVVDDILDFTQSAEQLGKPAGSDLAKGNLTAPVIFALEKEPKLRDIIESEFSEVGSLDEAINLVKSCGGIERAQELAKEKADLAIQSLQCLPQSVFRLALEDMVAYNLQRIA

SEQ ID NO: 26371 - protein, 382 aa, Mycobacterium sp. MCS
MRDHQVVVIGAGPSGVAAALSLRDRGLRPVLIDRADHVGSSWKARYDRLKLNTGRRTSHMPNRPFPDGTGVFPTRDQVVAHLDRHAHEDGIELLLETTVTRIDRHPAGWCLSTSTGDLTARQVVVATGYEHSPRIPEWPGMRSYPGEVSHSAQYRNPRPYTGRRVLVVGAGSSAMEIVHDVATGGAESAWLAVRTVPHIMIRSLPGGFPSDYLATPLFDAPTWLADAVSRVGQRIDVGDLAEYGLPTPSEGVFARGKRLGRAPVIVDREVVRAIRARVFEVVPTIARFDGATVELVDGRRLQPDAVICATGYTRGLDAMVGHLGVLDDKGLPRSCGVAAAAPGLRFVGFLSRPGLISYVAKQSQHVARHIADELDRTPTLIR

SEQ ID NO: 26372 - protein, 134 aa, Schizosaccharomyces pombe 972h-
MVSAWIYFTSLMLTCANIMLQMYFTVMYSDLKDDFINPIDLSRKLNWYVLPEMGFQAFSALLLLLSGAWITFLLNVPMLAWNAKMIMSNTHMHDSTTIFKDVSSRQKRSFFKLACFAVFFFVYLFLFVSRLVDE

SEQ ID NO: 26373 - protein, 455 aa, Schizosaccharomyces pombe 972h-
MDFYNHAANILSDLSKKKGSIKQLAFNSKKHDPKRTYALVCETLKYKPVLDEIIARSDCFLKENLARVLVHDLLMSKRGLSISNGPIKECILRHKTRLNAEFVKLKVKKGVKSHEELALKNPVSLPRWLRINTIKSTKDEVLQGLGLDKVSSIEELGPDKFYIDDCVENLIAIDPSFPIVENSLYKEGKVIIQDKASCFPAAVLAGLTGHVGDIIDGCAAPGNKTTHLAACFPKSHIFAFERDAKRVQTLRKMVGISGANNVTIEHQDFTLTDPKSDLYRNVTHILLDPSCSGSGIVSRQDYLLGNEQDVTEDTERLENLCSFQSTILKHALQFPNCRHVTYSTCSVHRLENEQVVCEVLSQEPDWKCNSLTKTLPNWKTRGIPEYCAQPSMAEGMIRCKPGAGGTIGFFVANLYHPQREQETFKMYKNDDDTKKRKRKKKKKEVKKKARIQGEE

SEQ ID NO: 26374 - protein, 339 aa, Pseudomonas putida
MATTTMTMIQALRSAMDVMLERDDNVVVYGQDVGYFGGVFRCTEGLQTKYGKSRVFDAPISESGIVGTAVGMGAYGLRPVVEIQFADYFYPASDQIVSEMARLRYRSAGEFIAPLTLRMPCGGGIYGGQTHSQSPEAMFTQVCGLRTVMPSNPYDAKGLLIASIECDDPVIFLEPKRLYNGPFDGHHDRPVTPWSKHPHSAVPDGYYTVPLDKAAITRPGNDVSVLTYGTTVYVAQVAAEESGVDAEVIDLRSLWPLDLDTIVESVKKTGRCVVVHEATRTCGFGAELVSLVQEHCFHHLEAPIERVTGWDTPYPHAQEWAYFPGPSRVGAALKKVMEV

SEQ ID NO: 26375 - protein, 380 aa, Gibberella zeae PH-1
MADSLHNAPIVLDNGSGTIRAGFAGDDLPKCFFPSWVGRPKHLRVLAGALEGEVFIGQKAASELRGLLKIRYPLEHGIVTDWDDMERIWEYVYGEGLKTLSEEHPVLLTEPPLNPRSNRDTAAQILFETFNVPALHTSIQAVLSLYASGRTTGIVLDSGDGVSHAVPVYEGFAMPSSIRRIDVAGRDVTEYLQTLLRKSGYVFHTSAEKEVVRLIKESVSYVAHDPRKEERDWVGVKPNDSKVAEYVLPDGYKLKIGAERFRAPEILFDPEIIGLEYPGVHQIVVDAINRTDLDLRKSLYSNIVLSGGSTLTKGFGDRLLTELQKLAVKDMRIKIFAPPERKYSTWIGGSILAGLSTFRKMWVSIDDWHENPDIIHTKFT

SEQ ID NO: 26376 - protein, 312 aa, Schizosaccharomyces pombe 972h-
MEKHQYRDLQLIGQGSFGSVFRAQDVESSKIVALKVVDLDATKDQIETLTQEINFLIDLNSVHITKYYASFVDGFRLWITMEYCDGGSCLDLLKLSGTFSERVIAEVMRQVLEALVYLHGQGKMHRDIKAANILTMKDGLVKLADFGVSGQLESLRDKNDDFVGTPFWMAPEVVKQTGYNYKADIWSLGITAYELATGEPPYSGIHPMKVLLLIPKHSPPSLERSKFSRAFCDFVSNCLKKNPKDRATAEYLSKHKFIKKYCPNTSVKEVVASYAKWKESELLPEATPYNSTMGNSANTIDEVVWDFGTVRR

SEQ ID NO: 26377 - protein, 458 aa, Arabidopsis thaliana
MKNGIAECPACHSKLVSPGSKTISRAYDDHKIRVSSKQRVLNVLLVVGDCMLVGLQPVLVYMSKVDGKFNFSPISVNFLTEIAKVIFAIVMLLIQARHQKVGEKPLLSVSTFVQAARNNVLLAVPALLYAINNYLKFTMQKLWLYGKSMSCGVLSVPLYFNPATVKMLSNLKVLVIAVLLKMVMKRRFSIIQALALLLIGISVNQLRSLPEGATAIGIPLATGAYVCTVIFVTVPSMASVFNEYALKSQYDTSIYLQNLGIVDLFVLFSGLLSSVITNVHNLFLYGYGAIFNFLGILGTVIYKGLQYALLRNFVMILTGPGSFDILQGHSRATMFLILNNAAQGILSSFFFKYADTILKKYSSTVATIFTGIASAALFGHVITMNFLLGISIVFISMHQFFSPLAKARDEQQQNGNLELGNTKDTHRANESFINMAAGANEEASHRGESDDRTPLLPR

SEQ ID NO: 26378 - protein, 520 aa, Mycobacterium smegmatis str. MC2 155
MASESPRPVLVIDYGAQYAQLIARRVREARVYSEVVPHTAGVEEIKAKDPQAIVLSGGPASVYSEGAPQLDPGLFDLDVPVFGICYGFQAMAQALGGTVERTGTSEFGRTELQVTGGDLHSELPATQPVWMSHGDAVTAAPEGFDVVASSAGAPVAGFENRARRLAGVQYHPEVLHSPHGQQVLSRFLHDFAGIDATWTPANIADQLIEAVREQIGDGRAICGLSGGVDSAVAAALVQRAIGDRLTCVFVDHGLLRAGERAQVQRDFVAATGAKLVTVDVADRFLEALTGVTNPEGKRKIIGREFIRAFEGAVRDLVEDEGSGDIDFLVQGTLYPDVVESGGGSGTANIKSHHNVGGLPDDLKFKLVEPLRLLFKDEVRAVGRELGLPEEIVARQPFPGPGLGIRIVGEVTAERLETLRRADAIAREELTAAGLDNQIWQCPVVLLADVRSVGVQGDGRTYGHPIVLRPVSSEDAMTADWTRVPYEVLERISTRITNEVREVNRVVLDITSKPPGTIEWE

SEQ ID NO: 26379 - protein, 378 aa, Arabidopsis thaliana
MSDLPLDLVEEILSRVSATSLKRLRSTCKQWNTLFKKRSFSQKHFHIAPKESMVLMLKEYRVCSMNINLNVSPPSVEFQGTLGIKDDSHSNLGQVEIVEVYHCDGLLLCATRDNRLVVWNPCLGETRWIQLKDECRRYSTFALGYENNKFCRRNYKILRYWGWFHDHIPDDGGRFRFEIYDFRSDSWKVLDDVPDDRFPPVSVVSLKGNTYWFGSNKKDFLRSFDFTTERFNHIGLPPSRDHGFMALSVVGEEQLSVLQEIETSKMEIFVTNKVGTEEAALLWSKSFIVDLPIGGHCSEVFASLLINEEKKVALCCNLDFETDGNLIFTIGEDNKYYSEIPYATNKPWWLCRFSEKFTKKWWWFPFIYNYVPSLVQIL

SEQ ID NO: 26380 - protein, 555 aa, Solanum lycopersicum
MENLLKIIGVILLLSILMIRVFGYLWLRPRKIEKHFAKQGIRGPPYKFFIGNAKEIVSLMLKASSQTMPLSHNILPRVLSFYHHWKKIYGATFLVWFGPTPRLAVADPDLIREIFTTKSEFYEKNEAHPLIKQLEGDGLLSLKGEKWAHHRKIITPTFHMENLKLLVPGAASKVIEMLDKLTPNLKNGEIEIEVSEWFQTLTEDIVAQTAFGHSYEQGKAIFRLQAQQMVLAAEAFQKVFIPGYRFLPTKRNIKSWKLDTEVKKLLMRLIQERTDNWDKNEMQENNGPKDLLGLMIQASIKESLQLSSSINSPIHHNSSTHNHNHNHNNNHNNNPSMITPNDIAEECKTFFFAGEQTTSNLLTWTTVLLAMHPQWQDLARDEVIKVCGSRAIPSKDDLAKLKMLSMILNESLRLYPPIVATIRRAKAMWISEDAKIPLGTEVLIPILAIHHDQAIWGNDANEFNPSRFSEGVARAAKHPVGYIPFGLGVRQCIGQNLAILQTKLTLAIILQRYVLRLSPQYKHAPTVLMLLHPQYGAPVIFKQRLTHDPTFDKSS

SEQ ID NO: 26381 - protein, 80 aa, Glycine max
  misc_feature (17)..(17): Xaa can be any naturally occurring amino acid
  misc_feature (31)..(31): Xaa can be any naturally occurring amino acid
  misc_feature (52)..(52): Xaa can be any naturally occurring amino acid
  misc_feature (57)..(57): Xaa can be any naturally occurring amino acid
  unsure (1)..(80): unsure at all Xaa locations
SQTDTTVNRTDAGAIAXLTGLKSMAGLRTRXTNTDITFIASNCGRTQCMQVXSPIGXKKSETSFYLPDLDDAQLAKEVEY

SEQ ID NO: 26382 - protein, 448 aa, Chlorobium tepidum TLS
MSPQSAEAIIIILLILFEGVLSLAEFAIISSSPARLRELREAGYPSASVALKLQDNAARFLSSIKVTAILITTLTSVLGGLFLAEPLAALFSHLAILEPYSHPLALTVVIASLAYLTHVIGGLLPKKFALRHPEAIAVRIAGFMNKLCTISSPAVLLADASAALLLRAFGIEANEKPQVSDEDVMLMIRQGAKKGVFESVEYEMISRIFRMSDKRASALMTPRNEIEWLDLERPDEELVARIKASGRSRFPVAKGSLDELQGVVRSLDLVNFSLSSKGSIREAIRASMKPPLFVPESVPAFHVLELFKKNRAHMALVIDEHGSVQGAITLTDVLESIVGDVPADDMEGDQKTIVRRSERTWLVDGMVPVDEFLTAFNLDAEKFFEENEPRYDTMGGFMMTRLGEVPSVSDTVKWGGLTFKVIKMNGKRVGRILVEQEAKNAEKKITKL

SEQ ID NO: 26383 - protein, 293 aa, Bartonella quintana str. Toulouse
MIDLTIKCKEKVPSRAFVVGYPIHHSKSPKIHNFWLKQYGLQGEYLAQEVKLEEFSDFLTSTKKRGFCGGNVTLPYKQEAFRLANYKDEVATMIGAANTLWYEGDKLCATNSDAYGFSANLDDSAPNWVGETALIFGAGGAARAILYALKKRGFERICLLNRTRQRADNLAEHFGKPVEVHDWHNVGEILYEADLIVNTTSVGMTDPHGWKTGSLFCDFQKTKTTTLVTDIVYTPLTTPFLQQAKAHGLRTVDGLGMLLHQAVPGFERWFGITPQVTKALRTKILEDMGEERG

SEQ ID NO: 26384 - protein, 140 aa, Chlorobium tepidum TLS
MERTLTILKPDCVRKQLIGAVTNMIERAGFRIVAMKKTRLTKETAGAFYAVHKERPFYGELVEFMSSGPCVPMILEKENAVADFRTLIGATDPAQADEGTIRKLYADSKGENIIHGSDSAENAAIESAFFFAAEEVVRVD

SEQ ID NO: 26385 - protein, 143 aa, Thermoplasma volcanium GSS1
MIEVKEPKRIPFVGMLQGMFTVFKHLFKKPITVQYPEEKAYTPPRFKFRIFLSMDDCVGCTLCEQVCPNLSIRMIVVERNNPHNKRNLYPQVNFGTCTVCRNCEEICPTEAIYLTHELETARTRNNFFYSPQELEKTEEEVKK

SEQ ID NO: 26386 - protein, 285 aa, Prochlorococcus marinus str. NATL2A
MTVSFEKKIKPYPHWEYSNPEFDSSIRIVPERGGLITEWRSEGKELLYFDLERFLDKDKSVRGGIPILFPICGDLSEGYSNGGKKYFLKQHGFARDLPWSINLLKDKLGIRLKLTDTKDSRSYFPFFFTLWMDVCLKEKSLQISIKIHNQSQESMPFSFGLHPYFQVSNTQKIKIDGLPEKCIDQTNMKVTNVSDQIRILDKGVDFLSYPSSSVKMFDFLSRNVIELIHQEPMDTTVIWTDPPRQMVCLEPWTSPRNSLITGDRKLEIKPEEYIDLSTTFQHNSF

SEQ ID NO: 26387 - protein, 369 aa, Thermoplasma volcanium GSS1
MVMEEWTEVNFGPQHPSMHGVLRLKVKLDGEIVKDVEPIIGYLHRNAEKICELQFYCDNMIYFDRMDYVAAMNMEIGYLEAAEKLLDVEPPGRAKWIRVMMGELNRIASHLVWLGAFGLDLGMLTPFFYCFKEREKILKIFTEVSGSRQQLNYMSIGGVYQDVTDEALDHIKQFITEFPKELNMIANLFVKNDIFLSRTKGVGILSKEMAIDYGVTGPMLRASGVEYDVRKAEPYLVYDKVNFDIPVSFKGDNLARFLVRIEEMRQSVKIIDQTIQKLPAGPYFNQKAKKPLMIRLRGQGEVYARTESPKGEFGVYIVGDGSLRPYRVRVRSPTFKNLSVLPALAKGQMIADLISIGGSIDLVFGEVDR

SEQ ID NO: 26388 - protein, 587 aa, Triticum aestivum
  misc_feature (219)..(219): Xaa can be any naturally occurring amino acid
  unsure (1)..(587): unsure at all Xaa locations
MAMVDEPLYPIAVLIDELKNEDIQLRLNSIRRLSTIARALGEERTRKELIPFLSENNDDEDEVLLAMAEELGVFIPYVGGVEHAHVLLPPLETLSTVEETCVRDKAVESLCRIGAQMKKNDIVDYFIAVVKRLAAGEWFTARVSSCGLFHIAYPSATDPLKTELRTIYGQLCQDDMPMVRRAAASNLGKFAATVEQSHLKTEIMSIFDDLTQDDQDSVXLLAVEGCAALGKLLEPQDCVAHILPVIVNFSQDKSWRVRYMVANQLYELCEAVGPEPTRADLVPAYVRLLRDNEAEVRIAAAGKVTKFCRILSPQLAIQHILPCVKELSSDSSQHVRSALASVIMGMAPVLGKDATIEQLLPIFLSLLKDEFPDVRLNIISKLDQVNQVIGIDLLSQSLLPAIVELAEDRHWRVRLAIIEYIPLLASQLGVGFFDDKLGALCMQWLEDKVFSIREAAANNLKRLAEEFGPEWAMQHIIPQVLEKINNPHYLYRMTILQAISLLAPVMGAEITCQKLLPVVINSSKDRVPNIKFNVAKVLQSLVPILDQSVAEKTVKPCLVELSEDPDVDVRYYANQALQACDQIMMSS

SEQ ID NO: 26389 - protein, 234 aa, Streptococcus agalactiae
LAISPFNYPVNLAGSKIAPALIAGNVVALKPPTQGSISGLLLAEAFAEAGIPAGVFNTITGRGSVIGDYIVEHEAVSFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGP

SEQ ID NO: 26390 - protein, 638 aa, Azotobacter vinelandii
MSEIIRVPDIGGDGEVIELLVKTGDLIEVEQGLVVLESAKASMEVPSPKAGVVKSVSVKLGDKLKEGDAIIELEPAAGAAAAPAEAAAVPAAPTQAVDEAEAPSPGASATPAPAAASQEVRVPDIGSAGKARVIEVLVKAGDQVQAEQSLIVLESDKASMEIPSPASGVVESVAIQLNAEVGTGDLILTLRTTGAQAQPTAPAAAAAASPAPAPLAPAAAGPQEVKVPDIGSAGKARVIEVLVKAGDQVQAEQSLIVLESDKASMEIPSPAAGVVESVAVQLNAEVGTGDQILTLRVAGAAPSGPRARGSPGQAAAAPGAAPAPAPVGAPSRNGAKVHAGPAVRQLAREFGVELAAINSTGPRGRILKEDVQAYVKAMMQKAKEAPAAGAASGAGIPPIPPVDFAKYGEIEEVPMTRLMQIGATNLHRSWLNVPHVTQFESADITELEAFRVAQKAVAEKAGVKLTVLPLLLKACAYLLKELPDFNSSLAPSGQALIRKKYVHIGFAVDTPDGLLVPVIRNVDQKSLLQLAAEAAELAEKARSKKLGADAMQGACFTISSLGHIGGTAFTPIVNAPEVAILGVSKASMQPVWDGKAFQPRLMLPLSLSYDHRVINGAAAARFTKRLGDLLADIRAILL

SEQ ID NO: 26391 - protein, 428 aa, Zea mays
MEDEDTGPGDGGEASPPHHVAASSDRARDMVASPTSSRSVTQTVNGSHHFVIQGYSLAKGMGVGKHIASETFTVGGYQWAIYFYPDGKNPEDNSTYVSVFIALASDGTDVRALFELTLLDQSGKGKHKVHSHFDRSLESGPYTLKYRGSMWGYKRFFRRTALEQSDFLKDDCLKINCTVGVVVSTMDYSRPHSIEVPESDIGFHFGTLLDTQEGVDVIFSVAGEKFHAHKLVLAARSPFFRSEFFDHELGEEKNGTDTGDEIKEIVIDDMDPVVFKAVLHFIYRDNLVNDDELSASSSDCSIFDRLSGKLMAAADKYELPRLRLLCESYLCKHISVNSVATTLALADRHHAMELKSVCLKFAAENLSAVIRTEGFDYLKDNCPSLQSEILRTVAGCEEPCSSGLKSQSVWAQLSDGGDTSGRRVRPRV

SEQ ID NO: 26392 - protein, 428 aa, Geobacillus stearothermophilus
MAFEFKLPDIGEGIHEGEIVKWFVKPGDEVNEDDVLCEVQNDKAVVEIPSPVKGKVLEILVPEGTVATVGQTLITLDAPGYENMTFKGQEQEEAKKEEKTETVSKEEKVDAVAPNAPAAEAEAGPNRRVIAMPSVRKYAREKGVDIRLVQGTGKNGRVLKEDIDAFLAGGAKPAPAAAEEKAAPAAAKPATTEGEFPETREKMSGIRRAIAKAMVHSKHTAPHVTLMDEADVTKLVAHRKKFKAIAAEKGIKLTFLPYVVKALVSALREYPVLNTSIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLMEA

SEQ ID NO: 26393 - protein, 374 aa, Methanosarcina acetivorans C2A
MEEMLEPNEMIVHLGPQHPMQPGPFRLNLRLKGETVMDAEVELGFIHKGIEKILENKTYLQGITIVDRICYLVALTNEECFVGCTEKLLGIEPPERAQYIRVILEELSRLQSHLLGMGEFGEFIGFVSMFMYTIKEREDILTLIDMVTGARVTHSYLKFGGVRDDLPEGFKEKALPVLNNLKKVISDYEEMFNSDRIYRERTVGVGVLTADVAKNLGVSGPPLRATGVPFDIRKNEPYLVYKDLDFKVCTETAGDCFARVQVRLNEMRESIYILEQCLDQIPNGPLFPEGTPYGRRTPVMRVPAGEVFHRVEDPRGEMGMYMISDGSDKPYRVKVRGPYYPTLQALPPLIKGTTVADVAAISGSMDGCTSEADR

SEQ ID NO: 26394 - protein, 230 aa, Oryza sativa (indica cultivar-group)
MGSGSGSFLKVVVKNLDVLAGPIVSLAYPLYASVRAIETKSAVDDQQWLTYWVLYSFITLFELTFSPVLEWLPLWSYAKLFFNCWLVLPYFNGAAHVYEHFVRPLVVNQQIVNIWYIPRKDESDRPDDVISAAQRYIEQNGSQAFESLVNKFKASNTRRSILEEVEAERRAKAELEAEARDENPFFNQNYRVHRIKFMLMGYVFKRSWISVNRFKDSSILATLVDAGFLP

SEQ ID NO: 26395 - protein, 234 aa, Bacillus cereus
LAIAPFNYPVNLFAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVGLLKEQVAKLSVGSPEQDSTIVPLIDDKSADFVQGLVDDAVEKGATIVIGNKRERNLIYPTLIDHVTTDMRLAWEEPFAP

SEQ ID NO: 26396 - protein, 136 aa, Methanosarcina acetivorans C2A
MVLKNIKYAVKNIPKKRVTRLCPEVESPLSDRFRGLQILDKSKCIGCGICANTCPNNAIKIVKAPIAPGSSKQRWFPEIDIGHCLFCGLCIDQCPKGALSSGKEYTKGMVKWAHKDLLMTPEKLAREVDIKEGDEK

SEQ ID NO: 26397 - protein, 286 aa, Oryza sativa (indica cultivar-group)
MASGRYMAYSPSPSTTPHSPRIPGLRAASSAVADQEKYLAELLAERHKLSPFIPVLPNSVRLLNQEILRVSTLLENASLLNQSGLEHGSPLTTGGLYSNGAAADMNGWTSAFQSEGSPAYSWRGGSQGSSSGLIVKKTMKVDIPVDKYPTFNFVGRILGPRGNSLKRVEATTDCRVLIRGRGSIKDPAREDMMRGKPGYEHLNEPLHILVEAELPVEIIDTRLIQARDILEDLLKPVDESQDFFKKQQLRELAMLNGTLREEGMQRSGSASPFHNSLGMKRAKTRG

SEQ ID NO: 26398 - protein, 289 aa, Zea mays
MSDLHPPEHQVAGHRASASKLGPLIDGSGLFYKPLQAGDRGEHEVAFYEAFSAHAAVPARIRDTFFPRFHGTRLLPTEAQPGEPHPHLVLDDLLAGFQAPCVADIKIGAITWPPSSPEPYIAKCLAKDRGTTSVLLGFRVSGVRVVGPEGAVWRTERPEVKAMDTAGVRRVLRRYVSSVADEGMDCALAAAVYGGKGGVLSQLRELKAWFEEQTLFHFYSASILLGYDAAAVAAGGDGGGVTVKLVDFAHVAEGDGVIDHNFLGGLCSLIKFVSDIVPETPHTQPLGPS

SEQ ID NO: 26399 - protein, 165 aa, Cichorium intybus x Cichorium endivia
MSFSEEQEALVKEAWEIMKEDIPALSLYFFTQVLEIAPAAKGLFSFLKDAEEIPQDNPKLKSHAVKVFKMTCEAIQLREKGEVVVSGSTLKYLGSVHLQKGVIDAHFAVVKEGVLRTVEKGVGEKWSEEMKGAWSEAYDQLAAAIITEMKKEATEMDEEAEETQT

SEQ ID NO: 26400 - protein, 635 aa, Glycine max
  misc_feature (260)..(260): Xaa can be any naturally occurring amino acid
  unsure (1)..(635): unsure at all Xaa locations
FHVKLSILTIHICFPSGSGFIDWLCEESLGATLNANFQDSYGCCIFFCEEELVSIMFSERLGADESHCQDLQSLSVSKRLVRSVSQKWRKKSNRNSGEEADDVNGVSLRCLNLYGRGGGCKVGADTGDDFGDSSSRRRSSASDEGKGYKPICGPEETAVDCFSYGVKDRFWRRHNRKNSELEELFTNNRMHIFLPDDILEMCLVRLPLTSLMNARLVCKKWRSLTTTPRFLHMRREGSYQSPWLFLFGAVKDGFCSGEIXHALDVSLNQWHRIDAHFLRGRFLFSVAGIQDDIFIVGGCSSLTNFGKVDRSSFNTHKGVLAFSPLTKSWRKMPSMKYARSNPILGVSEVSLDFPTCQSHQSRQDRRFPRSRIGGVSDVYEDPHKLSMRRHCRPAFNETEALSLPSRKTYKFLRQKSEHSSSKGSKRFLLIAVGGLGSWDEPLDSGEIYDSVSNKWTEIPRLPFDFGVARSGIVCGRMFYVYSETDKLAAYDIERGFWIAIQATPIPPRVHGYYPKLVSSDGRLFMLSVSWCEGDGQIGRRNKAVRKLWELDLMYLTWTEASVHPDAPMDWNAVFVSDKSLIFGVEMFKIIGRVLGFFTVCDVSDMANWNHISRDHVTHELDVSSCLTKSVAVLHL

SEQ ID NO: 26401 - protein, 468 aa, Pseudomonas fluorescens Pf-5
MSKSVQLIKDHDVKWIDLRFTDTKGTQHHVTMPARDALDEDFFEAGKMFDGSSIAGWKGIEASDMILMPDDETAVLDPFTEEPTLILVCDIIEPSSMQGYDRDPRAIAKRAEEHLKATGIGDTVFAGPEPEFFIFDQVKFKSDISGSMFKIYSEQGSWMSDQDIEGGNKGHRPGVKGGYFPVPPFDHDHEIRTSMCNALEEMGLTVEVHHHEVATAGQNEIGVKFNTLVKKADETQTLKYVVHNVADAYGRTATFMPKPLYGDNGSGMHVHMSIWKDGKNTFAGEGYAGLSDTALYFIGGIIKHGKALNGFTNPATNSYKRLVPGFEAPVMLAYSARNRSASIRIPYVSSPKARRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIKVRTFVHPLEYELYYSC

SEQ ID NO: 26402 - protein, 474 aa, Propionibacterium acnes KPA171202
MDGELKRGLSSRHMNMIAIGGAIGTGLFVASGATISQAGPGGALVAYFAMGLMVFLLMQSLGEMSSYLPVPGAFETYATRFVSPSFGFALGWNYWFNWAITVAAELAAASIVMAYWWPGVPAWMWSVGFLALLFLLNVLSARAYGESEFWFAIIKVTAVIVFLVLGILMIAGVMGTSPGLSHWRRGDAPFVHGFGGILTVFLIAGFSFQGTELIGIAAGESKDPRMTIPKATRQIFWRIMIFYIGAIAVIGLLLPYTDPHLLAGEVTDVAVSPFTLVLKRAGVAAAAAVMNAVILTSVLSAGNSGLYASTRMLYALAREGKAPRILGRTSRRGVPVPALIVTTLVGAACFATSLVGSGQAYTWLVNISGLCGFIAWIGIAICHIQFRRAFQAQGHDLSELPYRARWYPAGPIVAGVLCVIVTLGQGRDAVLSGDVTDMIVAYISIPVFLALWVGHKIVTKAPHADLSTADLHHD

SEQ ID NO: 26403 - protein, 336 aa, Pseudomonas fluorescens Pf-5
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTQQVAAGYAIYGPQTMLVLTLGDGVKGFTLDREMGSFVLTHEDIKIPESTQEFAINMSNERHWEAPVKRYVEELLAGDTGPLKKNYNMRWVAAMVADVHRILTRGGLFMYPRDSREPEKPGKLRLMYEANPMSFLVEQAGGASTDGHKRILDIQPEGLHQRVAVFLGSKEEVARVTGYHKE

SEQ ID NO: 26404 - protein, 234 aa, Bacillus licheniformis
LAIPPLNYPVNLFAAKLAPALIMGSAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVSLLKAQVAELSVGSPEQDSTIVPLIDDKSADFVQGLVDDAVEKGATIVIGNKRERNLIYPTLIDHVTTDMRLAWEEPFGP

SEQ ID NO: 26405 - protein, 178 aa, Triticum aestivum
  misc_feature (83)..(84): Xaa can be any naturally occurring amino acid
  misc_feature (100)..(101): Xaa can be any naturally occurring amino acid
  misc_feature (109)..(109): Xaa can be any naturally occurring amino acid
  misc_feature (125)..(125): Xaa can be any naturally occurring amino acid
  misc_feature (163)..(163): Xaa can be any naturally occurring amino acid
  unsure (1)..(178): unsure at all Xaa locations
TLEQVCTKKQAGTGPEFPGYRRPTRPGNLNCHEPVGADDTTTLYKIIDSLTSIANAHRGDPNAAEISLKIGRVSECGIDDSMXXSRDEGFILGAGRVWRXXAEFLTSYXNIDPVHGGVASLYQKXCRKNSDRIKNGTAAQLDGSDNESLPIFGSKLKVVNHLXPGSFMGAPGRIFLKL

SEQ ID NO: 26406 - protein, 290 aa, Prochlorococcus marinus str. MIT 9211
MLKHRLLSKIFSTWIDEYQEDARFGLKGKIIIDEESEFQKITLIESKRYGKALLLNNCWMTAEHQEKQYHECLVHPALSSAEKIYKILIIGGGDGGTARECLKYREVQQIDLIEIDRRVVELSQKHLPEIGGNAWKDERLNLQIANGINWVAQSQDNSYDVVIIDGADPEGPSEGLFNKAFFEDCRRILKDGGIFSTQSESAEAFHAIHIDMVKIIREVFDYASPLYGNVPIYPSGWWSWTFASMKKPRYLKPIPNRVNEILQSCEIWSPRWQSGAFNSIPAFLERALNQ

SEQ ID NO: 26407 - protein, 234 aa, Clostridium acetobutylicum
LAISPFNYPVNLSGSKVAPALIAGNSVVLKPSTTGAISALHLAEIFNAAGLPAGVLNTVTGKGSEIGDYLITHEEVNFINFTGSSAVGKHISKIAGMIPMVLELGGKDAAIVLEDANLETTAKSIVSGAYGYSGQRCTAVKRVLVMDKVADELVELVTKKVKELKVGNPFDDVTITPLIDNKAADYVQTLIDDAIEKGATLIVGNKRKENLMYPTLFDNVTADMRIAWEEPFGP

SEQ ID NO: 26408 - protein, 670 aa, Prochlorococcus marinus str. NATL2A
MVALTTSLDTLCVNSIRMLAVDAINKSKSGHPGLPMGCAPMGYALWDKHLRHNPKNPKWFNRDRFVLSAGHGCMLLYALLHLTGYDSVTIEDIKEFRQWGAKTPGHPETFETPGVEVTAGPLGAGISNAVGLAIAEAHLGAKFNKPDSTVVDHYTYVIMGDGCNQEGISSEACSLAGHLKLGKLIALYDDNHITIDGRTDVSFTEDVLKRYEAYGWHVQEISEGNTDVEGISQAIEKAKSVTDKPSIIKVTTTIGYGSPNKSDTAGIHGAPLGEEEAELTRKQLGWSYKPFEVPQDAYDQYRQAIQKGAQLEEEWNQSLATYKEKYPNEASQFERMLRGELPEGWDKDLPTYTSDDQGVATRKHSQICLGALGPNIPELIGGSADLTHSNYTDIKGETGSFQYESPEKRYLHFGVREHAMAAILNGIAYHDSGLIPYGGTFLVFADYMRGSMRLSALSELGVIYVLTHDSIGVGEDGPTHQPIETIPSLRAMPNMMVFRPGDGNETSGAYKVAIKNRKRPSSLCLSRQGMANQQNSSVDKVALGGYVLEECDGTPELILIGTGTELDLCVQAAKKLTKEGRKVRVVSMPCVELFEEQSDSYKEEVLPSNIRKRLVVEAAESFGWHKYIGLDGDSVTMNSFGASAPGGLCMEKFGFTVENVLEKSRSLLNK

SEQ ID NO: 26409 - protein, 303 aa, Symplocarpus foetidus
MGDHGPRTEISFAGSSRAAFAACFAELCTIPLDTAKVRLQLQKKAVTGDVVALPKYRGMLGTVATIAREEGLSALWKGIVPGLHRQCLFGGLRIGLYEPVKSFYVGDNFVGDIPLSKKILAGLTTGALAIIVANPTDLVKVRLQSEGKLPPGVPRRYSGALNAYSTIVKKEGLGALWTGLGPNIARNAIINAAELASYDQVKQTILKLPGFSDNIFTHILAGLGAGFFAVCIGSPVDVMKSRMMGDSAYKSTFDCFIKTLKNDGLLAFYKGFIPNFGRLGSWNVIMFLTLEQVKKFFIKEVPN

SEQ ID NO: 26410 - protein, 466 aa, Prochlorococcus marinus str. NATL2A
MRNSWVASRKGKTNVSQMHFARKGEITEEMRYVAKRENLPESLVMEEVARGRMVIPANINHMNLEPMAIGIASTCKVNANIGASPNASDISEELKKLDLAVKYGADTLMDLSTGGVNLDEVRTEIINASPIPIGTVPVYQALESVHGSISRLNEDDFLHIIEKHCQQGVDYQTIHAGLLIEHLPKVKGRITGIVSRGGGILAQWMLYHYKQNPLFTRFDDICEIFKRYDCTFSLGDSLRPGCLHDASDEAQLAELKTLGELTRRAWKHDVQVMVEGPGHVPMDQIEFNVRKQMEECSEAPFYVLGPLVTDISPGYDHISSAIGAAMAGWYGTAMLCYVTPKEHLGLPNPEDVREGLIAYKIAAHAADVARHRSGARDRDDELSKARKEFDWNKQFELSLDPERAKQYHDETLPEEIFKKAEFCSMCGPNHCPMNTKITDEDLDKLNDQIQSKGAAELTPVKLNKEN

SEQ ID NO: 26411 - protein, 236 aa, Clostridium perfringens
LAIPPFNYPVNLSASKIAPAIVAGNSVVLKPATQGSLSALFLAKMFHDAGLPGGVLNTVTGRGSEIGDYCVTHDKIDFINFTGSTEVGRRISEITVMKPLLMELGGKDAAIVLEDADLDLTVNNIIAGGYSYSGQRCTAVKRILVMNSVADKLVEKLKEKISKLKMGNPLEVEDVTIVPLIDNKAADFVMELIDDAKEKGATLVCGGHREGNLIEATLFDDVTTDMRLAWEEPFGP

SEQ ID NO: 26412 - protein, 460 aa, Azoarcus sp. BH72
MTTDALLDLDRKHLIHPVAAWRGHEQRGTTVLASGHDGVWLRDIHGKEVLDAFAGLWCVNIGYGHESVVQAAAEQMRKLPYATGYFGFGSEPAIRLAAKLAEIAPKSLRHTYLTLGGSEAVDAAIRLITHYYNATGRPQKKHFIAIERGYHGSSSVGSGLTALPAFHRGFDVPLPNQHYIASPYPYRSPVGDDPQAVIAASVAALRAKVAELGADNVAAFFCEPVQGSGGVIVPPKGWLKAMREASRELGILFVVDEVITGFGRTGPMFACLAEDVEPDLMTMAKGLTSGYVPMGALMISDEVYNGIADGAAPNVLVGHGATYSGHPVSAAVALEVIRLYEEGGILAHAQAMEPGFAAGLGEMLDHPLVGDVRHRGLLGAVELVADKASKRAFDPALGLADRLFRSGYQNGLIFRSFGDHILGFAPALCFTEDNFAQLFARLKRTLDEVLDAPDVRRALA

SEQ ID NO: 26413 - protein, 268 aa, Symplocarpus foetidus
MGDHGPRTEISFAGSSRAAFAACFAELCTIPLDTAKVRLQLQKKAVTGDVVALPKYRGMLGTVATIAREEGLSALWKGIVPGLHRQCLFGGLRIGLYEPVKSFYVGDNFVGDIPLSKKILAGLTTGALAIIVANPTDLVKVRLQSEGKLPPGVPRRYSGALNAYSTIVKKEGLGALWTGLGPNIARNAIINAAELASYDQVKQMKSRMMGDSAYKSTFDCFIKTLKNDGPLAFYKGFIPNFGRLGSWNVIMFLTLEQVKKFFIKEVPN

SEQ ID NO: 26414 - protein, 294 aa, Ashbya gossypii ATCC 10895
MCFSQSGRLSAQAADTMRSIKCVVIGDGAVGKTSLLISYTTNSFPQDYIPTVFDNYSTTIAVQDPASSTGEQQLFKLNLWDTAGQEEYDRLRPLSYPQTDIFLICFSINEPVSFQNIRDKWFPEIKHNTNYENMELFLECGKYPILLVGTKADLRDDDHEEDRLREMNTDFVSQAEIERVVQDCGFMGYVECSAATQEGVREVFERAVKYVVYEPDRLMNRSKNMSILVNSPLPLDSYANEDASNPKNKGGDPSAGSGPLKKAVGDDGAHGKELRVSADKLKKKRRKRSRCTIL

SEQ ID NO: 26415 - protein, 235 aa, Clostridium pasteurianum
LAIPPFNYPNVLSASKIAPALMAGNSVVLKPATQGSLCGLFLARVFEKAGVPAGVLNTVTGKGSEIGDYVTTHKEINFINFTGSTEIGARISKMTSMVPLLMELGGKDAAIVLEDADLELSANNIVAGAYSYSGQRCTAVKRVLVVDKVADKLVEKIKENIAKLTVGNPLEKDADVVPLISSKAADFVYVLIEDAKGKGADLVVGGNRDDNLIYPTLIDNVTPDMRLAWEEPFGP

SEQ ID NO: 26416 - protein, 408 aa, Triticum aestivum
MPVTDYQGASASPSPFSFGSLLSLRRDHTAMASGEEADLEVFQRHLAANLGDLLPAEAAEGVPAQEEILSVAWIRRLLEAFILCQEEFRVVLAQARRRGALPAAAERLVAEFHERAVKALDVCNAARDGVDQVRRLERLADIAASVLLAPGEIHEGQLRRARKAVSDLSVLLVDDTTAAASGGVASFLASHRNRSFGRARASPSRGSATGSSAASSASHFRSLSWSVSRAWSASRQLQAIGAGLTAPRAHEGGLVAPVYAMGCILHFTAWALVAAVPCPDRSSALLAHHLPVAPARAAFPWAPPLLTLQERLAEEGKRKERRSCCGLLKEIYVLEKATQKLADAIDAAPIPLFGDREADLREAAAELSAVCAAMREGLEPLEKQVREVFHRIVRSRVEGLDSSMHNAD

SEQ ID NO: 26417 - protein, 525 aa, Mycoplasma gallisepticum R
MVHLTNRNKVHSLHFIFLFIYLNYINNFNSMSNSECIKKKVCNASSYDFKDKYHHLKGLINNQEVGSSKLIEIKSPIDHELSGSFYGMTAEEIDDAYEKADIAFKSWSKAGYEYRKAKILKFAQLLDAHKEEFANLLTDNIAKAYNESLAEVTRSIQYIHDTISVYEEMITHPLVMDEKIHRVKEKVGKFVREPLGVALNISPWNYPLNTPLSKMIPTLIAGNTVVYKVATQAAIIGIRLAHLFKQAGFDPGVVQCVVGLGREIGDKLNTNKHIKSISFTGSTPVGLSLLKQSAVGNISLELGGKDAALVLSDYDKQKTIKEIVKGAYSYSGQRCTAIKRVFVKNEDADEFVQLLKKEVEKLHLGNPFNNPSLVPVIDQHAANFIKELFDDAVTKKAIVLTGGDFEKNCVEAILLDHVTTDMRVAWEEPFGPILPIIRVKNEAEMVKLHNQSEYGLQASIFTSDQTKFDELANQLEAGTINWNRSSSRGPDFFPFMGVKDSGVGVQGIRDTILSVTRYKGFVYNR

SEQ ID NO: 26418 - protein, 236 aa, Clostridium sporogenes
LAIPPFNYPVNLSASKIAPAIVAGNSVVLKPATQGSLSALFLAKMFHDAGLPGGVLNTVTGRGSEIGDYCVTHDKIDFINFTGSTEVGRRISEITVMKPLLMELGGKDAAIVLEDADLDLTVNNIIAGGYSYSGQRCTAVKRILVMNSVADKLVEKLKEKISKLKMGNPLEVEDVTIVPLIDNKAADFVMELIDDAKEKGATLVCGGHREGNLIEATLFDNVLRDMRIAWEEPFGP

SEQ ID NO: 26419 - protein, 325 aa, Geobacillus stearothermophilus
MAQMTMVQAITDALRIELKNDPNVLIFGEDVGVNGGVFRATEGLQAEFGEDRVFDTPLAESGIGGLAIGLALQGFRPVPEIQFFGFVYEVMDSICGQMARIRYRTGGRYHMPITIRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVMNF

SEQ ID NO: 26420 - protein, 399 aa, Oryza sativa (indica cultivar-group)
MGAAMLLAPMPLLLLASTPLAAVHLPARCRLRLQLLSRAAPEAASATTTTTTAPDNHFSVEEYLISNCNLTQPQAHKASKSIAHLKSRSNPDAVLAFLADFGLSPKEVAAIVASNPRILCARIDRSLAPICSELRAVGLSPSQIARLAQITGRYFLCRSFVSKVRFWLPLFGSSERLLQASDWNYWLLTSDLEKVVEPNVSFLKECGLSAHDISKLLVAAPRLVTMHPDYVKDAVRRAIQLGVAPGSQMFRHALSTAGCIGQDKIDAKVAVLKESLGWSQEEVNLAVSKAPRILVASEERLRRNAEFLIDEVGLQPQYVARRSVLLMYSLERRLVPRHLVVKLLKERGLIEQDRCFFNAVAPTEEKFLEKFVVPFEGCVPGLADAYESACAGKTPVQAE

SEQ ID NO: 26421 - protein, 382 aa, Oryza sativa (indica cultivar-group)
MQRLQKQLLPALRAAFPLPASHFSSRLLSASTATLSPTRFVDEDALVAACGLTGAEALKASKRLQKVPSNLDAALTFLAFLADFRLSKDDIAAASSRYPRFLHLKVDETLTSQVARLRDIGLSTPEIGRLITIAPCILSNPRTISRLEFYLSFLGSYPRVHSALRNNSSLLRRNNIESEVKPNIAFLEQCGLTTCDIAKILMSGSRILIMQPEHVKEIVACADKFGMPRESAGFRYALMAVTGISPVRVSAKLDFLRMVIGCSDAQLHIAVSRFPLILTYSEVKLSRSLEFLKAEVGLEPQYIVLRPALLSHSIQKRLMPRYHVMKVLNEKGLLKKDTDFYSMVKIVEESFFKKFLLPYHRSVPGLEKAYLAAREGKMFPEI

SEQ ID NO: 26422 - protein, 446 aa, Mycobacterium smegmatis str. MC2 155
MSHPEQSRHLATAIPGPRSQALIDRKGTAVARGVGTTMPVYAVRAGGGIVEDVDGNRLIDLGSGIAVTTVGNSAPKVVEAVRSQVGDFTHTCFMVTPYEGYVAVCEQLNRLTPVRGDKRSALFNSGSEAVENAVKIARSHTHKPAVVAFDHAYHGRTNLTMALTAKVMPYKDGFGPFAPEIYRAPLSYPFRDAEFGKELATDGELAAKRAITVIDKQIGADNLAAVVIEPIQGEGGFIVPADGFLPTLLDWCRKNDVVFIADEVQTGFARTGAMFACEHEGIDPDLIVTAKGIAGGLPLSAVTGRAEIMDSPHVSGLGGTYGGNPIACAAALATIETIESEGLVARAQQIEKIMKDRLGRLQAEDDRIGDVRGRGAMIAMELVKAGTTEPDADLTKALCAGAHAAGVIVLSCGTYGNVVRFLPPLSIGDDLLNEGLDVLEEVLRGA

SEQ ID NO: 26423 - protein, 484 aa, Prochlorococcus marinus str. AS9601
MRADKLDKIKFGTDGWRGIIGFDFNLSNLSRVVVAACQELHYQYYKEVNSKKIIIGYDRRFMACEFAKQIVPFVRGCGFEPILSDGFVTTPSCSFYAKEVGCLGALVITASHNPYNWLGLKIKSLNGCSVDESFTREVEKRLMLGNSIEKIDGITQLVDIKKFHLDRIKSLFDINYISKRLKKMKLKIFVDSMHGSAANCMAEIFASNDLEVISEIRKDADPFFGGKPPEPLLNYADDLKQTLMKNSTNEVKTLGIIFDGDGDRIAAIDEKGRYSSTQDLLPYFIKYLGEIKNNSYPVLKTVSGSDIIKNISESQNRDVFELPVGFKYIAEKMIKGKIFIGGEESGGVGFGDFMPERDALYAAMVLLNGIAEKSQYLYETLDEIQEDFGPSFYKRIDIKFPNQSEKNNVKEFIIDNIPENINNHKLKSISKIDGIKLRIDKNFWLLFRFSGTEPLLRLYCEAPKESYLIEVLEWGQEFINLARK

SEQ ID NO: 26424 - protein, 521 aa, Schizosaccharomyces pombe 972h-
MSSQSYYMNDLDDLRSLESSTLNKKDTAINELNPEQNDTRRSTDLLLEDKYGIQTGFSKYWKKCTYGIREYCKFIGPGFLIAVAYIDPGNYSTDLDAGSRFQYKLLFIVFLSNLFAVYLQSLCIRLGSVTGMDLARNCREHYNRYICWSFYVLAEIAIIATDIAEVIGTAVALKILMHIPLVAGVVITILDVLLVLIAWRPEGSMLSVRIFETAVALLVLVVAISFAVVLGRVHIGGAGTVFKGFLPSSTVFSREGLYSSIGILGATVMPHSLFLGSGLVQTRLRDLDVRRGNYTPVGDCSDYRPTHETIKHSLTYSIVEVALSLFTFALFTNSSILIVAGAVFYNTSGADTSDLFSIYDLLKEYVSISCGRLFAVALLFSGMSAGYVCTIAGQIVSEGYINWNLRPWLRRVITRAIAIIPCLVVSAAVGQSGLNQVLNASQVCLSILLPFLTFPLVMFTCSRKVMRVVSDSTNEETGQLIRETHDYSLGWTMTIVTWAIWLFLTALNLLLIVWLGMGVSF

SEQ ID NO: 26425 - protein, 488 aa, Athyrium yokoscense
MAVASVYKRVLPCPPAIEFASQEGKVLFAEALSDGTMNGFFRLISTFQTQAEPAYCGLSTLTVVLNALSIDPGRKWKGPWRWFDESMLDCCEPLEKVKKNGITFTKVTCLAQCSGASVQAFRANQSSLDLFRSFVETCVSSDDHHLIVSYDRRPLKQTGTGHFSPLGGYHRQKDMALILDVARFKYPPHWVPLSLLWDAMNTIDEATGKSRGFMMIYKREIPACFLFTLSCKDERWRAMCKHILEEVPELLKTTNLTSTGQVIHTVFDSLPADIASFVKWIVEVKLAEDEVDRDETERLHYKSKVLQQLRQTTVFALITKWVEENCVKSSVNESLPNVIMQACCQGAAAFTGIKCSSNITCIKKEGEAEVRLNEDRGDTVVLSNKLLVDGCEQVIDALVPKISTLNTVGGPCQSSLEEDSFHPTTRDLLAILLLALPTSMWEDIPNREVHSEICRIVSREELPFELRLEVEHLWEQANLVSRSCSEET

SEQ ID NO: 26426 - protein, 337 aa, Spinacia oleracea
KLKVAINGFGRIGRNFLRCWHGRKDSPLDVVVINDAGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPNLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQA

SEQ ID NO: 26427 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQTVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 26428 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIVGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 26429 - protein, 418 aa, Chlorobium tepidum TLS
MAGLTKENPFDIARRQLDAAAGIIGLDAEVLELLRWPMREMHVTIPVKMDDGAVRAFHGFRVQYNDARGPNKGGIRFHPDETIDTVRALAAWMTWKTAVMDIPLGGAKGGVICNPKTMSPGELERLSRSYIRQVGRLLDLEKDVPAPDVYTTPQIMAWMADEYSFMQGHNDFGVITGKPLALGGSLGRGDATARGGIICIREAAKMLGINLRGKPAAINGFGNAGAFAHKLAVELLGMKVVAVSDSKGSIYNPDGFDHQALMEYKKQHGSVADFPGSTPLTDAGLLELDVTVLIPAALEDEISCRNARNIQAKIVAELANGPTTPEADKILHERGVYLIPDLLCNAGGVTVSYFEMVQNASGWYWEEEVVHRQLEKKMAAAIKAVHQAAVQYSVDNRTAAMIVAIRRVAEAMKLRGWV

SEQ ID NO: 26430 - protein, 486 aa, Zea mays
  misc_feature (398)..(398): Xaa can be any naturally occurring amino acid
  unsure (1)..(486): unsure at all Xaa locations
MAAANLLSRSLLPTPNTIRTSHPTPRSPAVVSFPRRRARLSVCASVSMASPSPPPQPAAAGVPKHCFRRGADGYLYCEGVRVEDAMAAAERSPFYLYSKLQILRNFAAYRDALQGLRSIVGYAVKANNNLPVLRVLRELGCGAVLVSGNELRLALQAGFDPARCIFNGNGKTLEDLKLAAESGVFVNVDSEFDLENIVRAARATGKKVPVLLRINPDVDPQVHPYVATGNKTSKFGIRNEKLQWFLNSIKSYSNEIKLVGVHCHLGSTITKVDIFRDAAVLMVNYVDEIRAQGFKLEYLNIGGGLGIDYHHTDAVLPTPMDLINTVRELVLSQDLTLIIEPGRSLIANTCCFVNRVTGVKSNGTKNFIVVDGSMAELIRPSLYGAYQHIELVSPPTPXAEVATFDIVGPVCESADFLGKDRELPTPDEGAGLVVHDAGAYCMSMASTYNLKLRPPEYWVEEDGSIVKIRHEEKLDDYMKFFDGLPA

SEQ ID NO: 26431 - protein, 286 aa, Arabidopsis thaliana
MAMEIGEDEWKVCCGSSEFAKQMSTSGPLTSQEAIYTARDIWFNQVNVTDWLEAFSAHPQIGNTPSPSINSDFARRSVSEQSTAFATTSASALQELAEWNVLYKKKFGFIFIICASGRTHAEMLHALKERYENRPIVELEIAAMEQMKITELRMAKLFSDKAKVISETDSSSSPVSTKPQAAGVEVHLEVWSGTTGPSFVHGGGGVWSSVGTSATDRDGRSGPLMDLVDALNPGTYRISFDTAKYSPGCFFPYVSIVFQVTESQKWEHFHVPLLLAPFSFSTYRGS

SEQ ID NO: 26432 - protein, 221 aa, Oryza sativa (indica cultivar-group)
MRGVGGPLLTIGDLLSDFAVDGGADLAGGEVSVPSSPSSAGQQAEEADPSELNRLFGVRAPFLFFPLLPVPRFGRHQSIDSSYHMRFSSLIMRPSCNWFDFLSYLLGADVLQIDRVCCKIQIKSIVQMNDLQEHYDNLMKALQENDPSWPSLMLKLCTALKTADKLVSCASTDAEQLLQKVELLERLLVRGDRAVTAIVEELQRSRPSEDSHSSKSKPSGK

SEQ ID NO: 26433 - protein, 234 aa, Bacillus thuringiensis
LAIPPINYPVNLSAAKLAPALIMGNAVIFKPATQGAISGIKMVEALHKAGLPKGLVNVATGRGSVIGDYLVEHEGVNMVSFTGGTNTGKHLAKKASMIPLVLELGGKDPGIVREDADLQDAANHIVSGAFSYSGQRCTAIKRVLVHENVADELVSLLKAQVAELSVGSPEQDSTIVPLIDDKSADFVQGLVDDAVEKGATIVIGNKRERNLIYPTLIDHVTKEMKVAWEEPFGP

SEQ ID NO: 26434 - protein, 429 aa, Magnetococcus sp. MC-1
MSSIVEIHGREVIDSRGNPTVEVDVYTEDGGFGRAAVPSGASTGSREAVELRDGDKSRFLGKGVRKAVDAVNTVLAEVVLGMEVADQKGIDAAMIALDGTHNKSRLGANAILGISMAVAKAAADECDLPLYRYLGGTNTSLLPVPMMNIINGGAHADNNVDIQEFMIMPVAATSCTEAIRMGAEVFHSLKKVLKSKGLNTAVGDEGGFAPNLGSNEEALKVIVEAIEAAGYKPGEDIKLALDCASSEFYNKETGNYDLTGEGRVLTKQELVAFYEDLVAKYPIISIEDGFDESDWDGWKLMTEALGNKIQLVGDDLFVTNSKILAEGISKGIANSILVKVNQIGTLTETFEAVEMAQRAGYTAVISHRSGETEDATIADIAVALNAGQIKTGSMSRSDRIAKYNQLIRIEEELGGMARFEGMKVFYNLR

SEQ ID NO: 26435 - protein, 215 aa, Gibberella zeae PH-1
MSAQDPLSSTNPSSVTNNTQDASGRQPSSAAAGSSELSSAKISLRKSLRSFPDFPIPGINFVDIMPLFADPTAHATLVEALELQIAEAFPTKPDVIVGLDARGFLFGPGLALRLGVPFAAVRKQGKLPGPCVTAEYIKEYGKDLFQMQEDAVREGQKVLIVDDIIATGGSAKAAAELVQQLKGEVMGYLFILEIPGLNGRDKLGAPPTKILLEDA

SEQ ID NO: 26436 - protein, 282 aa, Triticum aestivum
MDGGTTSKRRVGAPGEGESSGKRQNATMGMDALDCPVCFHPLRPPIYQCSVGHFICSSCRPKLVRNKCHLCSAETTFKRCLGMERLMESVTVACSNANYGCAQKLTYYQKEEHEKECPSAPCFCPASSCSFAGPTDALLEHSASQHKWPCTTINYSEDVELCLEPGLHFLRTKDREIFLLNVALEPYGHAISVVCIQPKAINSKFKCRMSYGSFLTNYYQRSVYKIRSSSLSDGLPKGYNLILPKDEIADDGKGTLLTFSIDDPNPKVKVREPICLKPVRGV

SEQ ID NO: 26437 - protein, 127 aa, Streptomyces coelicolor A3(2)
MTRSVITTDNAPSLPAPLSQGIRKGPVLQISGQLPFDPYTGAVVGTTVAEQTAQVLRNVTAVLEAGGAGLEDVVMLRVYLTDPAHLPELNDAYATAVGEPFPARTTVYMQLPPGLLVEIDALAVLDD

SEQ ID NO: 26438 - protein, 665 aa, Arabidopsis thaliana
MEMESCKLFIGGISWETSEDRLRDYFHSFGEVLEAVIMKDRATGRARGFGFVVFADPNVAERVVLLKHIIDGKILCRSDKCISLSEVVHFTLTNKNVEAKKAVPRDDHVVFNKSNSSLQGSPGPSNSKKIFVGGLASSVTEAEFKKYFAQFGMITDVVVMYDHRTQRPRGFGFISYDSEEAVDKVLQKTFHELNGKMVEVKLAVPKDMALNTMRNQMNVNSFGTSRISSLLNEYTQGFSPSPISGYGVKPEVRYSPAVGNRGGFSPFGHGYGIELNFEPNQTQNYGSGSSGGFGRPFSPGYAASLGRFGSQMESGGASVGNGSVLNAAPKNHLWGNGGLGYMSNSPISRSSFSGNSGMSSLGSIGDNWGTVARARSSYHGERGGVGLEAMRGVHVGGYSSGSSILEADSLYSDSMWLSLPAKAEEGLGMGPLDFMSRGPAGYINRQPNGECRQRSVRTTCGKHVDDDKPQDKESNPSSIAIISINVKWTKRERSECYSPQNRDETILILQTLSQLQDSTGSATIVPTLLSFIRSLLTRLSLKPLKDAFASSRSSFTIVLCCNSNILKTTTSLTLKQLLHPLQQLLHLSTPPTLNSQELKQSVPFACRNLNKEKAFKCWRNVSMVSMLSVSTNGSLLAPPVPLAELLSSHNTLKLLQATSMLSFFF

SEQ ID NO: 26439 - protein, 545 aa, Synechococcus sp. CC9605
MNVGKSITNVSGRTGTVAPVVLAILDGWGYRNASEHNAIQQGGTPVMDALWHTYPHTLIEASGSHVGLPDQQMGNSEVGHLTIGAGRIIRQELVRISDTVRSNQLGETQALKELVERTQKRGGTLHLLGLCSDGGVHSHINHICGLIQWAADSGITDLAVHAITDGRDTPTQSAPGYISQVEAALSRSGVGQLASLCGRYWAMDRDQRWERIEKAYNLYTDPNFSVDNRTAGQVLTDSYAEEITDEFLEPVRLQNSVMKDGDSVLVFNFRPDRARQIVQALCLPDFDGFERSHTLELDVVTFTQVEQDLPVQVAFPPEPLDQLLGQVVADAGLKQYRTAETEKYPHVTYFMNGGIEQPLSGEDRHLVPSPRVATYDLSPAMSAEQLTDSCISAIERAEYSLIVINYANPDMVGHTGVMDAAKEAIQTVDCCIGRLLDAVGRQGGTMLITADHGNAELMQGADGQAWTAHTTNPVPAILIEGERRKLPGHGNSITLRDNGGLADIAPTLLQILDLPQPTAMTGESLIAPMSNMDPTPKTARLPLSV

SEQ ID NO: 26440 - protein, 369 aa, Aspergillus oryzae
MATNTSSFTAIPILDYSLSTSPTTKPQFLAELRNALINVGFFYLIHAPIAPQIQKDVVDKCKDIFDLPLEKKVEIEMVNSKHFLGYSRLGAEITAREQDYREQFDFATELPAPGPSEPLYRNIRGPNQWPDESAIPGFRKAIEAYLAEISPLSDAFRGLISEALDLPPTALDPYFDDPQQLKLKLIKYPPPPISSTEAEVQGVGPHKDSEFLTFLLQASPHSGLEVQNKSGDWISAAPVENSLVVNIGRALEAITGGVCTATTHRVSLAPRNFIDQAGASLGPRFSIPVFLGMGLDLSAEKITLQIPQHVRDLIQDEKVRSDAEATFNRIFSGRTGEGTLLHRVISHQDVGRRWYPDLLDFALKQYETK

SEQ ID NO: 26441 - protein, 234 aa, Clostridium difficile
LAISPFNYPVNLSMSKIAPALIGGNAVVLKPATQGAISALHVVEIMRKAGIPDGVLNTITGRGSEIGDYVVTHKGINFINFTGSTEVGQHISKISGMVPLLLELGGKDAAIVLEDADLDFAAKNIVSGAYSYSGQRCTAVKRILVQESVADKLVGKIKPLVEKLTIGNPMDEVVITPLIDNKATDFVQGLVDDALHKGAKLITGNVRKNNLFYPTLLDNVNVDMKIAWEEPFGP

SEQ ID NO: 26442 - protein, 490 aa, Azoarcus sp. BH72
MPLTLTRPDLQRQHNFIANAWHDATDGRLLPVSDPATDTVFAHVPDSAAADARAAVDAAHAAFPAWRALTGRERAQYLKRWHALILAYQDDLGRLISREQGKPLAEGRGEVLYAASYVEWFAEEAARSHGEVIPEPVRGRKMLMVKEPVGVVAAITPWNFPAAMIARKIAPALAAGCTVVAKPAEDTPLTSLALVRLAEEAGLPAGVLNMVTASRERAAEVVDVWLADSRVRKITFTGSTPVGKHLVRESAATLKRVSMELGGNAPFIVFEDADLDAAVAGLMAAKFRNGGQTCVCPNRVFVHDAVHYDFVARLSARVAALKVGPASAPDSQIGPMINARAVDKIAAHVADAVERGACVVTGGERLAALGANYFAPTILVGVDAGMRCTQEETFGPVVPVTRFEHEDEVVAAANDTPFGLAAYFYTRDMARAWRVADRLESGIVGINEGALAAEVAPFGGIKESGYGREGSRHGLDDYTQMKYLCQGGLG

SEQ ID NO: 26443 - protein, 234 aa, Streptococcus pyogenes
LAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLVLAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGP

SEQ ID NO: 26444 - protein, 436 aa, Haemophilus somnus 2336
MSNSITKNLSKHKLVKDTLVLILAGGRGSRLHELTDKRAKPALYFGGNRRIIDFALSNCINSGLNRIGVVTQYAAHSLLRHLQKGWSFLPQERGEFIDMLPARQQIDDSTWYRGTADAVYQNMAIIRDHYRPKYILILAGDHIYKQDYSQMLLDHVSSNAKCTVGCIEVPREQASEFGVMAVDENLKVKAFVEKPKDPPAIPNKPDTSLASMGIYVFDADYLYDVLMREVNTPYTSHDFGKDILPKSLEEEVLYAHPFSRSCMGRNTDGEIYWRDVGTLDSFWQSNIDLVSEHPQLDIYDQRWPIRGNPTQTYPSKFFYNKQDIKPVDNSLISGGCVITDAEISYSVLFDQVKVKADSKVEYSVVLPQVTIGKNCILRNCIIDRQVVIPDNTVIGVNIEEDRKRFRVSSTGKVILVTESMMKKLNGEKVVSEIHLD

SEQ ID NO: 26445 - protein, 670 aa, Oryza sativa (japonica cultivar-group)
MLRAVHVLAIAAAVLTLAPLAASYPWQACNGSSNYTANSAFQRNLGVLAAALPGNASTSPDLLANATVGGAPDTVYALAFCPPIDNQNASGCRACVASAFADARSLCPNNRGAHIIYDGCVLTFSGRDFLGAATNPADMERKLRNTENVTVSDVGEFNGAIYEVLNATADYTAAAARRFGTGEISFDPTYPVIYSMAWCTPDMAPGRCRACLADTIAQMHAYFNPNAQGARLVGVRCAARYEIYPFYTGRGMVQVPVSRPPAVPGTPGKKSKTGKILAIVLPIVAALLASAMICFCCWRRRTKATKLSLSYSSRSEDIQNIESLIMDLPTLRIATDNFAENNKLGEGGFGEVYKGSFPGGQTIAVKRLSQSSGQGIGELKNELVLIAKLQHKNLVRLVGVCLEQEEKLLVYEYMPNKSLDTFLFDPEKRKQIDWAKRFMIIKGITGGLQYLHEDSQLKIIHRDLKASNVLLDANMNPKISDFGLARLFGDDQSQETTNRVVGTYGYMAPEYALRGQYSIKSDVYSFGVLLLEIITGRKNSDSYNSEQAVDLLSLVWEHWAMKTITEMVDPYLRSDSSSLDEILRCIHVGLVCVQEDPMDRPTLSMINIMLDGNTVSAKAPSRPAFFTEMLGNINIGSSMYSQPYPVTDSTAKHSTAMSLNDVTVTEPEPR

SEQ ID NO: 26446 - protein, 201 aa, Prochlorococcus marinus str. AS9601
MSSLRQSEIKRKTNETDISVFINLDGSGISEIDTGIPFLDHMLHQISSHGLFDLQIKAIGDTHIDDHHTNEDVGIALGKAFSKALGERKGISRFGHFFAPLDEALVQVTLDCSGRPHLSYDLQLKAPRIGNYDTELVREFFIAFVNNSGITLHINQIRGSNSHHIVEACFKAFSRAMRMATEIDPRRSDSIPSSKGMLEKQ

SEQ ID NO: 26447 - protein, 334 aa, Arabidopsis thaliana
MNRNHHDHLDAAGKDMWSRLSDLADKADMLYEREGISKDRKSVSEEEEEKKTRFSILVDLVGRLCDQEERRTLGSSPTKTNTLFEGSEKSHLDHHLDHLPQKPRSSLECFFTRVYTRRNHNNVSTSSSLFNTDEFERTETKSPTIRNSQSSPSSCLMENTKRKRYQSSGKSKKPKFDPFSLTAARETPEWLLDVMRKMKGAEGPIKLIYEKTLTATDVKPSESRLLIPFNKLLRNDFLTPEESRAIAIDKEEEEEDTKKIGVKTIIVNQFSKEWSLRFLIWVMKKKKSGNGTLYYTLNRGWNGVVSGNKLKANDNISLWTFRCGGVLCFALEKE

SEQ ID NO: 26448 - protein, 593 aa, Pseudomonas syringae pv. syringae B728a
MTADNALYIPPYKADDQDVVVELNNRFGAEAFTAQPTRTGMPVLWVERARLFEILTFLRNVPKPYSMLYDLHGVDERLRTNRRGLPGADFTVFYHLLSIERNSDVMIKVALSESDLSVPTITSIWPNANWYEREVWDMFGIDFPGHPHLSRIMMPPTWEGHPLRKDFPARATEFDPYSLTLAKQQLEEEAARFRPEDWGMKRSGANEDYMFLNLGPNHPSAHGAFRIILQLDGEEIVDCVPDIGYHHRGAEKMAERQSWHSFIPYTDRIDYLGGVMNNLPYVLSVEKLAGIKVPEKVDVIRIMMAEFFRITSHLLFLGTYIQDVGAMTPVFFTFTDRQKAYTVIEAITGFRLHPAWYRIGGVAHDLPRGWEKLVKDFVDWLPKRLDEYTKAALQNSILKGRTIGVAAYNTKEALEWGVTGAGLRSTGCDFDLRKARPYSGYENFEFEVPLAANGDAYDRCMVRVEEMRQSIKIIDQCMRNMPEGPYKADHPLTTPPPKERTLQHIETLITHFLQVSWGPVMPANESFQMIEATKGINSYYLTSDGGTMSYRTRIRTPSYPHLQQIPSVIKGSMVADLIAYLGSIDFVMADVDR

SEQ ID NO: 26449 - protein, 263 aa, Oryza sativa (indica cultivar-group)
MAPPPISSSLSLMASNPIPSPPVAKPGRPLTVAACSNSSSSSSSSSPSSTSCSAAWSLPVATSAGRRGLLALGAGFLASPGLLCPAGDAGATRIEYYATVGDKLCDMNVVKSGLGYCDVEVGTGAQPPRGQLINVHYTARFTDGIVFDSTYKRGRPLTMRLGAGKILRGLEQGISGGGGVPPMLVGGKRKLMIPATLAYGPEPAGCFSDFRVNFGVSYKRRDYGQMKRKGATCLSPDAESKCVTGTPWVSNTQSTTFAICTKK

SEQ ID NO: 26450 - protein, 175 aa, Triticum aestivum
MAPTVMASSDTSVAPFQGLKSTAGLPVRRRSNGSSLGSVSNGGRIRCMQVWPIEGIKKCETLSYLPPISTEALLKQVDYLIRSKWVPCLKFSKVGFIFREHNASPGYYDGRYWTMWKLPMFGCTDATQVINEVEEVKKEYPDAYVRIIGFDNMRQVQCVRFIAFKPPGCEESGKA

SEQ ID NO: 26451 - protein, 661 aa, Bradyrhizobium sp. BTAi1
MTQVDHSRMANAIRALAMDAVEKAKSGHPGLPMGAADVATVLFTRVLKYDAAAPAWPDRDRFVLSAGHGSMLLYALLYLTGNEEMTLDQIKRFRQVDSLTPGHPENFRTKGIETTTGPLGQGISTAVGMALAEKMLQAEYGKKIVDHHTYVLASDGDLMEGISQEAIAMAGHWKLNKLIVLWDDNGISIDGPLSIADSVDQVKRFKSAGWAAELIDGHDPEAIAAAIARAQKSSRPSLIACKTTIGYGAPTKAGTSKVHGEALGPEELKGAKEKLGISLEPFSVPDDVLAAWREAGRRGAPARAEWETRLAEMGPRKRAEFERRLRHERPAALAKALKDHKKALLETPLNIATRKSSEAAIEVIAAAMPFEFVAGSADLTGSNNNKAKSATSFSAKTPKGRFIHYGIREHGMAAAMNGIFLHGGFAPNGATFLVFSDYARGAMRLSALMGAGVVYVLTHDSIGLGEDGPTHQPVEHLAALRAIPNMRVFRPADAVETAECWELALNRTNGPTVLALTRQNLPQLRTSAPSDNPCSHGGYELVAAQGEAKVSLFATGSEVEIAVAAQKQLAERGIPARVVSVPSLELLLEQPEDAKAAIIGKAPVKIAIEAAVRWGWDAVIGSDGIFIGMHSFGESGPYKELYKHFGITAEAAVDAAVKRLG

SEQ ID NO: 26452 - protein, 495 aa, Rhodobacter sphaeroides 2.4.1
MLQEIDWHARAKAVALPNRPFIDGQYVDSLSGETFACIYPGDGRPLTDVASCNAADVDVAVRSARKAFEAGVWSRMAPADRRRILLRFSELILANREELALLETLNVGKPIANAYNGDVVSAAACIAWYAEAIDKVYGEVAATAYDMTTLVMREPLGIVAAVVPWNYPMSMAAWKLGPALATGNSVILKPAEQSPFTALKFGELAIEAGMPPGVLNVVPGLGHIAGKALGLHMDVDCVGFTGSTEVGKYFMQYSGQSNIKRIGLELGGKSPQVVLADCDDLDAAAAGIAAGIFANTGQVCNAGSRLIVDEKIHDQLLEKIAAQAKVFAPGDPLDTATRMGSMVSEEQMDRVLGYIDAGRADGARPVIGGGRVKTETGGFYIEPTIFEGVRNDMKIAQEEIFGPVLSAIPVKGFDEAMATANDTVYGLAGAVWTGSVKNAHRAAKSLRAGVVWVNCFDRGSLAVPFGGFKQSGFGRDKSLHAMDKYTDLKAVWFAH

SEQ ID NO: 26453 - protein, 467 aa, Rhodobacter sphaeroides 2.4.1
MTRNDATNAAGAVGAAMRDHILLPAQEMAKLGKSAQPVLTHAEGIYVHTEDGRRLIDGPAGMWCAQVGYGRREIVDAMAHQAMVLPYASPWYMATSPAARLAEKIATLTPGDLNRIFFTTGGSTAVDSALRFSEFYNNVLGRPQKKRIIVRYDGYHGSTALTAACTGRTGNWPNFDIAQDRISFLSSPNPRHAGNRSQEAFLDDLVQEFEDRIESLGPDTIAAFLAEPILASGGVIIPPAGYHARFKAICEKHDILYISDEVVTGFGRCGEWFASEKVFGVVPDIITFAKGVTSGYVPLGGLAISEAVLARISGENAKGSWFTNGYTYSNQPVACAAALANIELMEREGIVDQAREMADYFAAALASLRDLPGVAETRSVGLVGCVQCLLDPTRADGTAEDKAFTLKIDERCFELGLIVRPLGDLCVISPPLIISRAQIDEMVAIMRQAITEVSAAHGLTAKEPAAV

SEQ ID NO: 26454 - protein, 109 aa, Nostoc punctiforme PCC 73102
MSDQINICELLTELSTNEQQLLSGGYSYGHGGYGHGGYGHGGYGHGGYGHGGYGHEGYGHGGYGHGGYGHGGYGHGGYGHGGYGHGGYGHGGYDHGGYDHGGPWDSDDD

SEQ ID NO: 26455 - protein, 342 aa, Rhodobacter sphaeroides 2.4.1
MPQRSDINRRVVLAQRPKGTPDESTLRMEEVPISEPAEGQMLLRTVWLSLDPYMRGRMNDTKSYAKPVEIGGVMTGQVVAEVMQSSLPGFEAGDMVLAGSGWQDYALSDGTEVVNLGKAPERPSRALGILGMPGYTAYAGLLKIGEPQPGETVVVAAASGPVGATVGQIAKLKGCRAVGVAGGADKCRYVVETLGFDACIDHRAPDFEAQLAAACPNGIDIYFENVGGRVLYGVLPLLNPFARMPVCGIVSWYNSPGLPEGPDMAPALMGTILRMKVKLQGFIIFDSFPRSLYAEFAREMTGWLAEGKVKYREQVVEGLEAAPQALNDLLAGRNFGKMVVKL

SEQ ID NO: 26456 - protein, 144 aa, Brassica napus
MQYFYILIVSLLLTTLSFKGEASGSVFFIDGSNNQYLRPPSEQALPMSLSEVSASVSALLGFAPPSTLTADGSSKLNKILKPNPFERPRAAFVLEIAGADDALVETLPSHSFLGNAVRGSISADSYKADIELPESEVDVVSVNE

SEQ ID NO: 26457 - protein, 324 aa, Dehalococcoides sp. BAV1
MLKLSSIYAPINEGLKGVEDEFKLVSESRKKSFPEMAEMLDYILVGGKVLRPALSMLSAMCFGAGIKKVLPLATSSEMLHIATLVHDDAIDKADTRRGRRTVNAVWGLEKAILLGDFLFAHAAETAAETGNMGIVTLFSQTLQIIASGELKQAYASFNPDQSYENYLERISGKTAALFVMATKGGAILADASPSDEEIMRSYGYNLGLSFQIVDDILDFVGNAKDMGKPIGSDLNNGTVTLPALLLMDRYPDNNPIKDMLNATDRIPHVAKAVEMINSSDIIDLSYKEAKRYADLACRNLSQLPKTAARESLYQLAEFIVERKN

SEQ ID NO: 26458 - protein, 565 aa, Oryza sativa (japonica cultivar-group)
MGIGIGIGIGIGIGTGTGAALPFGEASPWSLLGGAVAALLLVWAAQMLEWAWLAPRRMERALRAQGLRGTQYRFLHGDLTEDLRLVTAARSKPVPMDRPHDFIPRVAPLLHRALEEHGRVSFTWFGPMPRVTITDPDLVREVLSNKFGHFEKTKLATRLSKLLVGGLVILHGEKWVKHRRIMNPAFHAEKLKVELNILELEINLVTLTFLRMLPAFSASCSELIGRWENAVAASVGKAELDIWPDFQNLSGDVISRAAFGVRHHEGRQIFLLQAEQAERLVQSFRSNYIPGLSLLPTENNRRMKAIDREIKSILRGIIEKRQKATKNGEASKDDLLGLLLQSNMDYYSDEDGKSSKGMTVEEIIDECKLFYFAGMETTAVLLTWTMVALSMHPEWQDRAREEILQVFGRNKPDINGVSRLKVVTMVLHEVLRLYPPVVMMNRRTYKEIELGGVRYPAGVMLSLPVLFIHRDAAAWGHDAGEFDPGRFAEGVARACKDPGAGAFFPFSWGPRICIGQNFALLEAKVALGMILQRFAFELSPAYAHAPYTVLTLHPQHGVPVRLRRL

SEQ ID NO: 26459 - protein, 491 aa, Oryza sativa (japonica cultivar-group)
MVYGLLGLALLWQVHRLLVRLWWQPRRLERALRAQGVRGTSYRFLTGDLKDYGRLSKEAWARPLPLRCHDIAPRVAPFVHRTIAEHGKACLSWFGPIPKVTIADAEIAKDVLSNKMGHFEKLKFPVLSKLLADGVANYEGEKWAKHRRILNPAFHLEKLKLMLPAFSACCEELVGRWAASLGSDGSNEIDVWPEMQSLTGDVISRTAFGSSYLEGRRIFQLQAEQQELFMGAIQKISIPGYMSLPTKNNRRMYQIKNEVESIIRDLVQKRMHAMKDGERTKDDLLGILLESSTRHADENGHSGPGMTIEEVMEECKVFYFAGMETTAILLTWTMVVLSMHPEWQHRAREEVTMILYEVLRLYPPGIGFVRQTYKEMEIGGVKYPAGVMIELPLLFIHHDPDIWGSDVNEFKPERFAEGISRASNDHGAFFPFGWGPRICMGQNFALLEAKMALCMILQRFEFELAPSYTHAPHIVLMLRPMHGAPIKLRAI

SEQ ID NO: 26460 - protein, 338 aa, Zea mays
  misc_feature (194)..(194): Xaa can be any naturally occurring amino acid
  misc_feature (303)..(303): Xaa can be any naturally occurring amino acid
  unsure (1)..(338): unsure at all Xaa locations
INCLSSLAHPRAVVSSPAGRPRAVPSPAHPRAVVSSPVDRPRAVPSPASHARSPSSRPQPHARSLLPSHTRAVRRPVPSHARLMVQQQVSARFGKCLLELSGNNATIVMDDADIQLDVRSVLFAAVGTAGQRCTTCHRLILHENIYQTFLDQLVEVYKQVRIGDPLEKGTLLGPLHTPASKENFLKGIQTIKSXGGKILFGGSAIESEGNFVQPTIMEITRSAPVVKEELFGPVLYVMKFQTLKEAIEINNSVPQGLSSSIFTKRPNIIFKWLGPHGSDCGIVNVNIPTNGAEIGGAFGGEKXAGGGREAGSDSWRRFLRRATWREVLEVVSHSVTPW

SEQ ID NO: 26461 - protein, 501 aa, Oryza sativa (indica cultivar-group)
MEARELWVLAAALAVSLLYYLTVLMRYAGGGSSRSSRPRLPPGPTPLPLIGNLLSLRGVLHHRLASLARVHGPVMALRLGLTTAVVVSSRDAAAEAFTKHDRRLAARVVPDSNRAHGFSDRSVIWLPSSDPRWKTLRGIQATHLFSPRGLAAVRAVRESKVRDIVAYFRSRAGEEVVFGEAIYSGVLNLVSSSFFSVNMAGVGSEEAHGLRELVEDLVEAVAKPNVSDLFPFLRQLDLQGLRRRTEERMARAFGILDGIIDRRLANRTHGDRHGDFLDALLDLVSEGKMARDHVTIMLFEVFGAGSDTMSISLEWAMAELLRNPRAMRKARAELEDAAAVVEESDAARLPYLQAVVKEAMRLHPVGPILLPHRAVEDGVEIGGYAVPRGAMVIFNAWAIMRDPAAWERPDEFVPERFMETTTAIDFRGKEYEYLPFGSGRRLCPGLPLAERVVPFVLASLLRAFEWRLPDGVSAEDLDVSERFNTANVLAVPLKVVPVIVN

SEQ ID NO: 26462 - protein, 467 aa, Burkholderia pseudomallei K96243
MEGSQTGLGTGLKQRHVTMLSIAGVIGAGLFVGSGHAIAEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGVGAVLAAMLTTMFSFLGTEIVTIAAAESEHPERQIVRATNSVIWRISLFYLGSIFVVAALVPWNDALLPVHGSYQRAMELIGVPHAKGIIDVIVLVSVASCLNSALYTASRMIFSLSTRGDAPAFLRRTDASGTPRAAVLASTAFGFLTVIANYVMPEQVFGFLLATSGAIALLVYLVIAISQLRMRSTLDATGERLPLRMWCFPWLTWAVIVFICGVLVVMLLREDHRMEVGATAVLALAVVVASRMNRRARGGDEPTPAASRVSANLR

SEQ ID NO: 26463 - protein, 178 aa, Arabidopsis thaliana
MHLFIEGEIEHLVFPGLKSYIVPVWDLRTYQIFDMALRVHKNIQQRDMVIGRNLGNWILRGLDRMKPSAQVLLPKNTEPSIDKAKRVLQSTRLKPHVNTQTPQNREVDRNLFMSLRNFRSKYPIASMMMIKPPRSTGTTTQYRPYSVGESSLIKPIYARGGFNSVIRKDILQWMVQKR

SEQ ID NO: 26464 - protein, 338 aa, Prochlorococcus marinus str. NATL2A
MRAGSVIAIGEALIDRLGPLGGDPSSDLPVTDCFGGAPANVACALSRLGAKVSFIGSLGNDAFGEDFNNLLIQRGINTSGLQQDTLRPTRVVLVRRDSDGERCFEGFEGDKGLGFADQAISLEQIIRDWPLVAENAQWLVAGTIPLASEISSKAFLWCIENAMHSGIKIALDLNWRPTFWRNQVSTGSEPSVKEKNQILSILKNVSLIKLAKEEAQWFFNSSDPTEISSSLPQRPSVVVTDGSNPILWRLNNHLGKSFAIIPSSVVDTTGAGDAFTAGLIYKLISVELDQISEQSAKDIIQFGIACGSHVCKGLGAIEPQPYLDDIDNLLSLSKGEIS

SEQ ID NO: 26465 - protein, 601 aa, Oryza sativa (japonica cultivar-group)
MEVGVSLEAGKPAAAPWGMLYYGVPALLVLGALYRAAERCWLGPRRVAGALQGQGLRGTAYRFPAGDLPENARRSKEARAKPMPPCHDIVPRVAPLLQDIVKEYVNTSSYILQKVCACCYVQFTLFIELYLTAQNTELNVGNVCITWFGTTPRVVIAEPELVKDILSNKFGHFEKFTLKSLGKLIALGLASYEGEKWARHRRILNPAFHLEKLKHMLPAFSTCCSEMIDRWDSKLAGSDGPFELDIWQEFQNLTGDVISRTAFGSSFMEGRRIFQLQEEQADRIIKTIQYIYIPGYLYFPTENNRRMKENSREIEGLLRGIIEKRSRAVENGELSGDDLLGLMLKSNMDSGEPSNLRMSTEDVIEECKLFYFAGMETTSVLLTWTLVVLSMHPEWQHRAREEVLSAFGRDKPNFDGLSRLKTASACQNLNIFLHPYLITSGSTHVNLLTMPRYSVYLLQVTMILHEVLRLYPPAVTLSRRTFKEIQIGGITYPAGVGLELPIILIHHNTDVWGKDAHEFKPERFADGISKATKTNQQAFFPFGWGPRICIGQNFAMLEAKMALCVILQNFEFQLSPSYTHAPYASVTLHPQHGAQIILTRL

SEQ ID NO: 26466 - protein, 405 aa, Yarrowia lipolytica CLIB122
MSNYRRGVGSYSRMLGGGTNPFAAYTARKAKTKKRVLDKYEIIGYIAAGTYGRVYKARSKDPGDTNQYAIKKFKADKEGEMVHYAGISQSACREVALCAELDNRNITKLVETILEDTCIYMVFEYAEHDLLQIIHYHSHPERKPIPEYTLKSILWQLLNGVSYLHQNWVLHRDLKPANTMVTSDGVLKIGDLGLARLFSNPLQSLYSGDKVVVTIWYRAPELLLGARHYSPAVDLWAVGCIFAELLALRPIFKGEEAKMDNKTNVPFQRNQMQKIIEILGSPQEDDWPSLSKFPEYESLKQMKTFPPNLEAWYQSIGGTNQKGFQLLSRLLEYDPAKRLTANDALLHPYFTEAPKVSQNVFERQEYKYPPRRISCEDSDIKTMTYQGTKRGSQGGDNLHPRKKQK

SEQ ID NO: 26467 - protein, 499 aa, Oryza sativa (indica cultivar-group)
MENSQVWLLWGALSVAVLFYLSTLRRRYAGGKPLPPGPTPLPLIGNLHLAGGTFHHKLRDLARVHGPVMTLKLGLATNVVISSREAAIEAYTKYDRHLAARATPDTFRACGFADRSMVFIPSSDPQWKALRGIQGSHVFTPRGLAAVRPIRERKVGDLIAYLRAHAGKEVLLGQAMYTGLLNLVSFSYFSIDIVDMGSQMARDLREVVDDIISVVGKPNISDFYPFLRPLDLQGLRRWTTKRFNRVFSIMGDIIDRRLAHIRDGKPRHDDFLDSLLELMATGKMERVNVVNMLFEAFVAGVDTMALTLEWVMAELLHNPAIMARVRAELSDVLGGKEAVEEADAARLPYLQAVLKEAMRLHPVGALLLPHFAAEDGVEIGGYAVPRGSTVLFNAWAIMRDPAAWERPDEFVPERFLGRSPPLDFRGKDVEFMPFGSGRRLCPGLPLAERVVPFILASMLHTFEWKLPGGMTAEDVDVSEKFKSANVLAVPLKAVPVLIK

SEQ ID NO: 26468 - protein, 396 aa, Mycoplasma gallisepticum R
MNKYYMSSKRDYYEILEVSRSATQQDIKKAFRKLAMKYHPDRNKDSDAEEKFKEVNEAYEVLSDEEKRKLYDTYGHEGLNASGFHQGGFNPYDVFNSVFSGFDFEGGFGDVFSQFFGGGGSGFHNQEYIEEVDVNLVHEIKINFLEAANGCIKNVKYTRQVTCPDCNGSGSADGDVITCSDCNGEGFLVEQRRTLLGMFQTKKTCPSCKGEGQTIKNKCKKCKSRRMVDEVVERKVSIDSNVFYQDVVIVRGEGHIYKNLVGDLFLRVKIEPSRVFELRDNHVVVNVLVDPLVAITGGTILIPTLKEIKEINLKAGTKNGDIITIANGGINLKLDSRVYGANYNQKGDLIVVINYARPSEYSKQEITKLKEFIKPNKEVNLYETLMKKELNNKDSQ

SEQ ID NO: 26469 - protein, 151 aa, Methanosarcina acetivorans C2A
MNMEQTYVMVKPDGVQRGLVGEVISRIEKRGLKILALRMNVIAEATAKEHYGEHAARPFFPSLIEFITSGPSVSMVVAGKDAIKVMRAINGATNPVDAAPGTIRGDFALDVGRNVVHASDSPEAAAREIAIHFKDSEIGKYSRVDEVCLYE

SEQ ID NO: 26470 - protein, 170 aa, Arabidopsis thaliana
MTNAVGKALFSKAGELCVPVGFMCMKGLDLHIAEIEELCTEFPKTTVLLDHAGFCKVPESGEAKLAYSQLMKLSRFPQVYVKFSALFRISRTGFPYQDLSPLLSQLVSHFGANRVMWGSDFPFVVLECGYKEAKEAVTIIAKEASLSSSEMDWILGKTLMQLFPGQWVLP

SEQ ID NO: 26471 - protein, 656 aa, Vibrio cholerae O1 biovar eltor str. N16961
MKMNLSTPFPLGATLDAEGCNFAIYAPANRDILLALFHADGSYETHQLEHEYAGVKHTHISGIHAGQKYGYLIQLNDELHYISDPYARALEGPLHYAPPFDSHKSFDLPKCVVTDTHFDWQNVAKPRIARDEMVLFETHVKGLTQLNPDVEKALRGKYLGLVSQPMLDFYRQQNINTLQLLPIAACMHEPHLLESGKVNYWGYNPYVFMAPDPRYASKDAVNELKTTIRELHRNGIQVILDVVYNHTAEGGTNGPVFNLKALDPNYYLHHGDHYANYTGCGNTVDLSNQAALNLVMDTLRCWVTEYQIDGFRFDLAATLGRRGDEFSKEAAFFKAVAQDPVLREVKLIAEPWDIGPNGYQVGNFPFGWNETNDKLRDITRSFWRGDLGFLKEFATRLMGSRDLYSAANWPYKLTVNYITYHDGFTLQDLVSYKHKHNEANGEQNRDGHGDNRSDNYGFEGDTDSIVIRATRERQKRNFMASLLFAFGIPHILTADVLSHTQKGNNNAYCQDNDISWLNWENNETKQDFREWLAGMVAARQTYMVPFIRAFSGENRNNNRIAWRRVDGKPMEMDDWNRLSSVALHIGIGSDGPEMLYLINQTNAPARFVLPKDRQQDWRLICDTNMRHAQHGHAEGEVLQLPVSMSILHYQPKKKSA

SEQ ID NO: 26472 - protein, 245 aa, Mycoplasma gallisepticum R
MGCCHAINHRSYTVDYYLLKELSLSEDGKRLIQETINSDLINNLGNLVHRLIPMLESRQESTILPYLAGNEVEDKYLADLQKLPAEFEKLVEENDIRSAIKLVLNISKEYSSVIEVRKPWELYKNNKTQELANVLFAGTCAIRTVFVLLEPILTTKSKEVYEQMNFTPEQTQLKNINNFEQLLNHKINKSKKLFQKLDVTDPNVNLKPLEQQETKTKEVKDKKAKESSKQSPKEPTKEQAKEPTK

SEQ ID NO: 26473 - protein, 182 aa, Pseudomonas syringae pv. syringae B728a
MFKYIGDIVKGTGTQLRSMVMVFGHGFRKRDTLQYPEEQVYLPPRYRGRIVLTRDPDGEERCVACNLCAVACPVGCISLQKAETEDGRWYPDFFRINFSRCIFCGLCEEACPTTAIQLTPDFEMAEFKRQDLVYEKEDLLISGPGKNPDYNFYRVAGMAIGGKPKGSAQNEAEPINVKSLLP

SEQ ID NO: 26474 - protein, 463 aa, Bradyrhizobium japonicum USDA 110
MTPTMLPSSQQARDVAYQLHAYTNARSHQRAGPLIIERGEGPYVFDTAGKRYLDAMAGLWSAGLGFSEKRLIEAAHRQMQILPFYHTFASRSNGPSIALAEKLVKMSPVPMSKVFFTNSGSEANDTVLKLIAYRSNAAGQPQRKKVISRLRGYHGVTIGAASLTGFPDNHRSFDLPLPNIMHTGSPHFYKDSRAGESEETFATRRAEELESLIQREGADTIAAFFGEPVMGAGGVIVPPPTYWDKIQSVLKKHSILLVADEVICGFGRTGKMFGCETYNIAPDVIVVSKQLTSSYFPLSAIIMNDYMFEPIADESNKVGLLAHGFTGGGHPVGAAVALENLKLIEERGLIANVGRIGAYMQERLRTLVDHPLVGEVRGVGLIAAIELVLDKKRKVAATTPGDVGSIASRLLHERGIIVRNVDDALSICPPLIVNKDQIDELIDGITGMLHDLKATVVNCREPH

SEQ ID NO: 26475 - protein, 335 aa, Bradyrhizobium sp. BTAi1
MAVRVGINGFGRIGRNVLRAIAESGRKDIEVVGINDLGPVETNAHLLRFDSVHGRFPHTVTVDGDSIDIGRGKIKVTAERDPSKLPWKDLGVDIALECTGIFTSKDKASAHLTAGAKRVLVSAPADGADATIVYGVNHTTLTKDHLVVSNGSCTTNCLAPIAKVLNDLVGIETGFMTTIHAYTGDQPTLDTMHKDLYRGRAAAMSMIPTSTGAAKAIGLVLPELKGKLDGVAIRVPTPNVSVVDLKIVAKRNTDPKEINEAMKRASEQELKGILGYTTAPNVSIDFNHDPHSSTFHQDQTKVMNGNLVRVMSWYDNEWGFSNRMADTAVAIGKLL

SEQ ID NO: 26476 - protein, 396 aa, Bradyrhizobium sp. BTAi1
MTKFRTLDDVDPKGKRVLLRVDLNVPTENGHVTDTTRLERVAPTINEIATKGGKVILLAHFGRPKGRDPKDSLKPVAAALSAVIKRPVAFADDCIGEPAATAIAAMKDGDVLCLENTRFHKEEEKNDPAFVAELAKLGDIWVNDAFSAAHRAHASTEGLGHKLPAYAGRTMQAELDALEKALGSPVKPVIAIVGGAKVSTKIDLLENLVTKVDALVIGGGMANTFLHAQGVQIGKSLAEKDLAATALRIMEKAEASNCAIILPVDATVSYHFAANSPSFAYGLDAIPPDSMILDVGPQSTARIHAAIDDAATLVWNGPLGAFELTPFDRGTMVAAKHAAERTKAKKLISVAGGGDTVAALNQAGVASDFSYVSTAGGAFLEWMEGKPLPGVEVLKV

SEQ ID NO: 26477 - protein, 353 aa, Zea mays
MESGSTFYGGEGLSIDPKWFIDPKLLFVGPRIGEGAHAKVYEGKYKNQNVAIKIVHKGDTPEEMTKREGRFLREVTMLSRVQHKNLVKFIGACLEPVMVVVTELLVGGSLRKYLVSLRPRSLEPRVAVGFALDIARAMECLHAHGIIHRDLKPENLLLTADQRTVKLVDLGLAREETLTEMMTAETGTYRWMAPELYGTVTLRHGEKKHYNHKVDVYSFAIVLWELLHNKLPFEGMSNLQAAYAAAFKNIRPSADNLPEELSEILTSCWKEDPNDRPNFTQIIQMLLHYLSTLSPQETLAGPRRTFSSENTILPPESPGTSSLMASRGDLGDTPKGKKEDKPRGFFFCFSECY

SEQ ID NO: 26478 - protein, 340 aa, Bradyrhizobium sp. BTAi1
MNLSALNTVALAMVTPGKGILAADESTGTIKKRFDAIAVESTAQNRRDYREMLFRSDGMTFISGVILYDETIRQNAADGTPLVKLIEQAGSIPGIKVDEGTQPLPGCPGETVTVGLDRLADRLAAYYALGARFAKWRAVIDLDKDRIPSMTAVHVNAHALGRYAALCQAAGLVPIVEPEVLMDGDHDIGRCFDVTRRVMNEVFRELRIQRVALEGMILKPNMVVSGQKCPVQAGVTEVADRTVQLLKECVPAAVPGVAFLSGGQSDAVATAHLDAINRRGPLPWMLTFSYGRALQAAPQRVWAGRTANVPAAQRAFSHRARMNALASRGQWTTERENEAA

SEQ ID NO: 26479 - protein, 177 aa, Zea mays
  misc_feature (30)..(30): Xaa can be any naturally occurring amino acid
  misc_feature (36)..(36): Xaa can be any naturally occurring amino acid
  misc_feature (50)..(50): Xaa can be any naturally occurring amino acid
  misc_feature (63)..(63): Xaa can be any naturally occurring amino acid
  misc_feature (91)..(91): Xaa can be any naturally occurring amino acid
  misc_feature (151)..(151): Xaa can be any naturally occurring amino acid
  unsure (1)..(177): unsure at all Xaa locations
GRTRLAGQMIMGSTLELRQQALDRFLAYQXCDFEGXNRAMDGLPATITTXWDPALHKFLPEGXMKRHCRVNYVLETGANQKDALLRIEKLXIINPLLVLRGCRLVILYPELTEMQALSILKAAITMTNNGDQVLPKIINDLVGTPQELRNXVTIIHQDSEKVICNDDKTIVYKGETM

SEQ ID NO: 26480 - protein, 281 aa, Schizosaccharomyces pombe 972h-
MPLIIVSGYPSSGKTTRSNELKKALEDRIHQNIDNTKDYRVIIINDESLNIEKETYRESKNEKAARGLLYSAVQRELSKSTFVICDALNYIKGFRYQLYCESKSMYTTHCVIHVAVPQDLCRKFNSNKEQPYPDDVLEQLMFRYEEPNGMTRWDSPLFTVLHDDASCPIDDIWSVLIHNKNVKPNQATMVKPPAEVNYLYELDKTTQDVIMLILDNSNDTSLITVPGSKLQIALPSVTVSLPLLQRLRRQFIQINRQQSYNTNVLKEMFVEFLNGQFETLD

SEQ ID NO: 26481 - protein, 280 aa, Arabidopsis thaliana
MTSSSPTQRTHVSIPPEPGGKSLTQEANEPPVPISVSSPCGKRTRDPEDEVYLDNLRSQKRYLSEIMACSLNGLTVGDSLPVNMLESPARSESFLYHRDDLSLQYSPMSEDSDEARFCEDPTATASTSSSQPESRPTSPVSPYRYQRPLTSTNSPQPSPTILHHSHTCPASMISNAATTTTPQSRQRGSDTEGRFPSSPSDICHSGDLRRTALLRSVQMRTQPCGYSSSSGPSNIDGEERMCSKSMEEDRGYNKGEDIPYAEVSSKSKSCKALDMRLCEK

SEQ ID NO: 26482 - protein, 643 aa, Chlamydomonas reinhardtii
MQLPGVLLGVVGSLGRGVFGQRLHYAFACSAKSQLQRHGAAAQSCGVLSRCFSGVPAHTIVGMPALSPTMSQGNIAKWHVKPGQEVSPGSVLADIETDKATLAFENQDEGFVAKLLVPDGARDIPIGQPVLVLVEDASSVAAFANFTPGQSAPADAAPAAPVEQPPAATAAPALMEHAYPPHTRLTMPSLSPTMDRGNIVAWKVSPGAAIKAGDVLADIETDKATLAYEAVAEEGYVAALLVPEGTRDVAVGTPLALLVEAPEHLAAFARLTPEQAHALALGPQSGQAAAAAGITPPASQGPAEAAPRVVASERLGPAARLLLESSGLKPEDVTPTGPNNIITKADVLAAIAGGVKPGSAAAAKPAATKPVAAATAPAAATLKAAAPVAAATAAAQHSAGSAGPSGSGGSGGGSYTDTPNSQIRRIIAARLLDSKRNTPSLYMRADACLDAVADLRASLAARGTKVSVNDCVLRAVALALRDVPAANVHWDEAAGDVRAFGGVDISVAVATERGLITPIVRAADVKGLLAVSREVRALALKAKDNKLKPEEFTGGSFTVSNLGMYGLTHFSAIINPPQAAILAVGGATERVVLVGGQPAVRSAMSVTLSADGRVYDGELAGAVLAAFRRHMEQPYELLGATSS

SEQ ID NO: 26483 - protein, 475 aa, Burkholderia sp. 383
MQTMNLINGERVAGDGEAFPVVNPATGETVVTMRDASAEQVDAAVAAAAAAFPSWSATPPGARAARLLALADAIEERADEFAALESLNCGKPLHAVKADELPLTVDVFRFMAGAARCVSASSAGEYVAGFTSMIRRDAVGVVGSIAPWNYPLMMAAWKLAPALAAGCPVVLKPSELTPLTSLRVAELAAELFPRGVVNVVVGRGATTGDALINHRQLDLVSLTGGPATASRILEASSRKLMHTHMELGGKAPVIVFDDTNLDAAVEGIRNAAFFNAGQDCAQPCRLYVEDGIYDTFVANLANRVASIRLGAPDDTRTEMGPVISEGHRRRIAGFVDRARDLRHVEILTGGRDVAGGGYFYEPTIVAHARQDDEIVQREVFGPVISVTRFSGAEQAIHYANDSPYGLASSIWTRDVGKAMTVASRLRCGITWINAHGVATAEMPHGGMKASGYGSDMSVYALENYTTVRHVQIAHA

SEQ ID NO: 26484 - protein, 248 aa, Vernicia fordii
MARIAFGRFDDSFSLGSFKAYLAEFISTLLYVFAGVGSAIAYNKLTANAALDPAGLVAIAICHGFALFVAVAVGANISGGHVNPAVAFGLALGGQITILTGIFYWIAQLLGSIVACFLLKLVTGGLAIPTHSVAGRVGAIEGVVMEIIITFALVYTVYATAADPKKGSLGTIAPIAIGFIVGANILAAGPFSGGSMYPARSFGPAVVSGDFHDNWIYWVGPLIGGGLAGLIYGNLYISGDHTPLSNDF

SEQ ID NO: 26485 - protein, 582 aa, Triticum aestivum
MSGAAALRRSGSNSLSALLRAEDDDPGALAATKRRDGGGRRGRSGGRRSCLRLPLGGAGGCRVCACDEVDPAPRRRAPADGDGDGEAEAGGEEQRVPAALQCFSWKKGPAAVARIGRALRVEDDAVAEDAAPSLTALPDDVLEMVLSRLPLASLLAARCVCRRWRDLTVAPQLLRLRREGPRAATTPWLFLFGVEADGGWGASAAATAVHALDVAAHRWRRVGAAPLKGRFLFSVAGVGDELYAVGGRSGGSSAGSVKTKTHKGVMVFSPLTGAWRKTSPMRAARSRPVLGVFVMSASRSIVHARAEKHVRRANAGAKFRLGGTSAVYEDPHRLSLRRLRLRDVLNEDTDSTVPAHGHGKASRQQKQPAQARQALIAVGGRGPWDEPLVSGEIYDPVTDKWVEIAGFPTDVGLACSGAVCGDMFYVYCESDTVVAYHLDACSWSVVQTSRPPPRLRDYTPALVCCASRLFMLCVSWCDPANRRDKVVRKVFELNLGSTPLLHWTEASAHPDAPMDSNAVFAAGQDRIYAVEMFRIFGKVLDFATACRVSGGEQSWSRIARENAAAEADAMSCRLKSMAVLLL

SEQ ID NO: 26486 - protein, 358 aa, Staphylococcus epidermidis RP62A
MSEKVKFEKRESLKEKPDTANLGFGQYFTDYMLSVDYDADQGWHDMKIVPYAPFEISPAAQGLHYGQAVFEGLKAYKHNGEVVLFRPDQNFKRINNSLARLEMPEVDEEALLEGLKQLVDVERDWVPEGEGQSLYIRPFVFATEGILGVRSSHQYKLLIILSPSGAYYGGDTLKSTKIYVEDEYVRAVRGGVGFAKVAGNYAASLLAQTNANKLGYDQVLWLDGVEQKYVEEVGSMNIFFVENGKVVTPALNGSILPGITRKSIIQLAEDLGYEVEERRVSIEELFNAYDKGELTEVFGSGTAAVISPVGTLRYEDREIVINNNEPGKITQKLYDTYTGIQSGKLEDKYGWRVEVPKY

SEQ ID NO: 26487 - protein, 554 aa, Zea mays
MNDAGEAEAQELAPPGASAAAGLQGRAEVDTSTPFKSVREAVDRFGGSAAWSSDLIKRMFALPPSPKKQEGGDELADLEEQTAQLEKELGVKERETLDVLKELESTKKVVADLKLKIQNEGAGAFCIPEESVRGQAELPTAAEEVAEVQPENAETDVVMGALHVQLHQSPGTSVLKGLEQAKANLNRTTSDLAAIRASVESLRNDIAKERILVERSREKVCANTTLIASLEDELNRTAQKLQTLRDLQRRRDDQSDIFIEIKKMTSELEQLRNAASAAKSEAAMLSAEIEQMRASIGTAEVRCRAARKIEEAARAAEALALAEIKILLRNEASVEDLQGMEDVSLSLEEYSELAAKAQEADERSRKKIDAAMVQVDEANRTESDSLRKLEEARLQVEECKKALQDAQKRVDAANRGKSAVEEALRRCRSTTGHRRRSVHDPPRFKHPAPRSRDSQNMDIVGVSKGPLKPTLSIGQILSMKLMGPDGYDKSVWDDASEASTMSLGHILNRRHAVVYSSDATAQKKFPGKRKKFAFTGLSIFLARQAKRKKEKGSH

SEQ ID NO: 26488 - protein, 142 aa, Dehalococcoides sp. BAV1
MERTLLLVKPDGVNRGLSGEILGRMEKLGLKLIGLRMLQMDAVLADKHYAPHRARPFFKDLVTYITSGPITAAVFEGENAVEKMRKAMGATDPAKSEKGTVRGDLGIDIEQNTVHGSDSAENAKHEISLFFSESELVNYDRR

SEQ ID NO: 26489 - protein, 590 aa, Mycoplasma gallisepticum R
MNKINKDEQTMLKNKKCYISTPIYYASGNPHIGHAYTTILGDFLARFKKQRGYDVFFLSGTDEFGKKIETKAKSLNLTPQKMVDQYSSKFKELFDLLNIELTRFVRTTEPKHQEVVKKIFGLFYLKKYIYLDQWQGLYCVDCEENYTTSSVLKKADLVEKTNLDLSMDPDDQLYCHVGHKISSINEPSYFIKLSEFSDFIKESLTDNVPSVFPTSRNKEMLNNFVNVGLKDLSISRTSISWGIETPLNKSHRIYVWLDALFSYLTSMGFGSEDDKLYQEFWNNDSSERIHLIAKEITRFHRIYWVIFLKMLGIKQPTRMISHGWILDENGNKMSKSLNNIIDPIELAELFGVDQLRYYLLKELSLSEDGKVGKRLIQETINSDLINNLGNLVHRLIPMLESRQESTILPYLAGNEVEDKYLADLQKLPAEFEKLVEENDIRSAIKLVLNISKEYSSVIEVRKPWELYKNNKTQELANILFAGACAIRTVFVLLEPILTTKSKEVYEQMNFTPEQTQLKNINNFEQLFNHKINKSKKLFQKLDVTDPNVNLKPLEQRETKTKEVKDKKANKESSKQSPKQPTKEQTKEPTK

SEQ ID NO: 26490 - protein, 429 aa, Escherichia coli [sequence omitted]

SEQ ID NO: 26491 - protein, 509 aa, Oryza sativa (indica cultivar-group)
MEKLKSELWMTAVATCMSLLLYLTILRRRHASGGRSLSLPPGPTPLPLIGNLFCLGGIFHQTLAKLARVHGPVMTLKLGLTTAVVVSSAEAAREAYTKHDQRLAARPVPDAFRANGFSERSIVFSPSSDPQWKNLRGIHATHIFSPRALAALRGIRARKVRDIVGYIRTVAGEEMCVREVVHNGVLNLISNSFFSMDMADVGSESARGLHGLIEDIIATVAGPNVSDFFPFLRQLDLQGLRRQTGSHLGIVFGLLDDIIDRRMAESRDHPDKQQHGDYLDALINLSSTGKIPRYHITYLLFDIFAAGADTMTTTVEWAMAELLRNPRVMAKVRAEVMDALGGKESFDEGDAASLTYLQCVFKEAMRLHPVGSILVPHLAQQDGVEIGGYAVPKGTTVIFNAWAIMRDPAAWESPDQFLPERFLHKESSSPPLELRGKDYEYIPFGSGRRLCPGLPLAERAVPFILASLLHAFEWRLPDGMSPDDMDMTEKFATANVLATPLKAVPVVTH

SEQ ID NO: 26492 - protein, 605 aa, Dehalococcoides ethenogenes 195
MSQSATRNFCIIAHIDHGKSTLADRLIEMTGTLRHDEMCEQVMDSMELERERGITIKAKAIRLRYLSKDSHEYRLNLIDTPGHVDFSYEVSRTIAACEGAILVIDATQGIQAQTLANVYLAIEYNLEIIPVINKIDLPGADIPRVMGEIKSVLGYDEDAVIQISAKLGLGVPELLEAIVARVPAPKGDGKLPLRALIFDSHYDPYKGVVAYLRVADGNINKGDDLRLMGQGTEFKVLEAGYFAPAQVAALRLDVGDVGYVATGLKSVGECRVGDTVTLQHGGAIQPLIGYHPAKAMVFAGIYPTQTDDYHELREAMEKLSLNDASLSYEPESSPLLGHGFRCGFLGLLHLDIIVERLEREFNLSLVVTSPGVSLTVTRTSGEVLTVVNPNEMPLPHEIASIEEPWVSVVIITPSKYIGTVMDLVRENYGVYKNTEYLGQLAMSELGQRVQLHYDMPLRSILTTFHDQLKSRTQGYASLDYEFVGYRIANLSKIDVLVNDVAVDAFSRIIPPDKAHEIGEALVKKLKEMIPRQLYQVTLQAAIGSKIVARADISAKRKDVIAKCYGGDITRKRKLLDKQKEGKKKMRQIGKVEVPKEAFLSVLKLQ

SEQ ID NO: 26493 - protein, 558 aa, Oryza sativa (japonica cultivar-group)
MAETRRWELAAHRRLEKGKVVGVVVLDGWGEAAPDTFNCIHVADTPTLDALKKGGPERWRVIKAHGTAVGLPTDDDMGNSEVGHNALGAGQIYAQGAKLVDMALASGKIYEGEGFKYIQQSFENGTLHLIGLLSDGGVHSRIDQLQLLLKGASEHGAKRIRVHILTDGRDVLDGSSVKFVELIENDLAKLRDKGVDARIASGGGRMYVTMDRYENDWQVVKRGWDAQVLGEAPHKFQNALEAVKKLREDPKANDQYLPPFVIVDERGRPIGPIMDGDAVVTFNFRADRMVMLAKALEYESFDKFDRVRFPKIRYAGMLQYDGELKLPSHFLVAPPEIERTSGEYLARNGIRTYACSETVKFGHVTFFWNGNRSGYFHPNLEKYEEIPSDIGIPFNEQPKMKAVEIAKKTRDAILSRKFDQVRVNIANGDMVGHTGDIEATIVGCKAADEAVKIVLDAIEQVGGIFVVTADHGNAEDMVKRDKSGKPLRDKDGNVQPLTSHTLNPVPIAIGGPGLQPGVRFRSDLPSAGLANVAATVMNLHGFEAPDHYEPTLIEVVDK

SEQ ID NO: 26494 - protein, 291 aa, Yersinia pestis biovar Microtus str. 91001
MGLLVVLRTHDVFNPPHMRDVTGNIKNQTGTEKILRRQYRVITETTVPISKSESLPYIILSQPEHYRLFTLMKEIEKLIANNRTWSNTICKDDPGFFEHLAQSQKPRFLWIGCSDSRVPAEQLTGLKSGELFVHRNVANLVIHTDLNCLSVVQYAIDVLQVEHIIICGHLGCGGVEAAIKGEEMGLIDNWLLHIRDLWYKHSSLLGELPQEERSNVLCQINVVEQVYNLGHSTIVRSAWKRGQKAMIHGWVYGIENGLLRDLEVSATSLGSLEMVYRKAMAELLQNNKEDH

SEQ ID NO: 26495 - protein, 428 aa, delta proteobacterium MLMS-1
MGEIIGVQGREVIDSRGNPTVEVEVFLDSGASGRALVPSGASTGVREALELRDSRKKRYLGKGVETAVANVNNIIGPAITGLESCEQVLIDRVMLELDGTDNKKKLGANAILGVSMAVARASAEDCALPLYSYLGGVNAKVLPVPMMNVLNGGAHADNNVDVQEFMIMPLGAPSFKEALRMGVETFHSLKAVLKKAGHQTAVGDEGGFAPNLRSNEEAMECLLEAINSAGYKPGKDIAIALDVAASELYDAKAKCYVLAAEEKSKKSAAELVKLYASWLKKYPLVSIEDGLAEGDWAGWKKMTAELGGKVQIVGDDIFVTNTAILARGIKEGAANSILVKLNQIGSVTETIDAVDMAHRAGFTAVISHRSGETEDTTIADLAVALNTGQIKTGAPSRTDRVAKYNQLLRIEDELGAAARYAGAGALGL

SEQ ID NO: 26496 - protein, 336 aa, Arabidopsis thaliana
MESNRFSLDRNWLNEVVERTNLTSGEGIDYGLKIKSSGFMDLLQSQQEDMSQFASGSTEVPAFSSQLSEEGSDLEGSEDEVKPKQSISRKKWTAKEDIVLVSAWLNTSKDPVIGNDQQGQSFWKRIAAYVAASPSLDGLPKREHAKCKHRWGKVNKSVTKFVGCYKTTTTHKTSGQSEDDVMKLAYEIYFNDTKKNFTLDHAWRELRYDQKWCEATSRKGDKNAKRKKCGDGNASSQPIHVEDDSVMSRPPGVKAAKAKARKSATIKEGKKPATVKDDSGQSVEHFQNLWELKEKDWDRKEKQSKHQQLERLLSKTEPLSDIDLFLKNKLITDLWS

SEQ ID NO: 26497 - protein, 335 aa, Zea mays
  misc_feature (49)..(49): Xaa can be any naturally occurring amino acid
  unsure (1)..(335): unsure at all Xaa locations
MDSRLAIAALLLLASASSAAAAADGGKVAVALYYESLCPYSARFVVNHXAKVFADGLREVVDLTLVPYGNARIHPGGEISCQHGPYECLLNTVEACAIDAWPDLDVHFSFIYCVEDLVVKRQYKDWESCFEKLGLDPKPVTECYKSEHGHKDYENFEAYICKAYKGTPPKACQGLGRLQMALETAAEARNGVSYNSGVSKLATAEDEGGEHKARGPRSAGPVRTRSHWSAAKERKAKGGAAAADGTARTQEYRRRGGQRPRQTAIPVTGREHSGRTTHASREPGGTGRAATTTNLVPPPALQPEQPRLPAPSHHMGRLPPHGTCRGATGLLLADA

SEQ ID NO: 26498 - protein, 152 aa, Kluyveromyces lactis NRRL Y-1140
MSFIKNFLTGAVKTTADPTGLTQSGSGNEGASSKSNDPIVEGKFYPRTLSKFNGHDDEKIFIAVLGKVYDCSQGRQFYGPSGPYSNFAGHDASRGLATNSFDLDTVRHWDQPIDTLQDLNEQERGALEGWAAHFQKKYPCIGSLEAEPGVNN

SEQ ID NO: 26499 - protein, 601 aa, Legionella pneumophila subsp. pneumophila str. Philadelphia 1
MFGFVSDLLTAAVSSLDELLQDTPAHQIILGTAALYFLYNQYHNPSISRWYRSRNNASMKQRIIDSAYALAKNLPGVNQIIEKELNKELSSTREKLRIQRSGMTLREEIPEEGLSPQDILSAFDVDVEKCHFDFLSVTNDSPEREFLVERGDGKDSGALYAIHPKELTELLKEVYGATALTNPLHDKWPRINAMQAEVIRWCQNLFHGSKECYGLLTHGGTTSIIEAMAAYVIRARAKGIDYPEIVVPETAHAAFKKAAELTGAILITVPVDKKTGAVNPKVMSSYITRNTAVIVGSAPSFMNGIHDPVSELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIITLRNAIQKELTTLLEEGNGLTSEDIYVYGNPQWSILGFRSNTCNAHFIADELEKRGWKLNLLQNPDGFHLCLTHVHTLVKGFETQFIKDLREAVIDVKNYPPGKKPSGNVKVYGAVGMMPIELQREICKQYQKARLNYTSASPGSLRIFTNVPVEEDEGLRNRKTEKYKV

SEQ ID NO: 26500 - protein, 204 aa, Arabidopsis thaliana
MSCTHDHNCEDHECSSDWSLYKHIDLSKVSALNESVSGSAKSVFKAWEQRLHSSGEHLESNEGDPELLVFVPFTSDVKIKSISIVGGPEGTSPSKLRVFINREGIDFSDAESMQAVQEWELAENLQGVLEYQTRYSKFQSVGNITLHFPESFGGDTTQIRYIGFKGEATQLKRDVVATIVYEIRPNPSDHKTKAETGGGFSQVE

SEQ ID NO: 26501 - protein, 883 aa, Chlamydomonas reinhardtii
LVQVWCCPTPDKQMNPMQLHRTYGQCHSDVLDIAWSPDGAFLAAASKDITLRVFSLNPIPGYEPPTLCGHKDALLGVFFASPAMLAKGTADGGEAPCLYSLSVDGSLHAWTYAASAAYTLDNLAAPVAKRKREAAAAEAAEKQRRLEEGEEEEEAAGEAEGEGDAARRKSGRRASTSSGTAAGEEEQAEEGGGGAEEAKKEERPFPYLAGGKWYLTSKHYFNQRGSRVSSYAHHAASGLLAVGFSGGVFDLYSLPDFANLHTLSVGQERITSLAFNDTGDWLAVGCARLGQLLVWEWRSETYVLKQQGHYHDITTTAFSPDGALIATGADDCKVKVFQQSSGFCFVTFSDHSAPVTAVTFLPSGHALLSASLDGTVRAWDLVRYRNFRTLTAPSPVQFGSLAVDPAGEVVCAGTVDTFQIYVWSLKTGRLLDVLAAHEGPVSALAFSPITSLLASGSWDRTVRTWDVYGGGGGGGSAGDVLDHRHDVLALAMRPDGRQLAAATLDGSIYLWDPVEGMLEGTIEGRRDIRGGRLQGDRRTADNSSAGASFNSLAYSADGALLLAGGNSKFVCVYDVSEKLLLRRFQLSHNRSLDGVLDTLNSKNMTDAGPLQLINHNDDDDDEALELLPPSTDLAAAADVPGTAAGKRPAVRCRCVALSPTGRVWAAAATEGLLLYGLDTGVLFDPTDLTEDLTPAAAHAALAGGTPLRALTIALRLGEPELVRHVILATPPRDVGTTAASLPAMFVPTVLAALAEAAADCPHLEFLLGWVRAVCSAHGAALQAAAGGGAPGTGVAARLAAAGVAGGQLPASSVLPALRSLQKVLGRLHTDLAAACEGNVYMLDYLASVSGTAATGEPANGEQPAEDGSGGAEDDDDDEEEASD

SEQ ID NO: 26502 - protein, 197 aa, Triticum aestivum
TVGADDTTTLDKIIDSLTSIANAHRGDPNAAEISLKIGRVSECGIDDSMDKVGPKVLILGAGRVCRPAAEFLTSYQNIDQVHVVVASLYQKDAEETVDGIKNATAAQLDVSDTESLSNLVSQVDVVVSLLPASFHAAIARVCIELKKHLVTASYVDDSMSKLEQAAQGAGVTILCEMGLDPGINHMLSMKMIDEAHA

SEQ ID NO: 26503 - protein, 298 aa, Arabidopsis thaliana
MTEEFEIAGISTGAWWSSPTNTAAVFSGYSLPCSTEISPDVTNFGWQNFDNKINDHNDGCMNMHNSFFEGLLIDPNDQLLPDPWSKSTIPNAKSELLENFPFLDNMFLVDSEAESLLDHEIRNHKSSKEQITQDYKNLTSKRSEELEENSDEYSPRLLKRPRLETLSPLPSFKVRKEKLGDRITALQQLVSPFGKTDTASVLNEAVEYIKFLQEQVTVLSNPEQNTIGSVQQQQCSNKKSINTQGEVEEDECSPRRYVDLSSRGLCLMPISASYPVAAAAASAAEMNVHLVSGIFHSL

SEQ ID NO: 26504 - protein, 175 aa, Triticum aestivum
MAPTVMASSATSVAPFQGLKSTDGLPVSRRSNGASLGSVSNGGRIRCMHVWPIEGIKKCETLSYLPPLSTEALLKQVDYLIRSKWVPCLEFSKVGFIFREHNASPGYYDGRYWTMWKLPMFGCTDATQVINEVDEVNKEYPDAYVRIIGFDNMRQVQCVSFIAFKPPGCDESGKA

SEQ ID NO: 26505 - protein, 531 aa, Oryza sativa (japonica cultivar-group)
MVFGELFSRASLPPPWSLLAYGLVGPVLLWQAGRLLDRLWWRPRRLERALRAQGLRGTAYRFLLGDLREFGRLNEEAWSSAPLPLGCHDIVPRVTPFVHRNVRDNGRPCCFSWFGPIPSVTITDPAQVRDVLSNKLGHFEKPKLPALTKLLADGLTSHDGEKWVKHRRIMNPAFHLEKLKLMLPAFSTCCEELVGKWMDSLGPDGSCELDVWPEMQSLTGDVISRTAFGSSYSEGRRIFQLQTEQAELFIGAIQKFVIPGYMYLPTKKNRRMRRINSEVESILRGIIGKRMQAIAEGESTNDDLLGLLLESNMRHADENGRSSPGMTTEDVIEECKLFYFAGMETTSVLLTWTMVVLSMHPEWQDRAREEVLGLFGRDKPEYEGLSRLKTVTMVLYEVLRLYPPAIVFSRKTYKEMEIGGVVYPRGVILELPVLFIHHDREIWGRDVHEFRPERFAEGISRASNDRGAFLPFGWGPRVCIGQNFALLEAKMALCMILQRFEFELAASYTHAPHTVMTLHPMHGAQMKLRMI

SEQ ID NO: 26506 - protein, 433 aa, Oryza sativa (japonica cultivar-group)
MVCKGKVSITWFGPVPRVTITKPELVREVLSNKFGHFEKLKFGRFQRLLHNGLGSHEGEKWAKHRRIINPAFHLEKLKRMLPAFAACCTELVDKWEGLAKGGDEPYEVDVWPEMQSLTGDVISRAAFGSSYLEGKRIFQLQGEQIELIVATMNKIHIPGYIHLPTKSNRRMKQIAAEIEGMLKRIIAKRESALKAGEASSDDDLLGLLLESNLDHSKGNGGAASSGISIDDVIGECKLFYFAGMETTSVLLTWTMVVLSMHPEWQDRAREEVLHVFGSRAPDYDGLSRLRIVTMVLYEVLRLYTPLTALQRKTYKPMELGGVRYPAGVVLTLPLLCVHHDKDVWGADADEFRPERFAEGISKASREAPAFFPFGWGPRICIGQNFALLEAKMGLSMILQRFSFDLSPSYTHAPFPVGLLQPEHGAQVRLTRLN

SEQ ID NO: 26507 - protein, 1058 aa, Fusobacterium nucleatum subsp. vincentii ATCC 49256
MPKRKDIKTILVIGSGPIIIGQAAEFDYAGTQACLSLREEGYEVVLVNSNPATIMTDKEIADKVYIEPLTVEFLSKIIRKEKPDALLPTLGGQVALNLAVSLHESGILDECGVEILGTKLTSIKQAEDRELFRDLMNELNEPVPDSVIVHTLEEAEKFVKEIGYPVIVRPAFTMGGTGGGICYNDEDLEEIVPNGLNYSPVHQCLLEKSIAGYKEIEYEVMRDSNDTAIVVCNMENIDPVGIHTGDSIVVAPCLTLTDRENHMLRDVSLKIIRALKIEGGCNVQIALDPNSFKYYIIEVNPRVSRSSALASKATGYPIAKIAAKIAVGMRLDEIINPVTKSSYACFEPAIDYVVTKIPRFPFDKFGDGDRYLGTQMKATGEVMAIGRTLEESLLKAIRSLEYGVHHLGLPNGEEFSLEKIIKRIKLAGDERLFFIGEALRRNVSIEEIHNYTKIDLFFLNKMKNIIDLEHLLKDNKGNIELLRKVKTFGFSDRVIAHRWEMTETEITELRHKHNIRPVYKMVDTCAAEFDSNTPYFYSTYEFENESTRSDKEKIVVLGSGPIRIGQGIEFDYATVHAIMAIKKLGYEAIVINNNPETVSTDFSISDKLYFEPLTQEDVMEILDLEKPLGVVVQFGGQTAINLADKLVKNGIQILGSSLDSIDTAEDRDRFEKLLLDLKIPQPLGKTAFNVETALKNANEIGYPVLVRPSYVLGGRAMEIVYNDEDLKKYMEKAVHINPEHPVLIDRYLIGKEIEVDAISDGENAFIPGIMEHIERAGVHSGDSISIYPPQSLSQKEIETLINYTKKLAKGLKVKGLINIQYVASKGKIYVLEVNPRASRTVPFLSKVTGVPVANIAMQCILGKKLKELGFTKDIADIGNSVSVKVPVFSFQKLKNVDTTLGPEMKSTGEVIGTDVNLEKALYKGLTAAGIKIKDYGRVLFTIDDKNKEAALSLAKGFSDVGFSILTTEGTGAYFEEHGLKVKKVGKIDNSEYSVLDAIQNGDVDIVINTTTKGKSSEKDGFKIRRKATEHGVICFTSLDTANALLRVIESMSFRVQGL

SEQ ID NO: 26508 - protein, 547 aa, Oryza sativa (japonica cultivar-group)
MEIVDGASPPLHPWSLLLYALGALAALWWAWRALDRFWLRPRRLGRALRSQGLRGTDYRFPSGYLKEFARLLAAALAAPMPPLSHDVASRALPFELAAIKQHAYTHAPANVRDQTEVAWNAGNVCVTWFGPEVRVIVSDPKLFREILANKNGRFGKQKSILWVQNLLADGLTSHQGEKWVAHRRIMNHAFHLEKLKRMLPAFAACSSELISRWQDSVGADGAQEIDVWPEFQNLTGDVISRSAFGSSFSEGRRIFQLQSEQARNVMKMAKALYFPGYRFLPTELNRRTKANAREVRELLKGIITKRESAMKDGHAVNDDLLGLLLETNIKESQEAGSSKPTMTTKDIIEELKLLYFAGSDTTAVLLTWTMVLLSMHPEWQDRAREEVLRVFGKNSPDFEGINHLKVVTMILHEVLRLYPPILLLGREAYEETELGGVTYPPGVTFALPIAGIHHDPDVWGEDVGEFKPERFAEGVSRASKDSPALVPFSWGPRICVGQNFALLEAKMALSMILQRFSFGLSPSYTHAPFPIPTLQPQHGAQIKLTKL

SEQ ID NO: 26509 - protein, 116 aa, Fusobacterium nucleatum subsp. vincentii ATCC 49256
MKEKLIELVEKEYLRNDIPQFKAGDTIGVYYKVSEGNKERVQLFEGVVIRVNGGGVAKTFTVRKVTAGIGVERIIPVNSPNIDRIEVLKVGRVRRSKLYYLRGLSAKKARIKEIVK

SEQ ID NO: 26510 - protein, 504 aa, Debaryomyces hansenii CBS767
MSTERLIYSPKHLTEVTLEERGLRITDQSLEALHGNDHTHNFLSACLQTDSRTGESESHIPFRNIIWCEKISSDDYQDLYELAYMYSSSQSLKPERIQIQIKSVDPGHAHLSSDINDLSKYILSRAYDKSLISPSILVIINPHGGQGNAVSIYEQKILPILKEAHVNFKYQETKYQGHAMEISKGLDVNRYDIIACCSGDGIPHEVINGFYQRSDKGLEAFNKIAVTQLPCGSGNALTLSTHGSNDASVATLSMLKSQKAKLDLMAVTQGTGNKEKTSLSFLTQCYGIIADSDIGTEHLRWMGPIRFDLGVTYKVLKRSKYPCDIYVNCITESKQDISDHFDKHYKQNYGPKTLTAEEFELKYPGLDQDPPSNWVKLPEITTSNLNILYVGKMPYVSNDAQFFPAALPNDGSMDMIITDTNMSIIDTTSTLLSVSKGTHVYSDKVHHSKVLSYRLVPKLANPDNHYISIDGENFPTEQLQVEIMPGILTGLLNDGNFVDTSFSK

SEQ ID NO: 26511 - protein, 629 aa, Aspergillus oryzae
MRHVLNKEQLLMVKQAAIAWAAAEPLSVENVEVAPPKAHEVRIKILHTGVCHTDAYTLSGKDPEGAFPVILGHEGAGIVESVGEGVTNVKVGDYVIALYTPECGECKFCRSGKTNLCGKIRATQGRGVMPDGTTRFKARGKDLLHFMGCSTFSEYTVVADISVVAVTPSCPTDRSCLLGCGITTGYGAATVTANITEGSNVAVFGAGCVGLSIVQGAVKKKAGKIIVVDINDGKEAWAYKFGATHFLNPARLRKTVQDELIDMTDGGCDYTFDCTGNVSVMRAALEACHKGWGESIVIGVAAAGQEITTRPFQLVTGRVWRGCAFGGVKGRSQLPGLVEDYLNGDLKIDEFITHRETLANINTAFEQMKQGDCIRCVVDMVQYNAVEFCKKGIVYLVTLDKHAIEENLGRTSVLRSENGRSPGTGPESTTGLTISKINMPVSLHPLVDNGITKGDANFPGGNLYCLCPQNKVTVAIKGNVAHNHACGCSKCWKPAGALFSVVGVVPKENLSVAANADKLEILDKAAAIQRYACKECGTHLFGRIEIDHPFKGLDFVHAELSDKKGWQEPQFAGFVSSIIEQGFHPNGMDEVRSKFQSLGLQTYDTLSPPLMDLIATYTGKKNGKLSANL

SEQ ID NO: 26512 - protein, 441 aa, Salmonella typhimurium LT2
MYHGQLKNILLLSLRFIMDKLSYASDSSTSAWNTYLQQIERVAPYLGELSPWVDTLRHPKRALIVDIPVQMDDGTIRHFEGYRVQHNLSRGPGKGGVRYHPDVDLNEVMALSAWMTIKCAALNLPYGGAKGGIRVDPFSLSEGELERLTRRYTSEIGIIIGPQKDIPAPDVGTNGKVMAWMMDTYSMNHGTTVTGVVTGKPIHLGGSLGREKATGRGVFVSGLEAARRANIAVEGARVAVQGFGNVGSEAARLFAGAGARVVAIQDHTATLFNATGIDMKALTAWQTEHKQIAGFPGAETIASDAFWRLEMDILIPAALEGQITRQRAEALTCKLVLEGANGPTYPDADDVLASRGILVVPDVVCNAGGVTVSYFEWVQDMASFFWSEEEINARMDKIMTDAIVHVWEKAAEKSCSLRTAAYIVACERILLARKDRGIYPG

SEQ ID NO: 26513 - protein, 884 aa, Yarrowia lipolytica CLIB122
MKINVIEAAKHAKELWLKKDPRDEDELQSDVQVEVVEVEEHLLEWMGAKLGIPPSDMDGGYPREVHFMAEKLAEMSLEKALELVKTNYDYHDHDNNFRHEYRMEIKGLLDIFKDSPVESEKEDPENILLIRYWATIFDWWSPYPEVRSVTDPFDETDTTVETWRVWVLGTIWVAISAFVNQFFSVRLPAITLDASVCQLLLYPCGRLLQYALPDWGFRFRGKRYTLNPGIWSQKEQLLATVMVTCANGTPYITSNVITQALPIFYNQKWASDYGYQFVFMLTTQMIGFGMSGLLKRVAVYPVKAMWPSLLPTLAVNKALLAPNRKESINGWKISRYNFFMVIFAVSFLYFWVPNYLMNFMQTFNWMTWISPRNADLAIVTGSIEGLGFNPIPTFDWNQATALLAPITLPLYTSVTGFCGALFGGLVILALYYSNNSWTGYISINSNRLFDNKGEVFNVTRILTDYRFDRDKYLAYSTPYYSAGNLVAYSANFSIFTFSFVYTILTDWRAMKDAIVDTAKAVRYIHRSNYYGKVDPYSRYMRKHKEVPDWWFYLVMIIMFVLSVVLVEVWPVDTPVWCIVFVIGLVAVFIIPFTVFLSYTATELTLNVLSELMIGYALPGRFMALNLVKALSVQIAQQAQAYTKDQKLTHYAHLPPRTIFWLQLWATLVNGVVAMGVIQFQLGQEKLCEPDNKMKFTCPEQTTFFTASVAWGVIGPKKMFNKYPVMKWMFLFGACAGLFFFFVQVTMPKLMVRWFPKHADRIDFYRRKFLYFNPLIFVMGIVDGWSPYNLTYKVGGLYLALVFNGYIKGRYLAWWRKYAYVMEAAIVTGIALSAIIIFFSVQYNPKDLDWWGNSVVNAGYDSEGIPPNVQVPEDPGYFGPPPSEW

SEQ ID NO: 26514 - protein, 367 aa, Mesorhizobium loti MAFF303099
MATKHLFLLPGDGIGPEAMAEVKKLISAMNEKLGSGFATDEGLVGGCAYDAHGAAISDADMAKAMAADAVLFGAVGGPKWDAVPYEVRPEAGLLRLRKDMELFANLRPAICYPALAASSSLKQEVVEGLDILIVRELTGGVYFGEPKQIIDLGNGQKRGIDTQVYDTFEIERISGVAFELARTRKNHVTSMEKRNVMKSGVLWNEVVTQTHKARYADVKLDHMLADAGGMQLVRWPKQFDVIVTDNLFGDMLSDIAAMLTGSIGMLPSASLGAPDVKTKKRKALYEPVHGSAPDIAGKGIANPIAMIASFAMCLRYSFGMVDEADRLEGAIAAVLDQGLRTKDIFSPGMTEVGTVEMGDAIIAKFLG

SEQ ID NO: 26515 - protein, 200 aa, Schizosaccharomyces pombe 972h-
MLQSQPIRRKLVVVGDGACGKTSLLSVFTLGYFPTEYVPTVFENYVSDCRVDGKSVQLALWDTAGQEEYERLRPMSYAKAHIILVGFAIDSPDSLENVSTKWIEEINTLCPNVPFILVGMKADLRSDPVAIEEMRRRNQNFVKSQQAELVAQRIGARKYMECSSLTGDGVDDVFEAATRAALTVRDSENDKSSTKCCIIS

SEQ ID NO: 26516 - protein, 308 aa, Oryza sativa (indica cultivar-group)
MASFRLMIAAVSLSLVQLSMGSRRLMELYIPPASDQLTYHHGSVLSGDIPVSILWYGKFTPTQMSIIADFVVSLTGAPNAATPSVGQWWGTIEQLYLSNAATNSQTSTRVRLDEQVSDEQCSLGKSLTLAQIDQLAARVGTKRGGVALVFTDEDVTVEGFCSSRCGKHGSDASAGTTHIWVGNSAKQCPGQCAWPFAQPVYGPQGTPLVAPNNDVGADGMVMILASMVAGTVTNPYGDGFYQGPQDAPLEACSACPGVYGSGAYPGNAGKLLVDATTGASYNANGANRRKYLLPALYNPATSSCDTLV

SEQ ID NO: 26517 - protein, 190 aa, Hevea brasiliensis
SEVLTPADEENHINKHNFRIPFVCGCRNLGEALRRIREGAAMIRTKGEAGTGNVIEAVRHVRSVMGDVRVLRNMDDDEVFSFAKKIAAPYDLVMQTKQLGRLPVVQFAAGGVATPADAALMMQLGCDGVFVGSGVFKSGDPARRARAIVQAVTHYSDPNMLAEVSCGLGEAMVGINLNDKKVERFANRSE

SEQ ID NO: 26518 - protein, 131 aa, Glycine max
QGHNTEGHSWISVLGTAYNVSNWAMEHSAGDDPITNLAGQNVTDVLITYHSGTTWTHLVKAYHGYHLRDLKVSEVTIDYKKLASEFSILCLIDTHGHVHLCTLASVVHKNLIALYAVLRSTIALTHSSSGM

SEQ ID NO: 26519 - protein, 407 aa, Fusobacterium nucleatum subsp. vincentii ATCC 49256
MEKLSLQTKIVLGMQHVLAMFGATVLVPFLTGLNPSIALICAGVGTLIFHSVTKGIVPVFLGSSFAFIGATALVFKEQGVAILKGGIISAGLVYVIMSFIVLKFGVERIKSFFPPVVVGPIIMVIGLRLSPVALSMAGYSNNTFDRDSLIIALVVVITMIFISILKKSFFRLVPILISVAVGYIVAYFMGDVDLSKVHEASWIGLPVGAFDIITTLPKFTFAGVVALAPIALVVFIEHIGDITTNGAVVGKDFFKDPGVHRTLLGDGLATMAAGLLGGPANTTYGENTGVLAVTKVYDPAILRIAACFAIVLGFIGKFGVILQTIPQPVMGGVSIILFGMIAAVGVRTIVEAQLDFTHSRNLIIAALIFVLGIAIGDITIWGTISVSGLALAALVGIVLNKVLPEDK

SEQ ID NO: 26520 - protein, 439 aa, Pseudomonas syringae pv. phaseolicola 1448A
MTYKLPTTATAPFCPSATTDSVSIPSNASLLRKMMLFVGPGLLVSIGYMDPGNWATAIEAGSRFGYSLLFVVVLASLSGMVLQNLCSRLGIATGRDLAQLSAARYSRNVAKGQWLLAELSIIATDLAEVLGAALAFHLLLGVSITTGVALTAFDTLIVLALQGANFRRLEAIVLGLIATIASCFAIELFLIKPFWPDVVAGLKPSWDVLSSQEPLYIAIGILGATVMPHNLYLHSSVVQTRVNGADLASKATAIRYARLDTIGSLSLALLINAAILILAAAAFHKTGHTEVVEIQDAYHLLDPLVGGAIASVLFGVALLAAGQSSTFTGTIAGQVVLEGFLQAKIPCWQRRLITRALALIPALIGVIWLGDSSVGKMLVLSQVVLSLQLPFALWPLIRFTSDPQLMGPFVNSRLVKIAAWGLFGLISAANLTLLWFWVS

SEQ ID NO: 26521 - protein, 251 aa, Zea mays
  misc_feature (148)..(148): Xaa can be any naturally occurring amino acid
  unsure (1)..(251): unsure at all Xaa locations
MANEFPDEVLKSVFPLLDGKDLVFCMLVCRQWHEIAKDDYFWKCICSRKWPSICKQPPSGANYKKLYLTFSKPREMQNLPVPRLTFEDIVFYIDMWLEGSLIFSQAVSGRTLRAGLQGAPPPGIPDILAAHLSSQDCILMLEVEPKLXVPMGPAITVSVLANRKDSNKMACIINKSTFDYIDSNAARALAYEYLRFSPRHPFTSDIRAWMSLLFLCKGANTIEVFGIELDFCDAAKSEKEILWLLDMLDWK

SEQ ID NO: 26522 - protein, 1554 aa, Ustilago maydis 521
MASTSHQPPIVSPPDMQDVESTNNMGAAPLACVSSRGTWGEPERGEHVNVDQAMQDFQLVRQSSRGSVSSANAAASSSGLRGASAIGRALSGGDHKKQPKINENELDLENVPSEETYENDFDLGKWLLTRSAQAKDEGIHDGKPVGMLWKDISIIAPGSGGGGIFVKTLPVAIANTAWRDPIGILATLIPPLSKLSIARNMTTTTLLYSSNGILKPGEMLLVLGRPGSGCSTMLRAITSKNHTNVSALGKILYGGLSPDQINRKYRGEVVFVDEEDTHFPTLTVGQTLQFALKNKVPHRSRRLKGESRQQFIETCIEVMLKMFGMTHVRDTIVGDQAVRGVSGGERKRTTISEALATRASVIAWDNSTRGLDASTALDYARSLRIITDLAQRSTIATLYQVSESIFDLFDRVAIIDQGRCIYYGPRKFVRSYFYELGYDTPDRQTTADFVTALTDVNQVVFRPGMQNQAPKTAQDRERVWRSSNLYHQLEAEMESYEHHLAQAEQADQLKQTVRSEKRKGVNKGSSYTVSFWDQIVSCIWRQLLIKWGARGDLYVKLFTIISVSFMISSLFYKQPFDSEGVFTRGGILLFACLFNGWLQLSESFEAVAGRPMLSRHHQFAFYRPSAVVLARALVDIPFLLVQCLLSSIIIYFLANLRSDAGAFWIFYVYCFLSSYSLTALYRMCAAFSPGFNEAIRFSVLALNLLIIWVGYVLRRPQMNWMIWLSYAQPISYAFEGFLANELNYPINCTSQQIVPFGEVRDVAYQTCSLTGGEPGSVIVQSADYLSVTFGYSRSHIGRNVGVMIAFAVLYLIPTVIGAEIINFGGAGGGVTVFARTKAAKAKLAASKPAGNDDIEEKAVVAADIPSSSDSNGSITRANSPADPGKKGNGSDKQALTKTAQELDKKAIFTWKNVSLQLPTGRKLLDDITGYVKPGTITALMGASGAGKTTLLTALSQRGVSGNLSGDILVDGKPLGPGFQRDTGFVLQGDVHLASQTVREAIEFSALLRQPAEVSRAEKLADAKRAIELLELEDLQDALIGVPGFGLGVERRKRVTIAVELAAKPDLLLFLDEPTSGLDSAGAASIVRLIRRLASEGQAILCTIHQPSALLFESFDNLLLLQPGGKTAYMGQIGNERSKGSDRVREYFERNGAPACAPTTNVAEYMLEVVAQKTQKPWSERWKASPEAKALREQVDAINAERAGRAMIQDSRAEREYSATLKTQIIECTKRQFRDLWRDAPFAYGILFSNFVTGFAAGGGFAHLGNSTTDLQYRVFVVFLVILNFPATVNSIISKFWEMRITFTVREGPSKTYSWIAFMTAFVAVSIPIALVASVLFFLPSFFLPLYSQRSTVAGMWYFMIFLVTCYEMFFSLALAAACPTPVTAANLLPFLLPFIAIVNGVIKPKSTLPAPWSGLIYANPLYWYVRSMVGNVLHDLPVRCRQEDLAIFDAPANQSCAQYALEWVESVGGQLLNPDSNSRCEFCQYQVGDQFAATLGATWDFRWKGVGIVAGYTIGQLLLAYAAYWYFTEKGYGIGARLISALVEKVKRLGKRRQ

SEQ ID NO: 26523 - protein, 294 aa, Pisum sativum
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFSKDQRQVKMFLYQILCGIAYCHSHRVLHRDLKPQNLLIDRSSNALKLADFGLARAFGIPVRTFTHEVVTLWYRAPEILLGSRHYSTPVDVWSVGCIFAEMINQRPLFPGDSEIDELFKIFRITGTPNEDTWPGVTSLPDFKSAFPKWPSKDLATLVPSLEPSGLDLLSSMLRLDPSRRITARGALEHEYFKDIKFVP

SEQ ID NO: 26524 - protein, 316 aa, Oryza sativa (indica cultivar-group)
MSHAAIVLVSVLLLCSAHPSAGARRLMELYKPPPSEQLTYHNGTVLRGDIPVSVVWYGRFTPAQKAVVSDFLLSLTVASPAPTPSVSQWWNTINQLYLSKAAAQGKNGGGGGKITTQVRLAGQLTDDQCSLGKSLKLSQLPALAARAKPKKGGIALVLTAQDVSVEGFCMSRCGTHASNAKARTAYVWVGNSATQCPGQCAWPFHQPVYGPQTPALVPPSGDVGMDGMVMNIASMVAGVVTNPFGDGFYQGPKEAPLEAATACPGVYGSGAYPGYAGNLAVDPATGASYNANGAHGRKYLLPALFDPATSTCSTLV

SEQ ID NO: 26525 - protein, 553 aa, Candida glabrata CBS 138
MSFAGYSGNSNSNSHFKRRNTTQTDRDGANTHNKRSRPNNYSKNADFAKSNDMNDRNNSKPEFTGSRYQGGKASRFPKKDYEESSNKNRNRNQNTKRFQSTKPNRKLNVNESRFREDYNNKHGRISTRYNNFTTGNTSDIRTNGNNTPLRQDDRNTITRPSNNANNNQDSGRKIFELPKGPKSTISRYNTGEPYKGTKPQSIPTPTLPTTFLSRPMNDSVYERLLQVGEGTYGKVYKARNTVTKELVALKKLRLQGEREGFPITSIREIKLLQSFNHENVSTIKEIMVESQKIIYMIFEYADNDLGGLLLNKQININAAQSKHIFKQILHGIEYLHDNNILHRDIKGSNILIDNQGSLKLTDFGLARKIDCNRDAIRDYTNRVITIWYRPPELLLGTTNYGPEVDMWGCGCILVELFNKMAIFQGTNELEQLEAIFKVMGSPSIEQWPNIFDMPWFFMIMPQQATKYPNVFEEKFRAVLETDNCFKLAQGLLRYDQEKRLTASEALQSEYFKEDPQPQPLILNDAISCHEFEVKLARKQQKKKEQSKSTTSSA

SEQ ID NO: 26526 - protein, 384 aa, Pisum sativum
MAIHHHHHHHQQLHHNSLLDALYCDEEKLEEEQEDVSSQQSDVTTNNDNNILDSTSLFPLLLLEQNLFSQDEELTTLFSKEKTQQETYYEDLKNVVDFVSLSQPRREAVQWMLKVNAHYAFSPLTATLAVTYFDRFLLTFHFQKDKPWMIQLVAVTCISLAAKVEETQVPLLLDLQVQDTKYVFEAKTIQRMELLILSTLKWKMHPVTPHSFLDHIITRLGLKTNLHWEFLRRCENLLLSVLLDSRFVGCVPSVLATATMLHVIDQIEESDDNGVDYKNQLLSILKINKEKVDECYNAIVEVTNENNYGHKRKYEQIPGSPSGVIDAVFSSDGSNDSWKVGSSSYSTSEPVFKKTKTQGQNRNLSPLNRVIVGILATASATTSP

SEQ ID NO: 26527 - protein, 129 aa, Haemophilus somnus 2336
MTKIIHTEKAPAAIGPYVQAVDLGNLVLTSGQIPVNPATGEIPADITTQARQSLENIKAILAQAGLTVADIVKTTVFVKDLNQFATVNAEYERFFVENNHPTFPARSCVEVARLPKDVGIEIEAIAVRQ

SEQ ID NO: 26528 - protein, 369 aa, Arabidopsis thaliana
IVVGEGETAPVGAAIGLLAETEAEIEEAKSKAASKSSSSVAEAVVPSPPPVTSSPAPAIAQPAPVTAVSDGPRKTVATPYAKKLAKQHKVDIESVAGTGPFGRITASDVETAAGIAPSKSSIAPPPPPPPPVTAKATTTNLPPLLPDSSIVPFTAMQSAVSKNMIESLSVPTFRVGYPVNTDALDALYEKVKPKGVTMTALLAKAAGMALAQHPVVNASCKDGKSFSYNSSINIAVAVAINGGLITPVLQDADKLDLYLLSQKWKELVGKARSKQLQPHEYNSGTFTLSNLGMFGVDRFDAILPPGQGAIMAVGASKPTVVADKDGFFSVKNTMLVNVTADHRIVYGADLAAFLQTFAKIIENPDSLTL

SEQ ID NO: 26529 - protein, 503 aa, Schizosaccharomyces pombe 972h-
MSTKLVDHVEITVPTGKTYIQPVGLFINNQHVDSVHGGRVKVYSPSTEKLICEVADADEEDVDIAVKVARAAFQTDAPWRKFSSAQRGRCLSRLADCIEQNLEYLASIETLDNGKSITLARGDVQAAADCFRYYGGWADKDYGQTIETDIKRFAYTRHEPIGVCGQIIPWNFPFLMCAWKIAPAVACGNTIILKTAELTPLSALCLTKFVPECGFPPGVINVLSGDGRRCGNAISSHMDIDKVAFTGSTGVGRMVMRAAASSNLKKVTLELGGKSPNIVFNDADLDSAAVWTNYGIFYNSGQVCCAGSRVYVQEDVYDEFIKRMVAKAKTLKVGDPFAEDTFQGAQVSKQQYERIVSYIESGIAHGAKLEIGGKRHGNLGYFVEPTILSNVTEDMAVGKEEIFGPVLAVIKFKTIEEAIRRGNNSTYGLAAGVHTNNITNAIKVSNALEAGTVWVNCYNLLHHQIPFGGYKESGIGRELGSYGLTNYTQTKAVHINLGMDSPI

SEQ ID NO: 26530 - protein, 366 aa, Arabidopsis thaliana
MKPIVCDKGHGMVQAGFAGDEAPKVVFPCVVGRPRDGLNPNESYVGEEGHANRDILTLKDPMEHGIVNNWDDMEKIWHYTFYNELRVDPEEHPVLLTEAPYNPKANREKMTQIMFESFDVPAMYVSMQSVLYLYSSGRTTGVVLDLGERVSHTVPVYEGYALPHGILRLDLGGRDLTDYLIEIMTERGYTYTTSAEREIVRDIKEKLCYVALDYEQEMEKTTKGWTIDKTYVLPDGQEITIEAERFMCPEVLFQPSVIGKESSGIHEATRNSILKCPVDTRRDMYGNILMTGGTTMLHGIKERMTKELNALVPSSMKVKVVVPPESECSVWIGGSILASLSTFHQMWITKDEYEEHGAAIVHRKCV

SEQ ID NO: 26531 - protein, 479 aa, Prochlorococcus marinus str. AS9601
MAERFSQKNLRVRPSSDEEKIVTNAKKHFEKTLVEISGELVGSVAALEHPTKNKKLNYGEIFLRDNVPVMIYLITQKRYEIVKKFLSVCLELQSSNYQTRGVFPTSFVEENGQLIGDYGQRSIGRITSADASLWWPILCWYYVNKSGDYAFGKSQSVQRGIQLLLDLVLHPTFEGTPVLFVPDCAFMIDRPMDVWGAPLEVEVLLHGCLKSCINLMELSRADHVSRLLDQRLILTNQWVKDLGSFLLKHYWVTSQTMQILRRRPTEQYGDDQHFNEFNVQPQVVPSWLQDWLENRGGYLIGNIRTGRPDFRFYSLGNSLACMFGVLPPEEQRALFRLVLHNRQHLMAQMPMRICHPHMDVEEWQNKTGSDPKNWPWSYHNGGHWPSLLWFFGTAVLLHQKHYGSDDVILMEEMKSLIEESYWCQLNQLPKQEWAEYFDGPTGTWVGQQSRTYQTWTIVGFLLMNHFLRNEYNDLDMFKI

SEQ ID NO: 26532 - protein, 453 aa, Mycobacterium tuberculosis
MNELLHLAPNVWPRNTTRDEVGVVCIAGIPLTQLAQEYGTPLFVIDEDDFRSRCRETAAAFGSGANVHYAAKAFLCSEVARWISEEGLCLDVCTGGELAVALHASFPPERITLHGNNKSVSELTAAVKAGVGHIVVDSMTEIERLDAIAGEAGIVQDVLVRLTVGVEAHTHEFISTAHEDQKFGLSVASGAAMAAVRRVFATDHLRLVGLHSHIGSQIFDVDGFELAAHRVIGLLRDVVGEFGPEKTAQIATVDLGGGLGISYLPSDDPPPIAELAAKLGTIVSDESTAVGLPTPKLVVEPGRAIAGPGTITLYEVGTVKDVDVSATAHRRYVSVDGGMSDNIRTALYGAQYDVRLVSRVSDAPPVPARLVGKHCESGDIIVRDTWVPDDIRPGDLVAVAATGAYCYSLSSRYNMVGRPAVVAVHAGNARLVLRRETVDDLLSLEVRHHHHHH

SEQ ID NO: 26533 - protein, 453 aa, Mycobacterium tuberculosis
  misc_feature (1)..(1): Xaa can be any naturally occurring amino acid
  misc_feature (139)..(139): Xaa can be any naturally occurring amino acid
  misc_feature (193)..(193): Xaa can be any naturally occurring amino acid
  misc_feature (339)..(339): Xaa can be any naturally occurring amino acid
  misc_feature (415)..(415): Xaa can be any naturally occurring amino acid
  unsure (1)..(453): unsure at all Xaa locations
XNELLHLAPNVWPRNTTRDEVGVVCIAGIPLTQLAQEYGTPLFVIDEDDFRSRCRETAAAFGSGANVHYAAKAFLCSEVARWISEEGLCLDVCTGGELAVALHASFPPERITLHGNNKSVSELTAAVKAGVGHIVVDSXTEIERLDAIAGEAGIVQDVLVRLTVGVEAHTHEFISTAHEDQKFGLSVASGAAXAAVRRVFATDHLRLVGLHSHIGSQIFDVDGFELAAHRVIGLLRDVVGEFGPEKTAQIATVDLGGGLGISYLPSDDPPPIAELAAKLGTIVSDESTAVGLPTPKLVVEPGRAIAGPGTITLYEVGTVKDVDVSATAHRRYVSVDGGXSDNIRTALYGAQYDVRLVSRVSDAPPVPARLVGKHCESGDIIVRDTWVPDDIRPGDLVAVAATGAYCYSLSSRYNXVGRPAVVAVHAGNARLVLRRETVDDLLSLEVRHHHHHH

SEQ ID NO: 26534 - protein, 385 aa, Erwinia carotovora subsp. atroseptica SCRI1043
MSAALIPDSKLPSLGTTIFTQMSALAQQHQAINLSQGFPDFDGPDYLQQRLAYHVSQGANQYAPMTGVSPLRQAIAEKTEALYGWRPDADSEVTVTAGATEALFAAIAALVRPGDEVICFDPSYDSYAPAVTLAGGVLKRIALQPPAFRVDWSSFTDLLSDRTRLVILNTPHNPSATVWQKTDFEQLWQAIAARNIFVLSDEVYEHICFDNEGHASVLAHPSLRQRAIAVSSFGKTFHMTGWKVGYCVAPAALSAEVRKVHQYLTFSVNTPAQFAIADMLREQPQHWRELPDFYRARRDRFINALAGSRFEILPCEGTYFLLADYRAISDLDDVSFCRWLTEHVGVAAIPLSVFCADPFPHTLIRLCFAKQEATLDAAAERLCQL

SEQ ID NO: 26535 - protein, 443 aa, Staphylococcus epidermidis RP62A
MKNYDLIIIGFGKAGKTLAAHAASHGQKVAVVEQSTKMYGGTCINIGCIPTKTLIHDGIEGSSFKEAITRKKEVVQALNNKNYQGLNSKDNIDVLNYKANFISNEVIELQDNNGTIQETITADKIVINTGSRANIPDIKGIDTAQNIYDSTGLLNIDYQPQELVIIGGGYIALEFASMFANFGTHVTILERGDAIMTNEDQDIANLIVKDLQDKGVTINTNTSTIAFSNNKDQTIIHTNHGEISADTVLLATGRKPNTNHLGLENTDVKIGKQGEVIVNTHLQSTVKHIYAAGDVKGGLQFTYISLDDYRIIKSHLFGDGSRTTENRGAIPYTVFIDPPLSRVGLIASEAKLQGYDILENKVFVSNIPRHKINNDSRGLFKAVINKDTKEILGASLYGKESEELISLIKLAIDQHIPYTVLRDNIYTHPTMTESFNDLFLEPL

SEQ ID NO: 26536 - protein, 443 aa, Cryptococcus neoformans var. neoformans B-3501A
MSSDKFISNLFSLSLFDTPPTAMSFFKSRSASASTASLKPESLGPKTSEVFTVPPQESSVKKRWEYDDHQLGLIAQLKEYTKTIALPESDEYYPWEQRFLSDPATHARYMRAAKWKLHDGKHRIRGTMEWRREYKPELIQPDDVGVEAETGKIILTGFDMDARPILYMRPGRENTETSPRQIRHLIYHLERAIDLMPPGQEQVAIIVDYKSATSQSNPSIGTARKVLHILQNHYVERLGRGLVVNMPWWINAFFSGISPFMDPITRDKIRFNPRLLDLVPAAHLDSEFGGDYNFTYDYSVYWKTITEFCHIAPNGRRVPPPGKEEEGKGREGWIPPAGNGIKAAVEGYVPKEGTVKSGEIVKAGEKNEKSEKTGKGAAATSANGVAGAAPTASSTTSPAPPEKEMESLAIQTAPGEPIGGSVFDHPPSEGEVHEAKQSLNVSA

SEQ ID NO: 26537 - protein, 723 aa, Mycoplasma gallisepticum R
MMDFQSVNNRLEDFKQILIKNNYSEASIKKFLSAFEFAKFWHADQKRKSGEPYIIHPLETSIKLAEWKMDDDTIIAGLLHDLLEDTSVDKRLISSTFNNNVLDLVKAVTKISSEAKKNREGLLLHKNELDYTIRVFSSISKDLRPIIIKIADRFHNLSTIQYLKSDRQKIIAQETFDIYAQIAGRLGMYWIKTQLLDITFKIINPTAFDDTQSLINAHKLINSLKWINFEQQIKKILDGNHLNYELTSRIKSVYSTYQKLNYRHNSQNIKNIHDIYALRIIVENEFDVYQVLGLVHLNFKYIPRLFKDYICAPKNNLYQSIHTTVLVDGTLIEVQIRTKSMDRNSNLGLASHWAYKLNIDISETDEYKTEVLNRFQVDIFNEKRARDLTLIKDLTKGSLIDVLVSNNNKNYSLSSSVTALELAYRVDPKQFIFLDKIMCSNDNILFDKLLEDGDVVSFEYSNEIKINESWLKRIKNPAIKKELIAIIEQLNQYEDSEKEFLEKLRKHLKKNVISQNDILERVKILGFKRLSDYVKYVNKTNFTDNEQYDFFSKNYNWKKILKKLKVHKPKWLFLNSYFKEIPGINFASIKISTCCSILPYIPSAGLIQKNILNVHSPNCKNINKLNNEKIIALHWSEEKLAARPRLFRSYVKLQGAWSGNVVNDILLIIINNNAKLFSLNVTKDKKNNTFMADLGIYVQDMRHLNFIMDEITLKDMSFNWNLL

SEQ ID NO: 26538 - protein, 235 aa, Pisum sativum
SKMRAILIDWLVDVHTKFELSPEALYLTINIIDRFLAISLVSRRELQLVGISAMLMASKYEEIWPPEVNDFVCLSDRAYTHEQILIMEKTILGKLEWTLTVPTPFVFLVRFLKAASVSLPSSDLALENMAHFLSELGMMHYATLMYSPSMMAAAAVYAARCTLNKSPVWDETLTMHTGYSEEELMGCARLLVSFHSASGSGKLKGVYKKYADPQKGAVAVLPPAKNLVSSAAVGS

SEQ ID NO: 26539 - protein, 178 aa, Mycoplasma gallisepticum R
MKTELIAQLKKTIITVKDFPKPGILFYDITPILLDPKLFDQVISVMAEVAKKSNADMIASPESRGFLFGVPLANKLKLPFVLVRKQNKLPRATFSASYDLEYGKNNVIEIHQDAIKPNSKVMIVDDLLATAGTVDAISRLVKQAKSEVVSYSFLIRLKDLGGIDKLDQTKPIDYILEY

SEQ ID NO: 26540 - protein, 196 aa, Dehalococcoides ethenogenes 195
MTKRTASIKRQTTETTISLSLNLDGSGQAEMCTGVRLFDHMLSQLAKHGLFDINVSANGDDIHHLVEDVALTLGKAFNEALGERKGIVRMADATVPMDDSLATVALDLSGRGYAVVDLPFSKNDLTGFPTDLVRHFLETFAIEGRLNLHARILYGSNDHHKAEALFKALARALDKATSLDPRREGIAPSTKGMLEN

SEQ ID NO: 26541 - protein, 302 aa, Prochlorococcus marinus str. NATL2A
MNKSALLSPAPFGRLLTAMVTPFDDEGKVDYGLAADLANYLVDQGSDGIVVCGTTGESPTLSWQEQQKLLETVRNSLGSRAKVLAGTGSNSTSEAIEATKEAANSGADGALVVVPYYNKPPQEGLEVHFRAIANAAPKLPLMLYNIPGRTGCSISPSIVSKLMDCSNVVSFKAASGTTEEVTQLRNYCGSDLAIYSGDDALVLPMLSVGAVGVVSVASHLVAPNLKKLIESFLEGKYSEALYLHETLQPLFKSLFATTNPIPVKAALQLIGWSVGPPRSPLVSLNSEMKEELVKILSSLRLI

SEQ ID NO: 26542 - protein, 363 aa, Schizosaccharomyces pombe
MSKKPVLNLDTSNGFSEEYISHPERNDNQGIVEITDLVFSSESKLTQRKESRDSKTFVPSFLEELDDDHLHELVTNGGILYMNSLGEGVSGSVRKCRIRGTQMIFAMKTVKAAPNTALQKQLLRELKINRSCTSPYIVKYYGACYNNAECQLNIAMEYCGAGSLDAIYKRVRSQGGRTGERPLGKIAFGVLSGLSYLHDRKIIHRDIKPSNILLTSKGQVKLCDFGVSGELVNSLAGTFTGTSYYMAPERISGGSYTISSDIWSLGLTLMEVALNRFPFPPEGSPPPMPIELLSYIINMPPPLLPQEPGIKWSKSFQHFLCVCLDKDKTRRPGPQKMLTHPWVKAFERIHVDMEEFLRQVWSD

SEQ ID NO: 26543 - protein, 329 aa, Arabidopsis thaliana
MKQASSSSSCNPTSLTNRLKTIFKKAEELSILCAIDVCVIYYGPDGDLRTWPKDRETVKNMALRYKEDRKRKKCLNLHEFLEKEKVKDKDKYKGKTNYVKNPNWYPNFDHYSPQQLSQLIQSLERTLSTLQKRLRIVESQKKQNTNLVHQSLTPSYLNQTQHLDPSKFSLYMYNHGDATLSQLPLSASQSNQLINYQMQHGFGQNMCLDNITNNNNFQHPGVSNTQDYSPLLSANNYGLNNHLMQQQDQLHGFDQNLCMMSEIINNNNGLQHPNLSNTVPHEFPYGNTSFSQDMFSSYDGSSLLQTSSLPPLHNIPNSYCFSDNSRLLC

SEQ ID NO: 26544 - protein, 337 aa, Zea mays
MEMLSMLKVGYTILRSETPATDLVNTFMDWAARRSLMLLAIFLPPYYIYKLTTSAFAAAVPEDVAGKVVLITGAASGIGQQIAYQYAKKVARLALVARMVGSLHDVAARARDGGSPDVLVVAGDVAKPEDCRRFVQATVEHFGRLDHLVNNAGVANVCWFEDVPDVAALKRVLAVNFWGAVHATHCALPHLKKSGGGKVFVNSSAAAALAMPGMSLYNASEAAVLNFFETLRVELRDEVGITIATSGWIVSEMTGGKQLSKEGTVEVAVRCAEATVDAICRGRRHLTVPLWYRALFLWRALAPEVVEFSQRLLCRRTAVPRRTAGGRRTREPRPPRE

SEQ ID NO: 26545 - protein, 211 aa, Neisseria meningitidis MC58
MPMNLFQNAKFFTTINHLKDLPDTPLEIAFVGRSNAGKSSAINTLTNHVRLAYVSKTPGRTQHINFFELQNGNFMVDLPGYGYAQVPEAVRAHWVNLLGDYLQQRKQLIGLVLIMDARHPLKELDIRMLDFFHTTGRPVHILLSKADKLSKNEQIKTLSQVKKLLKPYSDRQNISVQLFSSLKKQGIDEANRTVGSWLDAADAAASSPEEN

SEQ ID NO: 26546 - protein, 355 aa, Arabidopsis halleri subsp. halleri
ISYLTYDRADMAFAHYGPFWRQMRKVCVMKVFSRKRAESWASVRDEVDKMVRSVSCNVGKPINVGEQIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLGFYSEEAKLVSEAADLQNSIKLTRDNIKAIIMDVMFGGTETVASAIEWALTELLRSPEDLKRVQQELAEVVGLDRRVEESDIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 26547 - protein, 208 aa, Phanerochaete chrysosporium
GAGGETTAGTLTFVVYFLTQHPNVLQRLRQEILDVVGPSNLPTYDDIKQMKYLRAVLNETLRLYPPVPWNMRYAVKDGILPNSEPDGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRHI

SEQ ID NO: 26548 - protein, 1255 aa, Oryza sativa (japonica cultivar-group)
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILNSSARLKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQVYVLGLFWNGNSIIGILKFAPLSQQTCPVICFACLMCLRFFNSHLLATYETEELMGEVNSCKEMKSVCNWFALARQLIILLSVLVSCPGCQDFLSSLKMSHSSDEDSEISDSEIDEYADKFYARLVAGEFKVKDGQSYSCPFCSGKKKKDFNINNLIQHASGVGAASNRQAKDKATHRALAKHLKNGLTKSSGQQSQTAVVEPQPLPNRDEKFVWPWMGVLVNVPTEWKDGRQIGRSGNHLKEQLSRFCPLKIIPLWNFRGHSGNAIVEFGKDWHGFRNALAFEDYFGKEGYGRRDWKEKQNQGSNLFGWVARAEDHTSPGLIGDHLRKNGDLKTINDLENEGARKTDKLVANLANQIEVKNRHLQELEVTYNERTTSLEKMMGQREQLLQKYNEEIRKMQQLAQRHSQKIIDENQKLRSELESKMSELNTRSKELDEIAAKSDYDRRIIDQEKQKNAIKSSHLKLATLEQERADENVLKLVREHKREKEAAVKKILKLEQQVDAKQKLELDIQQLKGKLEVMKHMPGDEDSALKNKIDELSEELQEKMDELDAMESLNQTLVIKERKSNTEMQDARKELENGLLDLLDGQSHIGIKRMGELDLEAFSKACRKMSSEEDAEITAAILCSKWQAEIKNPDWHPFRFVLVDGQEKEIIEDDAKLQELKEEHGEDIYRLVRDALCEINEYNPSGRFPVGELWNFKDKRKATLKETVQFVLRQWRANRRKR

SEQ ID NO: 26549 - protein, 323 aa, Fusobacterium nucleatum subsp. vincentii ATCC 49256
MLDTEIIEIAKNIYDTEIKSLEMRMNKLSENFVKVVRKIYDCKGKVVVTGIGKTGIIGKKISATFASTGTTSIFMNSTEGLHGDLGIINQEDIVLAISNSGESDEILAIMPAIKNIGAYIIAMTGNINSRLAKASDLYINTHVEEEGCPINLAPMSSTTNALVMGDALAGCLMKLRNFSPQNFAMYHPGGSLGRKLLTRVGNLMKTGEALALCKADTSMEDIVILMSEKKLGVVCVMNEENNILVGIITEGDIRRALSHKEEFFKLKAKDIMTTKYTKVDKEEMATQALSIMEDRPHQINVLPVFDKEKFVGVIRIHDLLKVR

SEQ ID NO: 26550 - protein, 621 aa, Zea mays
  misc_feature (286)..(286): Xaa can be any naturally occurring amino acid
  unsure (1)..(621): unsure at all Xaa locations
MFTIVNRGNKPLGFREVKTTPLSQGGKAKLIRLRPPHGSGNLGANPANSCPLTPLGFLERSATVFGDCHSVVYHDTVFTWFHTHRRCFRLATVLVSLGITCGDVVSVILPNVPAMFYMQFGVPMIGPVLAIINTELDARTVPVLVHLSGSKLVFVDPSSLQLIGDALRLLPPGHPIPHVIPVEDPHEEFPAAPADTLTYERLLDKGDPEFVWVQPESEWDPMVINYTSGTTSEPKGVVHCHRGTFLITVDSLIEWSVPPRPTYLWTLPMFHANGWSYPWGMAVVGXTNVCLRRVNAATVYAAIASRGVTHLCCAPVVLNMLANAPEGVRRPLPGKVHVRTAGSPPPAAVLQRTEAIGFEVSHGYGLTETAGLPVSCTWKGEWDSLPASERARLKARQGVRTPATGKVDIMDSETGCSVPRDGSTMGEIVLRGGCVMLGYLDDNAATKAAIREDGWFYTGDVGVMHPDGYLEIRDRSKDVIINAGENISSVEVESVLYSHPAVNEAAVVARPDELRGETPCAFVSVKDYAAGTVTAADITAWCRERMPQYMVPRTVVFHTELPKTSTVKIQKYVLRNLAMEMGPARKADGATANGSRRQQQLDVVVCWGFNHAQMHSLSFPS

SEQ ID NO: 26551 - protein, 203 aa, Triticum aestivum
  misc_feature (78)..(78): Xaa can be any naturally occurring amino acid
  misc_feature (82)..(82): Xaa can be any naturally occurring amino acid
  misc_feature (107)..(107): Xaa can be any naturally occurring amino acid
  misc_feature (145)..(145): Xaa can be any naturally occurring amino acid
  misc_feature (151)..(151): Xaa can be any naturally occurring amino acid
  unsure (1)..(203): unsure at all Xaa locations
MFVHECGGCHLGSPVQQGTIVCRVNLLSEDMASKLGAMTIECIEYFSSLVDPVDIVSLKFMLLCSIMVIHNVDVAGIXSSKXSLKSVGLDVDAMRAVVDNSSKRYLXTRNPCLVFSKVMLEEDPIVHRHLSSLYDTLLDQDLYQXMSERYXRVEIQHVIMMVEWTIVTVEKKLSQRFLVKKSARSLDHGAGSSKSLMRQKHRP

SEQ ID NO: 26552 - protein, 333 aa, Zea mays
  misc_feature (77)..(77): Xaa can be any naturally occurring amino acid
  unsure (1)..(333): unsure at all Xaa locations
MSSRMAGAALLRHLGPRLFAAGPAVSGLTARGGMPAAARLLPARMASTAAEAAREDAGANKQHGGTEKHEEEAAGGXQSKKAVVSYWGIDTPKLVKEDGTEWKWTSFRPWDAYTSDTSIDIGKHHAPTTLPDKAAYLIVKSLRVPMDLFFQRRHASHALLLETVAAVPGMVGGMLLHLRSLRRFEHSGGWIRALLEEAENERMHLMTFLEVTQPRWWERALVLTAQGVFFNAYFVGYLLSPKFAHRVVGYLEEEAVHSYTEYLKDLEAGIIDNTPAPAIAIDYWRLPADAKLKDVVTVVRADEAHHRDVNHFASDIHYQGMKLKDTPAPLSYH

SEQ ID NO: 26553 - protein, 321 aa, Haemophilus influenzae Rd KW20
MIKKIAVLTSGGDAPGMNAAIRGVVRSALAEGLEVFGIYDGYQGLYNNKIKQLNRYSVSDVINRGGTFLGSARFPEFKDPNIRAKCAEILRSHGIDALVVIGGDGSYMGAKLLTEEHSFPCVGLPGTIDNDVAGTDYTIGYQTALQTAVDAIDRLRDTSSSHQRISIVEIMGRHCSDLTISAGIAGGCEYIVASEIEFNREELIQQIERSIIRGKRHAIIAITELLTDVHSLAKEIEARVGHETRATVLGHIQRGGSPCAFDRILASRMGAYAVDLLLQGKGGYCVGIQNEQLVHHDIIDAINNMQRVFKADWLKVAKRLE

SEQ ID NO: 26554 - protein, 437 aa, Ustilago maydis 521
MAESNNTDLPTATATSYKPGEATMLALTFHGTQDVRLTEVRTPTITDPTDVVVRSTGVTICGSDLHLYHNKIPDLKKGDILGHEGTGVVEHVGAQITKFKVGDRVVASFSIACGTCEQCKAKLFTMCDRTNTSAKMDELYGQKLGGILGYSHLLGGYAGTQAEYFRVPFGDVNCFHVPDSVSDETALLMADVTLTAYHSVVDIKFQEGETAAIWGAGPIGQLIAQWLLKVFGARKVMLIDNVAPRLHWAQERLNGLETINFDQTPQVAEEVMHKVAGGVDVSFDAAGFRYAKSLKHQTMQTLGVETDTPEIINEAIRATRKFGRISVIADYVGQCNEFLIGAMMEKGILLKGNGQAPVQAYMEQVFEDYIVPGKFDPTLILTHRFKLEDIAKVYKAFDEKRIDEHKGGIPIIKTFIETKASKPRAASTPELSSVPGF

SEQ ID NO: 26555 - protein, 135 aa, Zea mays
MVFVWLTAFFLVVALIVLVIYQLMCLADLEFDYINPFDSSSRINKVVMPEFVLQALLSVLFLLSGHWAMLLLSLPMVYYNYTLYQRRQHLVDVTEIFNQLGREKKRRLFKIVSLIVLLFLSLFWMIWSVLSEEDE

SEQ ID NO: 26556 - protein, 289 aa, Archaeoglobus fulgidus DSM 4304
MFEGVIPAMVTPFKEDFSVDYEGIAKNLDYLEKHVNALVPAGTTGEAATLSYEEHIDVVRYVAETSKLPVIGGAGSNSTREAIWLAKEVEKAGAEAAMLVTPYYNKPNAEGLYQHYKAVASEVSIPIIVYNVPSRTGINTTPELVRRLAEIDNIFGIKEASGNLKQISEIIRTTPDDFVLLSGDDFLTLPILCLGGKGVISVAANVAPHLMKEMYEAFVEGNIERAREMHHRLTPLFDVLFIDTNPIPVKKALQLMGLAAGKPRLPLVELSEEKTQKVKEVLKSLELIS

SEQ ID NO: 26557 - protein, 482 aa, Pseudomonas putida KT2440
MPSEHSAGSPAGSSVDFEKVGSDYFQQRELKKGAAGWVLLVGLGVAYVISGDYAGWNFGLAQGGWGGMFLATLLMATMYLCMCFSLAELSSMIPTAGGGYGFARSAFGPWGGFLTGTAILIEYAIAPAAIAVFIGAYCQSLFGIGGWMIYLAFYIVFISIHIFGVGEALKLMFIITAIAAIALAVFLIGMVPHFDAANLFDIAKTDAVGASSFLPFGYVGVWAAIPYAIWFFLAVEGVPLAAEETKNPKRDLPRGLIGAMLVLLAFALLILVVGPGGAGSEALKASGNPLVEALSKAYGGSTWMGGFVNLVGLAGLIASFFSIIYAYSRQIFALSRAGYLPRKLSETNKSKAPVLALVIPGIIGFALSLTGQGDLLILVAVFGATLSYVLMMAAHITLRIRRPKMERPYRTPGGIFTSGLALVLACIAVVAGFLVDPRVVIGAAVIYAVLIAYFAFYSRHHLVAGTPEEEFAAIQKAEEALH

SEQ ID NO: 26558 - protein, 551 aa, Bradyrhizobium sp. BTAi1
MYAYDDIDRTLVNERVAEFRDQVKRRLSGELTEDEFKILRLQNGVYLQLHAYMYRIAIPYGTLSSEQLRRLAHVARRYDRGYGHFTTRQNIQFNWIKLAELPDAMADLAEVGIQSMQTSGNNMRNVTSDQWAGVAPGEVEDPRIWAELLRQFTTLHPEFSFLPRKFKIAITASAHDRAAIKIHDIGLRLLKNEQGETGFEVLVGGGLGRSPFIAKTIKPFVHGHDILSYVEAILRVYNQYGRRDNIYKARIKILVHELGIETFAAEVEEEWQQIRDGVLKLDDGIVEDIRSRFFYPAYETLPHMPDELRQAAHDPKFEAWRKNSVVAHKVQGYAIVTVSLKPIGKPPGDATADQMDALADIADKYSFGEIRVGHEQNLALPHVRKRDLPAVWKALDAIGLAIPNVNLVSDIIACPGLDYCSLANARSIPIAQEITRRFANHDTANLIGRLHINISGCINACGHHHVGHIGILGVEKNNEEFYQITIGGRADEGAVLGTLIGPAVPYAEVADVVEDIVEAYLALRASPEELFVDTVARLGVEPFRERVYATR

SEQ ID NO: 26559 - protein, 358 aa, Haemophilus influenzae Rd KW20
MQSYNIAVLAGDGIGPEVMAEAIKVLNRVQEKFGFKLNFNEFFVGGAAIEHCGYPLPAETLKGCDQADAILFGSVGGPKWTNLPPDQQPERGALLPLRKHFKLFCNLRPATLYKGLEKFCPLRADIAAKGFDMVVVRELTGGIYFGQPKGREGDGVQTKAFDTEVYYKYEIERIARAAFEAAMKRNKKVTSVDKANVLQSSILWRETVTEMAKDYPEVTLEHIYIDNATMQLIKSPESFDVLLCSNIFGDIISDEAAMITGSMGMLPSASLNEEGFGLYEPAGGSAPDIAGKGIANPIAQILSAAMMLRYSFNLNEAADAIESAVQKVLASGHRTADLADDSTPVSTAEMGTLITQAI

SEQ ID NO: 26560 - protein, 627 aa, Escherichia coli
MSATKLTRREQRARAQHFIDTLEGTAFPNSKRIYITGTHPGVRVPMREIQLSPTLIGGSKEQPQYEENEAIPVYDTSGPYGDPQIAINVQQGLAKLRQPWIDARGDTEELTVRSSDYTKARLADDGLDELRFSGVLTPKRAKAGRRVTQLHYARQGIITPEMEFIAIRENMGRERIRSEVLRHQHPGMSFGAHLPENITAEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEAFRDTLLEQAEQGVDYFTIHAGVLLRYVPMTAKRLTGIVSRGGSIMAKWCLSHHQENFLYQHFREICEICAAYDVSLSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAATQTIEMGMADMSENFRARGGRNLPA

SEQ ID NO: 26561 - protein, 201 aa, Kluyveromyces lactis NRRL Y-1140
MKLLIQFIAVLSALAAFVLADPTITHKVYFDIEHGDESVGRIVIGLFGEVAPRTVQNFFELSISEDPKMGYVKSIFHRVIPQFMIQGGDFTNGNGTGGKSIYGDTFDDESFEVKHDKPGRLSMANRGRNTNGSQFFITTVPTPWLDGKHVVFGEVLEGMDVVSYIENVPRNRSDRPKQDVRIAGSGEVETVPPSDLDNDEL

SEQ ID NO: 26562 - protein, 473 aa, Zea mays
  misc_feature (113)..(113): Xaa can be any naturally occurring amino acid
  unsure (1)..(473): unsure at all Xaa locations
RTGTVWTASAHIITAVIGSGVLSLAWAIAQLGWAAGPAVMLLFAVVIYYTSTLLAECYRSGDPVAGKRNYTYMDAVRASLGGAKVRLCGAIQYANLFGVAIGYTIAASISMLXYTINLQCFLYISVSISDELTLMLHDRRRSSAIKRADCFHAKGHKHACRSSSNPYMILFGVAEVVFSQIPDFDQIWWLSIVAAVMSFTYATIGLVLGIMQTVANGGFQGSLTGISIGAGVTPTEKVWRSLQAFGNIAFAYSYSIILIEIQDTVKAPPPSRAKVMKRATMVSVATTTVFYMLCGCMGYAAFGDAAPDNLLTGFGFYEPFWLLDIANVAIVVHLVGAYQVFCQPLFAFVEKWAAATWPDSAFIAREFRVGPFALSLFRLTWRTAFVCLTTVAAMLLPFFGDVVGLLGAVSFWPLTVYFPIEMYVVQRAVRRWSTHWICLQMLSAACLLVSVAAAAGSIADVIGALKVYRPFSG

SEQ ID NO: 26563 - protein, 507 aa, Chromobacterium violaceum ATCC 12472
MKSIKPVLLLILDGFGHRTEGDDNAILHARMPVWSRLREQYAYGTINASENFVGLPSGQFGNSEVGHLNIGAGRIVQQDISRIDCDIEDGRFSSNDTLQQAMSKAQGSALHILGLLSDGGVHSHENHIHALIRAAQAAGVPKIYVHAFLDGRDTPPRSAETYLKRLDAALAECPNARLVSVTGRYWAMDRDKRWERVEPAYRLLVDGEGLFHAETGLDALKAAYERDENDEFVKATGIGAPVKMQDGDALIFMNFRADRARQLTSALTDPAFDGFKARQPKFGYYATLTSYGEAYSALPVAYAPQKIHNGMGEYLSSKGLKQLRIAETEKYPHVTYFFNGGEEQVYPGEDRILVPSPKVATYDLQPEMSAGEVTDKIVAAIQSGQYQAIFCNYANGDMVGHSGVFDAAVKAVEALDGCIERCVDAMLAAGGEVLITADHGNCEQMYDGEHHQPHTQHTTNQVPFLYIGRPAKIRAGGSLRDISPSLLAMMGLEQPAEMTGQSLIDFQ

SEQ ID NO: 26564 - protein, 431 aa, Solanum lycopersicum
MAGQTVIVSGLNPAAILQSTIGGAPVAAAAENGHTRKVVPLSKDALQDFMVSIITQKLQDDKQPFYVLDLGEVVSLMEQWNSALPNIRPFYAVKCNPEPSFLSMLSAMGSNFDCASRAEIEYVLSHGISPDRIVFANPCKPESDIIFAEKIGVNLTTYDSEDEVYKIRKHHPKCELLLRIKPMTDGNARCPMGPKYGALPEEIEPLLRTAQAARLTVSGVSFHIGSGDADSNAYLGAIAAAKQVFETAAQLGMPKMTVLDIGGGFTSGHQFTTAAPAVKSALETHFHDFPELTIIAEPGRFFAETAFTLATTIIGKRVRGELKEYWINDGLYGSMNCVLYDHATVTATPLACMSNRNNLNCGGSKTFPSTVFGPTCDALDTVLRDYQLPELQVNDWLIFPNMGAYTKAAGSNFNGFNTSAIVTHLAYAYPN

SEQ ID NO: 26565 - protein, 519 aa, Zea mays
MIKQFLGRLPKKPSKSGDKDPIGRPSPSVSHQPLGPRAGDRATNLSSHPPVISSSGLSYGSGMHVGNAYTKAHVNGDSAASAFRSLPSFKDVPNTEKQNLFNEKLNLCCAQFDFTDPTKNIKEKEIKRQTLVELVDYIASASGKFSEASMQEITKMVSANLFRTLSTPPRDNKVDGFDVDEEEPVMDPAWPHLQIVYELFLRFIQSQETDAKLAKRYIDHSFVLRLLDLFDSEDPREREYLKMILHRVYGKFMVHRPYIRKAINNIFYQFIYETEKHNGIAELLEILGSIINGFALPLKEEHKLFLVRALIPLHKPKCIAMYHQQLSYCITQFVEKDCKLADTVIRGLLKYWPITNSSKEVLFLGELEEILEATQPAEFQKCMVPLFRQIARCLNSSHFQVAERALFLWNNDHIESLIKQNSRVILPIIFPALERNASGHWNQAVQSLTLNVRKLFSDNDPGLFTESLRKYEEEKAREKEVKSKQEATWRRLEEMASAKATSGAAVLVSRPLSRQSSAV

SEQ ID NO: 26566 - protein, 558 aa, Arabidopsis thaliana
MASLVSGDKEAQISGDPGSKRGGWITFPFMLATLLGLSVTSFGWVMNLIVFLIEEFNIKSIAAAQISNVANGCLSMLPVVAAILADSFFGNIPVIAASSFISLLGIVLLTLIASLDYLRPRPCEAGSVLCTPPSKLHLGILYTALALVTTGAGGTRFTMASAGANQYEKPKEQGSFFNWYFLTLYAGAITGATAIVYIQDNASWKLGFGLCAAANLISFIVFVSGKRYYKHDKPMGSPFTSLIRVVVSATVKRKAVISCNEEDYHHYGLEKEVKTSAAMPSKSFRFLNRAALMTKDDLNQKEGSVNNIWRLCSVQEVEDFKAILRVFPLWLSIIFVSTPMVMQTSLIVLQALVTDRGLGPNFKVPAGSLQVIIIITACIVIIMNNWLVFPMYKKLTHKLLTPLQKVGIGQVLTILSMALSAVVEAKRLKTVENGHPMSVLWLFPPLVIVGIGEAFQFPANIELFYGEFPESLRNTATSLTSVVIGISFYLSTALIDLIQRTTAWLPNDINHGRVDNVYWLLVIGGILNFGYFLVCSWVYKYRNLKDNDQEQDPKDGTM

SEQ ID NO: 26567 - protein, 163 aa, Triticum aestivum
  misc_feature (92)..(92): Xaa can be any naturally occurring amino acid
  unsure (1)..(163): unsure at all Xaa locations
MPARNHHSIQASSRQRSSSMAAHHQQQQQPQPQQQSQQQAVGFEDYLPVMAERLGEEGLMEELAAGFLLFMDPASGLITFNSLRRTAPAGGXSGGMSDNDLRGMLAEGEFDGERPASPRWKSCAPQGQGQTTNLLGSSHRRWDRWIVIGTIGAAQISLCKNSE

SEQ ID NO: 26568 - protein, 682 aa, Oryza sativa (japonica cultivar-group)
MPAAAAAHHLAGVAAAFLLAVLLHVHLAAGEDEPPPWYLCDPYSASGRYSENSTFQANVNRLSATLPRNTSSSPAMYATGAAGDVPDKVYGYALCRGDVADAHACERCVAAALRDAPRVCPLVKDALVFHDLCQLRYSNRNFLLDDDYYVATYSLQRSSRLVSAPAPAAVAAFDAAVAMLANATAEYAAAANTSRRYGTAEEEGVDGDGDSGRPRMYALAQCTPDKAADVCRACLTTLTTVQLPKLYSGGRTGGGVFGVWCNLRYEVFPFFSGRPLLHLPAFVEAPPPATSAAATRRGEKKRNKTGIVLAIVMPTIAAMLLIVVAYFCCWRRRRPEEQTFLPYDIQSIDSLLLDLSTLRAATDDFAETKMIGRGGFGMVYKGVLPEGQEVAVKRLCQSSGQGIEELKSELVLVAKLYHKNLVRLIGVCLEQQEKILVYEYMSNKSLDTILFDIDKNIELDWGKRFKIINGIAQGLQYLHEDSRLKIVHRDLKASNILLDFDYNPKISDFGLAKIFDGDQSKDITHRIAGTYGYMAPEYAMHGHYSVKLDVFSFGVLVLEIVTGRRNSGSYDSGQDLDLLNHVWGHWTRGNVVELIDPSLGNHPPIEQMLKCIHIGLLCVQKRPASRPTISSVNIMLSSNTVRLPSLSRPAFCIQDVSASDSSNPHSTAVSSNDMSITDLVPR

SEQ ID NO: 26569 - protein, 215 aa, Synechocystis sp. PCC 6803
MSHSDLPLANAVPLDKIRYNDQGLVPAIAQDYLDGTVLMLAWMNEAALAKTLATGQVWYWSRSRQELWHKGATSGHFQKLLGIRYDCDSDALLLTIEQKGDIACHTGERSCFHQLDGHKSPPPADMLTELARVIGDRRDHPTPESYTCKLLAGGDNKILKKIGEESAEVVMACKDDDPEAIAGEVADLFYHTLVALAHHNVDLRAVYRKLGDRRR

SEQ ID NO: 26570 - protein, 448 aa, Echium pitardii var. pitardii
MDSAIKKYITTDELKKHDKPDDLWISIQGKIYDVSNWLKDHPGGHYPLTSLAGQDVTDAFVAFHPASAWQNLDEFFNGYYLKDYYVSDVSKDYRKLVSEFSKMGLFKKNGHTVFVTLSLIAMSFAMSVYGVLFCQGVLVHWLCGCLVGILWTQCGLLGHDAGHYTMMPSSRLNKFVFILAANCLSGVSIGWWTWNHNAHHVACNSLEYDPDVQYIPFIVVSSKLLTSLTSHFHEKRLKFDSLSKFFVSHQHWTFYPVMCSARLYLIVQSFIMLLTKRNVSHRSQELFGLIVFWIWYPFLVYCLPNWSERIMFVLPSFFMTGIQQLQFSLSHVSSSVYVGKPKGNDWFEKQTSGTLDISCPSWMDWFYGGTQFQIEHHLFPRLPRCHFRTISPLVMELCKKHNLNYNCASFFKGNKMVIKTLKKAALEARDLAKPKNLECVGVNTHAQD

SEQ ID NO: 26571 - protein, 479 aa, Mesorhizobium loti MAFF303099
MTDLKGFEERKGLARPLGVRHKADPERETWSESRARETRELGASEQPYCLVIGGGQGGIMLGARLRQLGVPTIVIEKNARPGDSWRNRYRTLVLHDPVWYDHLPYIPFPENWPVFTPKDKMGDWLEMYTRVMELNYWVATKCLSASYDEGRKEWTVVVDRVGRQITLKPKHVVFATGAYGPPRKIDLPGAAAFKGELLHSSQYASGDKFRGKKVAVIGAASSGHDVCVDLWESGADVTMIQRSPTTVVKSDTLMEVGFEIFSEGALARGITTEKADMIVASTPFALVPKGQRALYEVIKARDAAFYERLSASGFAIDFGDDETGLLMKAYRTGSGFYIDVGASDLIIDGKIGIRSGVAIKALTAKGILFEDGSELEVDAIIACTGYQSMNENVAALVSREVADKVGPCWGLGSGVKGDPGPWQGELRNMWKPTAQEALWFHGGNLALSRFYSKYVALQIKARMEGIATPVYGKPSNSRR

SEQ ID NO: 26572 - protein, 465 aa, Candida glabrata CBS 138
MSERREEERGRTGFSMKKNHNSNFNRRNQEQIHQKLPTKISGPLTLEQLCAYQHMFRIQEISSIIKSHSFEVPNARNRSPSPPPVYDAEGKRINTREQLYKKKLMNERFKLVEVVSKLIPGYSAPKDYKRPTTFQEKYYIPVSQYPQINFVGLLLGPRGKTLRKMQEDSGCKIAIRGRGSVKEGKTSSDLPPGAMDFSDPLHCLIIADNEEKIENGIKACRNIVIKAVTSPEGQNELKRGQLRELAELNGTLREDNRPCATCGQQGHKKYECPHRETFAMKIICRRCNQPGHTIRDCTSDSNYGKQIHSSRYNNEMPYHRTSTAVDQPSAYSRYGYTPRNHNGSSRFNDNSKYLNNGNKRATPQPELELETSHKRQQINPTSSSQDTLSHQTNHMTMTTIEDSGIDKLQLPAGMSNENPIPQPVNFNEIQINDVSGPNGTLEAPPGLDLGNNDSNITLQGPPGLN

SEQ ID NO: 26573 - protein, 362 aa, Pseudomonas putida KT2440
MNDLSHTHMRAAVWHGRHDIRVEQVPLPADPAPGWVQIKVDWCGICGSDLHEYVAGPVFIPVEAPHPLTGIQGQCILGHEFCGHIAKLGEGVEGYAVGDPVAADACQHCGTCYYCTHGLYNICERLAFTGLMNNGAFAELVNVPANLLYRLPQGFPAEAGALIEPLAVGMHAVKKAGSLLGQTVVVVGAGTIGLCTIMCAKAAGAAQVIALEMSSARKAKAKEAGANVVLDPSQCDALAEIRALTAGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 26574 - protein, 340 aa, Pseudomonas putida KT2440
MARKISYQQAINEALAQEMRRDSTVFIIGEDVAGGAGAPGEDDAWGGVLGVTKGLYHQFPGRVLDAPLSEIGYVGAAVGAATQGLRPVCELMFVDFAGCCLDQILNQAAKFRYMFGGKAVTPLVMRTMYGAGLRAAAQHSQMLTSLWTHIPGLKVVCPSSPYDAKGLLIQAIRDNDPVIFCEHKLLYSMQGEVPEEVYTVPFGEANFLRDGDDVTLVTYGRMVHVALEAANNLARQGIDCEVLDLRTTSPLDEDSILESVEKTGRLVVIDEANPRCSMATDISALVAQKAFGALKGPIEMVTAPHTPVPFSDALEDLYIPDAAKIEAAVRKVIEAARSAA

SEQ ID NO: 26575 - protein, 355 aa, Arabidopsis lyrata subsp. petraea
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHIKKKENQNAVDDGDVVDTDMVDDLLAFYSEEAKLVSEAADLQNSIKLTRDNIKAIIMDVMFGGTETVASAIEWALTELLRSPDDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 26576 - protein, 325 aa, Pseudomonas putida KT2440
MSNQLSTEQLLHAYEVMRTIRAFEERLHVEFATGEIPGFVHLYAGEEASAAGVMAHLRDSDCIASTHRGHGHCIAKGVDVYGMMAEIYGKKTGVCGGKGGSMHIADLEKGMLGANGIVGAGAPLVAGAALAAKLKGRDDVSVAFFGDGASNEGAVFEAMNMASIMNLPCIFVAENNGYAEATASNWSVACDHIADRAAGFGMPGVTIDGFDFFAVYEAAGAAIERARSGQGPSLIEVKLSRYYGHFEGDAQTYRAPDEVKNLRESRDCLMQFRNKTTRAGLLTAEQLDAIDARVEDLIEDAVRRAKSDPKPQPADLLTDVYVAYP

SEQ ID NO: 26577 - protein, 355 aa, Arabidopsis lyrata subsp. petraea
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 26578 - protein, 530 aa, Oceanobacillus iheyensis HTE831
MLAPLTPLDWKRRAIKYYPEKIAIVDGDKSFTYKEFGHRVDQLSKGLLEKGIKEGDHVAVMLPNTHYMLECFYGICQIGAVMVPLNYRLSAKDLNYIINHSDAKLLIVDEAFTEPIEEIQNSLSLEEMIIVEVDGESTSLQGTLYEALIHHDNDKVELPIVEIDENQLMTINYTSGTTSNPKGVMLTHRSNYINAANFLYHINVSHDDRYLHTLPMFHANGWGGVWAITAAGGTHVCLRKVDPPLILDIFEEQQITMLCGAPTVVNMLVNEPKAKQLNLQSKLRMATAGSPPAAALIQKAQDILGLEMVHVYGLTETSPFILYCEWKQDFNEKSSDEQATIKARQGIELAFNGETTVIRPDGEEVLWNGEELGEIVTRGNVVMQGYYKDVEKTDAAMKDGWFHTGDLAVIHSDGFIEIRDRAKDLIISGGENISSTEVEGVLYKHPDVLEVAVIAIPDEKWGEVPLAIIVPQPHSALTEEEVITYCRENLAHFKSPKKVEFVEELPKTATGKLQKFRLRELYWERAKRVN

SEQ ID NO: 26579 - protein, 355 aa, Arabidopsis lyrata subsp. petraea
ISYLTYDRADMAFAHYGPFWRQMRKVCVMKVFSRKRAESWASVRDEVDKMVRSVSCNIGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 26580 - protein, 355 aa, Arabidopsis lyrata subsp. petraea
ISYLTYDRADMAFAHYGPFWRQMRKVCVMKVFSRKRAESWASVRDEVDQMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 26581 - protein, 537 aa, Oceanobacillus iheyensis HTE831
MNTQLTLASMIKHTEKYFPKKEVISRTLAGIQTFTYEETVQRMKRLGHALESLGIKKGDRVGTFAWNHHRHLEAYFAVPSMGAILHTINIRLAPEDLVYIINHAEDKVILVDEDLLPLIERVADQLAHVEAYIVMTDRENLPETSLTSVYSYESLLERADSEYEFTTELNEEDPAGICYTSGTTGRPKGVVYTHRGIYLHSMALGMTDTVGLSETDTTMPVVPMFHVNAWGMPFAATWFGATQVLPGPMPTPQVLAQLIDEYKVTTTAGVPTIWLGLLKELESGNYSMKSLRNILCGGSAAPKSMIKAFETKYNIPFLHAYGMTETSPLVTVSRLKSYQHNIDSEERLELRSKQGMVVPGIEIRAINENGDVTRDGEDMGELIIRGPWIADQYYKDDRSADTFHDGWLHTGDVVTIDEEGTIKIVDRTKDLIKSGGEWISSVDLENALMAHEDIFEAAVVAIPDPKWQERPIACVVCKENAQLTKEDVLQFLQPQFAKFWLPDEVIFMNEIPKTSVGKFLKKALRDQVKETLSIKDE

SEQ ID NO: 26582 - protein, 519 aa, Debaryomyces hansenii
MFDVDTVHNFFTSWYGILLAVLIGYHVFDYIRIQIVMKKLGCVSPPVELDGFFGFKLLYTSLKHKKEGTLVNFIKERFETVGKDTFSFRIAGTPVISTKNPENIKALLATQFSDFALGTRHAQFKPLLGDGIFTLDGSGWKHSRAMLRPQFAREQVAHVKSLEPHIQMLAKHVRRAKGGAFDVQSLFFRLTVDSATEFLFGESVESLQDESIGMAKDAVDFDGKAGFAEAFNTAQVYLSIRSLAQKAYFLVNNKEFRSSNEKVHKFADYYVQKALNSSPEELEKHSQDGYIFLYELVKQTRDPHVLRDQLLNILLAGRDTTAGLLSFTFYELARNPQVWLKLKEEIYEKFGKGDDARLEDITFESLKKCEYLKALLNEVLRLYPSVPQNFRVAQKDTSLPRGGGPNRDQPIFIAKGQTVTYTVYAMHRDEQFYGKDSEVFRPERWFEPETRKLGWAFLPFNGGPRICLGQQFALTEASYVIARLAQLFPNLASHDDEYPPRKASHLTMCHQSEVKISLA

SEQ ID NO: 26583 - protein, 519 aa, Debaryomyces hansenii
MSELLDSIQPYLTKWYVVISALLVSFFIAHKISVARFKATHNCAASPEYYKVNWFSLPLLYRLIQVKREGRLLDFAQKIYDDVKALTFVIKIVGVPVIITRDPENMKAVLATQFNDFALGTRHAHFKPLLGDGIFTLDGNGWKQSRSMLRPQFSREQVAHVQALEPHLQRLAKHIRLADGETINIQDLFFKLTVDTATEFLFGQSVYSLKDAAINDPPTEDFDGRSSFANSFNTAQTYLGTRAYLQMFYFIVNNSDFRKCCKQVHDFTRFYVQKGLDMTPEELEKKSENGYVFLYELVKQTRDPKVLQDQLLNILLAGRDTTAGLLSFTFFELARHPRVFNKLKEEIYEAFGKGDDARVSEITFESLKKCEYLKWVMNEMLRLYPSVPVNFRVATKRTTLPRGGGPDGNSPIYVGKGTTVAYSVYSTHRMEEYYGKDADEFKPERWAESRKLGWAYVPFNGGPRICLGQQFALTEASYIVTRLLQMFDKLELHDDRPYPPAKSVHLTMCHQDGVYVSLS

SEQ ID NO: 26584 - protein, 339 aa, Karenia brevis
MRAIRVLACLACASHAGRFQQKSDTPELDAFAALLLASDAQAGFQAPNAANARAQNAQKLANVGAKVLAGSLAGLLALTAGTDGALAGPFTRDDLASLTYDQVKGSGLANTCPKVNKAGAGGIKIGGLKQLSDFCLEPTSFAILEEQMTQQKGTQTVPVPSKVTTRQTYVLDGIEGTLSVSEGKLKFVETDGIDYAPTTIQLPGGERVPFLFTVKNLVATAGTTADEIAPGFTMSGPFMVPSYRTGLFLDPKGRGTTTGYDQAVALPAMQAGGDEEMFKENDKKFDVGKGSIELKVTQVNTELKEIGGVFVHKQPGDTDLGSKEPKEILLKGNWFATVE

SEQ ID NO: 26585 - protein, 448 aa, Echium sabulicola
MANAIKKYITAEELKKHDKEGDLWISIQGKIYDVSDWLKEHPGGKFPLLSLAGQEVTDAFVAFHSGSTWKLLEKFFTGYYLKDYSVSEVSKDYRKLVFEFNKMGLFDKKGHIVLVTVLFIAMLFAMSVYGVLFCEGVLVHLLSGGLMGFVWIQSGWIGHDAGHYIVMPNPRLNKLMGIVAANCLSGISIGWWKWNHNAHHIACNSLDYDPDLQYIPFLVVSSKLFSSLTSHFYEKKLTFDSLSRFFVSHQHWTFYPVMCSARVNMFVQSLIMLLTKRNVFYRSQELLGLVVFWIWYPLLVSCLPNWGERIMFVVASLSVTGMQQVQFSLNHFSSSVYVGQPKGNDWFEKQTCGTLDISCPSWMDWFHGGLQFQVEHHLFPKLPRCHLRKISPFVMELCKKHNLSYNCASFSEANEMTLRTLRDTALQARDLTKPLPKNLVWEALNTHG

SEQ ID NO: 26586 - protein, 132 aa, Mesorhizobium loti MAFF303099
MPCRVVRGANPLPKQTFGTSHVPLSPAVRAGDFVYVSGQVPVGSDGIVVKGGITEQTEQVLANVKAALALAGCTLDDVVKTTVWLGDARDFGAFNAVYARHFPKNPPARTTVESRLMIDIKIEVEAVAYRPV

SEQ ID NO: 26587 - protein, 169 aa, Echium gentianoides
WTHNAHHIACNSLDYDPDLQHLPVFAVSSRFFKSLTPSFYGRELTFDSLSRFFVSYQHFTYYPVMVVARINLYVQTFLLLFSTRKVPDRALNIMGIVVFWAWFPYLVSCLPNWNERVLFTLTSFSVTALQHIQFTLNHFAGDVYGGAPSGNHWFEKQTAGTIDISWSLF

SEQ ID NO: 26588 - protein, 520 aa, Oryza sativa (japonica cultivar-group)
MAVEGRRRVPLPLPPPTRRGKQQQQQGGERARRVQAGDALPLPIRHTNLIFSALFAASLAYLMRRFFGIAFVQSVVSNSDDEEEEEDFLIDSRAAGPVAAQATPPPAPAPFSLLGSACAAPKKMPEEDEEIVAEVVAGKIPSYVLETRLGDCRRAAGIRREALRRTTGREIRGLPLDGFDYASILGQCCELPVGYVQLPGCLVASTNRGCKAIAESGGATSVVLQDGMTRAPVARFPSARRAAELKGFLENPANFDTLAMVFNRSSRFARLQRVKCAVAGRNLYMRFSCSTGDAMGMNMVSKGVQNVLDYLQDDFPDMDVISISGNFCSDKKSAAVNWIEGRGKSVVCEAVIKEEVVKKVLKTNVQSLVELNVIKNLAGSAVAGALGGFNAHASNIVTAIFIATGQDPAQNVESSQCITMLEAVNDGKDLHISVTMPSIEVGTVGGGTQLASQSACLDLLGVKGANRESPGSNARLLAAVVAGAVLAGELSLISAQAAGHLVQSHMKYNRSSKDMSKVAS

SEQ ID NO: 26589 - protein, 232 aa, Zea mays
MRSMLFLRCQPRVSSPSPSASASAPPFRPRVRVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELAELKGRDKLGDRAVFVLVEADA

SEQ ID NO: 26590 - protein, 169 aa, Echium pitardii
WTHNAHHLACNSLDYDPDLQHLPVSAVSSRFFKSLTSSFYGRELTFDSLSRFFVSYQHFTYYPVMVVARINLYVQTFLLLFSTRKVPDRALNIMGIVVFWTWFPYLVSCLPNWNERVLFILTSFTVTALQHIQFTLNHFAGDVYVGAPSGNDWFEKQTAGTIDISCSSL

SEQ ID NO: 26591 - protein, 169 aa, Echium pitardii
WTHNAHHIACNSLDYDPDLQHLPVFAVSPSFFKSLTSVFYGRELTFDGLSRFFVSYQHFTYYPVMIFARVNLYVQTFLLLFSTRKVPDRALNIIGILVFWTWFPYLVSCLPDWNERVLFVLTSFSVTALQHIQFTLNHFAANVYVGAPTGNDWFEKQTAGTIDISCSSW

SEQ ID NO: 26592 - protein, 393 aa, Solanum bulbocastanum
MTAPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNFFRIGGVAADLPYGWIDKCLDFCDYFLTGVAEYQKLITRNPIFLERVEGVGIIGRDEALNWGLSGPMLRASGIEWDLRKVDHYESYDEFDWQVQWQREGDSLARYLVRIGEMTESIKIIQQALEGIPGGPYENLEMRRFDRLKDPEWNDFEYRFISKKPSPTFELSKQELYVRVEAPKGELGIFMIGDQSVFPWRWKIRPPGFINLQILPQLVKRMKLADIMTILGSIDIIMGEVDR

SEQ ID NO: 26593 - protein, 129 aa, Blastopirellula marina DSM 3645
MKPFHAIHNPDTPISHLPFSPAVQVGQFVFVSGQASVDETGKIVPDTFAGEMRRSLENIRKVLAAAGLTMNDVVQTRNYVGDQADLPEFNQIYAEYFEQPYPARTTLMGCLGTLLKYEVDVVAVAPRLA

SEQ ID NO: 26594 - protein, 456 aa, Escherichia coli
MMEGQQHGEQLKRGLKNRHIQLIALGGSIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHAFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFLLLYPLGNWICLLFMAAVLVIMLMTRGMGIWVYLIPVWLIVLGIGYLFKEKTAKAVKAH

SEQ ID NO: 26595 - protein, 433 aa, Blastopirellula marina DSM 3645
MASTETTSRSAELYQRACRSLATGVSSSLRRFVTETPLYIDHADGAHFYDVDGNCRADYTLGWGPLIVGSNHAGINAAVAKQLTKGYTYGCQHVAEIELAELIVESVPGVEQVIFSNTGTEAIQSAIRIARAHTGRDKILKFEGHYHGWLNNVLVSYRPKSEDTTLAQPTCGGQPASEYADTLVLPWNDIDALKDLFALRGDEIACVLTEPILANSGSCMPKPGYLEALVELCREHGAVSIFDEVITGFRIALGGAREYFGVEPDLSVYGKALAGGFTMSAVGGRAEMFEVLRDQRTIHSGTYNGTTFNIIAAIETIRELRKPGTYERMNAHGQAIAEALTSAAADVGLDVVVSGVGSVFSVHFGVKQAPRDYRDTTRSDMQTYTRFRAAMLDNGVQLLPDARWYIGTQHDEAVLEHVINAIESSMKDTVRCS

SEQ ID NO: 26596 - protein, 818 aa, Oryza sativa (japonica cultivar-group)
MRAAAIQTHALVCAPPGAAAAALAPWPRRAAGGGGGGPLLHHHRLRSDLPHTRSLPCRARSPSSSSSSNVNSGRGDDADNLLEDLLSKHGEVVYNAGGAPGIDADDDAECLSFAVSLAKVASEVKAADIRVLFVKPLVYWTRFFIILTAFSNAQIDAISSKMRDIGEKQFSIVASGDTKPNSWTLLDFETIIIGAKRSRGQDVTHCASSDFRREDATQLPREGWRSRRPCRWPGGGWRSRRRRPTPAAAGYGGRLHAILRQRGARPVPVPTIAIRAHDPDILRPFVAPGGLDAFAALAFTSRSGISAFSRALLPSSSSPARRPRHPVSDAATALPFTVAALGSDADLLDAAFLSRLCGDAGGRVSVLVPDVPTPAGLVEALGSGSGRRVLCPVPDVVGLREPPVVPGFLAGLEAAGWVAVRAPAYVTCWAGPRCAEALVDAAAPDAVVFTSTAEVEGLLKGLDAAGWSWPRLRARWAPHGRRRAWPRHRRRRQEAGHRGHGGRGFEQTYRCYSAAAFNKPQLEGGDKVIMPASALHRLASLHIDYPMLFELSHHGDAAAHRVTHCGVLEFVADEGTVIMPRWMMRGMRLDDGGLVVVRSASLPKGSYAKLQPHTGDFLDTANPKAVLEKTLRSFTCLTTGDTIMVAYNNKEFLIDIVETKPASAVCIIETDCEVDFAPPLDYKEPEKVQQKPSVPSSKAASEDQDQIKDEPEFRAFTGSGNRLDGKASKPLAAGISSNPAAASSAISDSNKKVNQETAASGVSNSTRQKKGKLVFGSNKSSSSSKEPEKAPPVKVDELAKKEEPKFQAFSGTSYSLKR

SEQ ID NO: 26597 - protein, 207 aa, Bradyrhizobium sp. BTAi1
MATSHGPLRVGVGGPVGSGKTALMDLLCKSMRGRYDIAAITNDIYTKWDAEYLVRSGSLTPDRIAGVETGGCPHTAIREDASMNLAAVADMRAKFPGLDLILIESGGDNLAATFSPELADITIYVIDVAAGDKIPSKGGPGITRSDLLVINKIDLAPHVGASLEKMETDAKRMRGERPFVMTNMKKSQGLDRIVSFIEAKGGLTASA

SEQ ID NO: 26598 - protein, 351 aa, Arabidopsis lyrata subsp. petraea
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADLIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQL

SEQ ID NO: 26599 - protein, 558 aa, Neisseria meningitidis MC58
MSFKTDAEIAQSSTMRPIGEIAAKLGLNADNIEPYGHYKAKINPAEAFKLPQKQGRLILVTAINPTPAGEGKTTVTIGLADALRHIGKDAVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDADAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 26600 - protein, 351 aa, Arabidopsis lyrata subsp. petraea
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQL

SEQ ID NO: 26601 - protein, 407 aa, Oceanobacillus iheyensis HTE831
MEKDPQLMSKEEKKNRRNSLIGAAFLMATSAVGPGFLTQTAVFTETLLASFGFVILASIILDIGAQLNVWRIIAVSKKRGQEIANEVLPGLGFVVAIFVVIGGLAFNIGNIGGAGLGTNALLGIDPRLGAIITAGIAIFVFLSREAGAAMDQIVKWLGGLLILLIAYVMVVSQPPVGEAIHRSFIPLELDVYAIITVVGGTVGGYITFSGGHRLLDAGISGKESIREVTRTSVMGILVASVIRILLFLAVLGVVSAGLRLDPVNPAASVFQHAAGEIGLRLFGLALWVAGITSVIGAAYTSVSFLRTFHKKIDEHYRYWIIGFIVFSTVVFVLIGDAALLLVLAGAVNGLILPLTLGSILFAAHKKSIVGTYKHPIWLTVFGAIVVILTTYLGIQTLITQIPQLFNM

SEQ ID NO: 26602 - protein, 351 aa, Arabidopsis lyrata subsp. petraea
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPDDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQL

SEQ ID NO: 26603 - protein, 113 aa, Zea mays
MAMAPSAACVVSFPARPAASTAGPRAAAGTGAVHAVAGSAEGAKWWAPLLGWSGKADYLEAPAPAQDEAPRRQFVGVMTEEKARELRARMAQTESFHDAMYHSAIASRLARSS

SEQ ID NO: 26604 - protein, 316 aa, Alteromonadales bacterium TW-7
MTSALQRLKQHSSIVADTGDIEAIKKHQPEDATTNPSLLLKASEIEAYKPYLDKAWSYAKETEQDPAKQLELACDYFAVLLGKEISEIVPGYISTEVDARLSFDTQATIDKAHTLLSLYEKEGVSKDKILIKVASTWEGIKAAEQLEKEGTKCNLTLLFSDAQARACADANVFLISPFVGRILDWHVANGMEKPTDPLQDPGVQSVRSIFEFYKRHDYKTVVMGASFRNTGEIIALTGCDKLTISPNLLEDLGNLEGAQEYLLESDIPKEPKPEPLTEAQFRWLHNQDAMATEKLAEGIRSFADAQEQLEARFKAM

SEQ ID NO: 26605 - protein, 199 aa, Triticum timopheevii subsp. armeniacum
ELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQ

SEQ ID NO: 26606 - protein, 309 aa, Brassica napus
  misc_feature (206)..(206): Xaa can be any naturally occurring amino acid
  unsure (1)..(309): unsure at all Xaa locations
MAAEGGLRVEQRHGKARVRVGRVWRQGADGSHHFVEWNVSISLLSHCLSSYHRDDNSDIVATDTMKNTVYVKAKECGDRLSVEEFAILLGNHFCSFYPQVYTAIVNIIEKPWERVCIDGKPHLHGFKLGSENHTVEATVQKSGALTLTSGVAGLALLKTTQSGFEKFVRDKYTILPDTRERMLATEVNASWRYSYESVASIPKKGXLYFSEKFMEVKKVLMDTFFGPPETGVYSPSVQRTLYFMGSAVLRRFPDVASIHLKMPNIHFLPVNLSTKENPSMVKFKDDVYLPTDEPHGSIEATLSRITSKM

SEQ ID NO: 26607 - protein, 479 aa, Salmonella typhimurium LT2
MAQHAVYFPDAFLTQMREAMPSTLSFDEFISACQRPLRRSIRINTLKISVADFLALIAPYGWSLTPIPWCHEGFWIERDDEEALPLGSTAEHLSGLFYIQEASSMLPVAALFADDNHPQRVMDMAAAPGSKTTQIAARMGNRGAILANEFSASRVKVLHANISRCGIANTALTHFDGRVFGAALPEMFDAILLDAPCSGEGVVRKDPDALKNWSPESNLDIAATQRELLDSAFHALRPGGTLVYSTCTLNRQENEAVCLWLKETYADAVEFLPLGDLFPDADRALTPEGFLHVFPQIYDCEGFFVARLRKMSSLPAMPAPGYKVGAFPFTPLKGREALHVTQAANAVGLLWDENLHLWQREKEVWLFPAEIESLIGKVRFSRLGIKLAESHNKGYRWQHEATIALACPTHAHAFELSVQEAEEWYRGRDIYPQTPPAADDVLVTFQHQPLGLAKRIGARIKNSYPRELVRDGKLFTGNS

SEQ ID NO: 26608 - protein, 436 aa, Arabidopsis thaliana
MGKGPLSFRRLSSIRHRKKGSAVKDDSAQTSTPSSPPPPLPIHAGGSAVGATGKAKKKTGGARLWMRFDRTGAMEVVECDKSTIIKRASVPARDLRILGPVFSHSSNILAREKAIVVNLEVIKAIVTAEEVLLLDPLRPEVLPFVERLKQQFPQRNGNENALQASANVQSPLDPEAAEGLQSELPFEFQVLEIALEVVCSFVDKSVAALETEAWPVLDELTKNVSTENLEYVRSLKSNLTRLLARVQKVRDELEHLLDDNEDMADLYLTRKWIQNQQTEAILAGTASNSIALPAHNTSNLHRLTSNRSASMVTSNTEEDDVEDLEMLLEAYFMQLDGMRNKILTVREYIDDTEDYVNIQLDNQRNELIQLQLTLTIASFAIAAETLLASLFGMNIPCPLYSIHGVFGYFVWSVTALCIVLFMVTLGYARWKKLLGS

SEQ ID NO: 26609 - protein, 427 aa, Bordetella parapertussis 12822
MPFTANRQFKSQPRLLARAEGMYYTSTDGRQILDGTAGLWCVNAGHCRPEIVQAIASQAGEMDYAPGFQLGHPLAFEAATAVASFMPAGIDRVFFTNSGSESVNTALKIALAYHRARGDAQRTRLVGRERGYHGVGFGGISVGGISANRKTFSGALLPAEDHLPHTHSLEHNAFSKGQPAWGEHLADELERIVALHDASTIAAVIVEPMAGSTGVLVPPKGYLQRLREITARHGILLIFDEVITAYGRLGSPTAAEHFGVTPDIITMAKGVSNAAVPAGAVAVKREVHDAIVNGVQGGIEFFHGYTYSAHPLAAAAILATLGIYRRDDLFGRARDLSPAFEKAAHALQGAPHVIDVRNIGLVAGIELASRPDAPGARAAEAFRKCFDSGLMVRYTGDILAVSPPLIIDEAQIGELFEGIGKVLKEIA

SEQ ID NO: 26610 - protein, 464 aa, Mesorhizobium loti MAFF303099
MKEISCKLLVIGAGPGGYICAIRAGQLGVDTVIVEAGKPGGTCLNVGCIPSKALIHAAEEFEKVAHMAGGKSPLGISVSAPVLDLGKTIAWKDGIVSRLNSGVAGLLKKAGVKTVHGWAMFRDGKTVEVETETGSQVIRAETIVIATGSAPVELPFLPFGGPVISSTEALALSVVPKKLAVVGGGYIGLELGMAFAKMGAEVTLVEALPRVLAQYDAELTRPVVKRLAALGVEVMTEAKAKGLSTKGDALLVETADGKNTKVSADKILVTVGRKPVTEGWGLDQIDLDMSGKFIRIDDQCRTSMRGIFAIGDVTGEPMLAHRAMAQGEMVAEIVAGHKRNWDKRAIPAVCFTDPELVTVGLSPEEAKAQGEIKIGLFPFAANGRAMTKLGEDGFVRVVARADNHLVLGIQAVGQGVSELSTAFGLALEMGARLEDIAGTIHAHPTQGEGFQEAALKALGHALHI

SEQ ID NO: 26611 - protein, 573 aa, Oryza sativa (japonica cultivar-group)
MAMDAAPALKRKDADPPELWMGCCAAAAASGFPVSSRATKIRRLDAEVPPVVPGVCVPPAPPTQQQPVAGLGAGDVRVFGDQVPVGMAPAAAAAAAAKRKGEDAPELWLDDGGAASGFPVSSRATKIRRLDADVPPPVVPELCAPPPPPQPVAEVQMRGEEVPVIAVPAPNEERAIVLYKPDDAARNLLLGPLRPEFPLRVSPDWIHGLKSTALREASEHRALFEELAMDETSNLAMVPWVPVPSNSQEASTSAAATATTTTEMMDAEDTSMEVEQDGGSGGSHLAAAGEAPYYQWPQHCMAPPPQPPLPAFFLVLAAQWRLSRSWSENRDEILWPCQMEAERSRPYEPTAKDRIDETTPVCATHLSRLGPVNYIFARSRRELRPPFAPLLYRCCQAHHRKSCKKPMGNSKTPQPSKKSRIMLSDTDGHQLDNDEFSSESASNQMVLFNPETVAKGQDELGENHSPSLQKSANNPNRGMPSIGAFTVQCAKCFKWRLIPTKEKYEEIRECIIQEPFECERAREWRPDVTCNDPEDISQDGSRLWAIDKPNIALPTPGWERQIRIRGEGGTKIC

SEQ ID NO: 26612 - protein, 337 aa, Mesorhizobium loti MAFF303099
MPRRTMIEAIRDAMDVSMGRDDKVVVFGEDVGFFGGVFRCTQGLQAKYGKSRCFDAPINESGIVGSAIGMAAYGLKPCVEIQFADYMYPAYDQLTQEAARLRYRSNGDFTCPIVVRMPTGGGIFGGQTHSQSPEALFTHVSGLKTVVPSNPHDAKGLLIAAIEDPDPVIFLEPKRLYNGPFDGHHDRPVTPWSKHELGEVADGHYTVPLGKAAIRRAGSAVTVLAYGTMVYVAQAAAEETGIDAEIIDLRTLLPLDLDAIVASVKKTGRCVIVHEATLTSGFGAELSALVQENCFYHLEAPVARVAGWDTPYPHAQEWDYFPGPARVGRALIETLEA

SEQ ID NO: 26613 - protein, 183 aa, Triticum aestivum
  misc_feature (5)..(5): Xaa can be any naturally occurring amino acid
  misc_feature (19)..(19): Xaa can be any naturally occurring amino acid
  misc_feature (178)..(178): Xaa can be any naturally occurring amino acid
  unsure (1)..(183): unsure at all Xaa locations
LSPSXQSFPPAEAIRSSQXDSHVRFPGQIAGGARGLPFRRAPSFRNAADCGNATGNVCDPSLVHIAITLDEGYLRGSVAAVHSVVQHAMCPESVFFHFLVSDPSLGDLVRAVFPQLRFKVYYFDPARVRGLISSSVRQALEDPLNYARNYLAHLLEPCVRRVIYLDSDLVLVDDVRQXLAHRL

SEQ ID NO: 26614 - protein, 225 aa, Archaeoglobus fulgidus DSM 4304
MDSSGKYNAAKLALELVKDGMVLGIGSGSTVEVFLNLLGDKIREEGLEIYGIPSSYQSYFAAIRNGVEIVDLVEFEPDLCIDGADQVDAKLNCIKGGGGAMTREKIVAKASRKVVIIVDESKLVEKLSMPVPVEVLPFAYGWVLREIEKMGCKARLREGKGKIGPVITDNGNFVVDCDFGVIEEDRVEGLEGEIKLISGVVENGIFSKELIDAVIAGSSRSARFL

SEQ ID NO: 26615 - protein, 527 aa, Arabidopsis thaliana
MAAETASGSNRSISNSPLIENSDSNQILVPEKKSWKNFFSYLGPGFLVSIAYIDPGNFETDLQSGAQYKYELLWIILVASCAALVIQSLAANLGVVTGKHLAEHCRAEYSKVPNFMLWVVAEIAVVACDIPEVIGTAFALNMLFNIPVWIGVLLTGLSTLILLALQQYGIRKLEFLIAFLVFTIALCFFVELHYSKPDPKEVLYGLFVPQLKGNGATGLAISLLGAMVMPHNLFLHSALVLSRKIPRSVTGIKEACRYYLIESGLALMVAFLINVSVISVSGAVCNASDLSPEDRASCQDLDLNKASFLLRNVVGKWSSKLFAIALLASGQSSTITGTYAGQYVMQGFLDLRLEPWLRNFLTRCLAIIPSLIVALIGGSAGAGKLIIIASMILSFELPFALVPLLKFTSSKTKMGSHANSLVISSVTWIIGGLIMGINIYYLVSSFIKLLLHSHMNLVAIVFLGVLGFSGIATYLAAISYLVLRKNRESSSTHFLDFSNSQTEETLPREDIANMQLPNRVAVIGDLN

SEQ ID NO: 26616 - protein, 665 aa, Haemophilus influenzae Rd KW20
MATRRQLANAIRVLAMDSVQKAKSGHPGAPMGMADIAEVLWRDFLKHNPTNPKWADRDRFVLSNGHGSMLIYSLLHLTGYDLSIEDLKQFRQLHSKTPGHPEYGYAPGVETTTGPLGQGITNAVGMAIAEKTLAGQFNREGHEIVDHHTYVFLGDGCLMEGISHEACSLAGTLGLGKLIAFYDDNNISIDGHVDGWFSDDTAERFEAYGWQVIRNVDGHDAEQIRAATILAQAEKGKPTLIICKTIIGFGSPNKSGSHDSHGAPLGDEEIDLTRKALGWEYAPFEIPAEYYAEWSAKEKGAAAEKSWEEKFAAYAKAYPELAAEFKRRVSGELPTNWAAESKAFIEKLQANPASIASRKASQNAIEAYAHVLPEFLGGSADLASSNLTLWSGSKPIRAHENVGGNYINYGVREFGMSAIMNGIALHGGFIPYGATFLMFYEYAHNAVRMAALMKQRTLFVYTHDSIGLGEDGPTHQPVEQTASLRLIPNLETWRPCDQVESAIAWQQAVERQDGPSALIFTRQNLAQMDRTSAQLDAVKRGAYVLKDCDGTPELIFIATGSEVELAVQAAEALSAEGKKVRVVSMPSTNRFDKQDAAYRESVLPAAVTKRVAIEAGIADFWYKYVGFNGRVIGMNSFGESAPADQLFKLFGFTVENVVAKAKEIL

SEQ ID NO: 26617 - protein, 295 aa, Oceanobacillus iheyensis HTE831
MERKLGTDRVKRGMAQMQKGGVIMDVVNSEQAKIAEQAGAVAVMALERVPSDIRAAGGVARMANPSLVEEIIQSVSIPVMAKARIGHIVEARVLESLGVDYIDESEVLTPADEVFHLNKSDYTVPFVCGCRDLGEAARRIGEGAAMLRTKGEPGTGNIVEAVRHIREVQAQVNKVVHMSKDELMTEAKNLGAPYEILLQIKENGRLPVVNFAAGGVATPADAALMMELGADGVFVGSGIFKSHHPEKFARAIVQATTYFDDYERIAEVSKDLGEAMTGIDVHSLAADQRMQERGW

SEQ ID NO: 26618 - protein, 304 aa, Oryza sativa
MAGCLWPCVTGGGAAADGAGTLFRSKARGPVEVVRHARELLAFLAGEPRRMVDLAKSIGEMKSILYGNGEADPVDEACSQLTKEFFKENTNSLHLLVVCLPYMDLETQKDVTQVTANLLRQKVDYRMVASDYLEENQDLLDVLMSGYMIFILYIYTTCVQELLTRHRSSAAEFFSNNYDWFFPEFNSKLLSSSNYIIRRQATQLLGDILLDKSNTTAMVRYVSSKDNLIILMNLLREQSRAIQVEAFRVFKLFTCNPKKPPEIVGILVTNKSKILRFLADFTIEKEDQQFEADKAQVVTEISAM

SEQ ID NO: 26619 - protein, 263 aa, Magnaporthe grisea 70-15
MSPTGPLTRYDEHSFTKADNSVVVATDSIKNTIYIKARETPVNPPELYASILGQHFIDTYPHIHTAHVDVIVHRWTRMTIDGQPHPHSFFRDGQETRTVGAVVRRGSGLALRSGIAGLSVLKSTGSAFHGFVRDEFTTLPETWDRILSTDVDCGWSWKSFPDLDAVKAIVPKFDQAWEDARSITMKTFATDDSASVQATMYKMCEQILEAAPEVEKTDYSLPNKHYFEVDLSWHKGLANTGKDAEVYVPQSGPNGLIKCEVSR

SEQ ID NO: 26620 - protein, 199 aa, Triticum timopheevii
ELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDIIIADKFAPDANSQ

SEQ ID NO: 26621 - protein, 147 aa, Brassica napus
  misc_feature (117)..(117): Xaa can be any naturally occurring amino acid
  misc_feature (123)..(123): Xaa can be any naturally occurring amino acid
  unsure (1)..(147): unsure at all Xaa locations
GRVGNNCLFENNHGVELNEASKAKIFGKDFIAWANPEAADDSMWEDADDLLLNSPQSATPVRDTQDLTEAFEEATSEGIHSLALGALDNSFLVGGSGIQVFKNMRQGIQGKGVCVNXEPGYGXAHSAPRKALLMRAETNMLLMSPMS

SEQ ID NO: 26622 - protein, 610 aa, Zea mays
TRARVQRRNGDGDAAILVPYPDPLSLSVSMAAPPLVFVAAAIAALAILVLVLVVFAFRRWWWWWRQRRPLQAAAEASTPVAVQEEDIYRPLLSGNRDDHSRQSNYFLGSSVGEPSKIQTNRSNTSPRSHAIADTGRTYPDECCATQGETHVINIENDTSEEFRLGSTLRRTSPAKLTTPAQKHRRVSGDDYHNGSVPLKDSTYHSSLDLEVIAGPSHGISCSRQSSRPSMLPITLGRVPPSDLVLKDSEVSGKHAQINWNAKTLKWELVDMGSLNGTFLNSQAVHHPDAESRHWGEPAELAHGDIITLGTSSKLSVQITLQNQRVPAGVGMASDPMVARRSGKKLPMEDISFCQCPLQGVEHFGLFGIFDGHGGDGAAKAVSKILPENLGYILSHPETKERVQSCSDASDVLRYAFTLTEDAIDHQYEGCTGTALLIWFDQNKDCFAQCANLGDSACVMSVNGKTIDMTEDHRVASATERARIARTGQPLKDGEVRLNGLNLARMFGDKFLKEQDSRFSSEPYLSQAVRITKACTAFAVIASDGLWDVISTKRAVQLVVEGTERYSGDSASAAKVANRVLDEARSLRTKDNTSLIFVDFDILRTDPCIAK

SEQ ID NO: 26623 - protein, 1244 aa, Arabidopsis thaliana
MGSGNHVDIVDVSSGEEDVDTRGDVEYTDWLNGVMEPVDDTSDSTDIVEVLSEVRGGVNSQYRKPNSSNQALEDDDDCVILDCDPDKTRETTSVDDDDDDDVLVVGQKGEIACRDFPHPRHSCAKYAFNSTSHEKYCDMCHCYVCDIRAPCPYWCIAVSSIDHCHANDKEKIWKNQREYFRTGYMPTAPSSKPTPSILRVPKNTLLRKNHVEIRPCSSSTRVANPSSVKARHRIRQPIPHNQGLQSQPAQSLSTVRDSVIQKDRSSYRFSLRSRVASSAGNGISIRFNNAQVSQSSHHSSSTVAPTLNPETYTQQRNVRDHCTALPGSQSNVFTRHADQNIRGSGNRQFQTNVDRFAPSKAPLTAEDSHTATVQQQPGINENVLETKLSEFEKWLMENPNPTGPSHYGNTLPYAPFPPSALNSLSLFASSGFEFTLLSSLPISLYHSDTFAGEEALVLSIVGEALVLCFPALYRSRAAFRGSVKIALKPTRFSLTLGFLNFFRDEGEINVCEALRKLYGYTFGSARLFPMSLPFTRSKAHQMHFFHPYLNPSVAPTPSPAFSPNPSRIPPLRHKGHHRHRRWHLRRNATAVSPSSHDCQQTCVEPLTSTPFGSPCGCVFPMKVQLLLSVAPFSIFPVTNELEIEVAAGTYLEQSQVKIMGASADSENQGKTVVDINLVPLGEKFDNTTATLIYQRFRHKKVPLNETVFGDYEVTHISYPGIPSSSPNGDVTGDAPGGLPIPINATTFANKSQGIGFRTIAIIALSGFVLILVLVGAISIIVKWKKIGKSSNAVGPALAPSINKRPGAGSMFSSSARSSGSDSLMSSMATCALSVKTFTLSELEKATDRFSAKRVLGEGGFGRVYQGSMEDGTEVAVKLLTRDNQNRDREFIAEVEMLSRLHHRNLVKLIGICIEGRTRCLIYELVHNGSVESHLHEGTLDWDARLKIALGAARGLAYLHEDSNPRVIHRDFKASNVLLEDDFTPKVSDFGLAREATEGSQHISTRVMGTFGYVAPEYAMTGHLLVKSDVYSYGVVLLELLTGRRPVDMSQPSGEENLVTWARPLLANREGLEQLVDPALAGTYNFDDMAKVAAIASMCVHQEVSHRPFMGEVVQALKLIYNDADETCGDYCSQKDSSVPDSADFKGDLAPSDSSWWNLTPRLRYGQASSFITMDYSSGPLEDMENRPHSASSIPRVGGLILPNRSGPLRPMRSRRNFFRLRGSMSEHGGPSSSRHLWSGNGDWL

SEQ ID NO: 26624 - protein, 349 aa, Nostoc punctiforme PCC 73102
MSLWLGEILISETVTENWQQQAREAALADKLRAKAFGIAPENVDEAIAFRSHLLKSVLPAFSQFCQTTLQIEPKKMLQVLWDLWLPLGIKLASQRQQLERPLIQGILGGQGTGKTTMSKVLSLILNQLGYRTLSLSLDDLYKTYSDRLVLKQDPRLIWRGPPGTHDVDLGLDVLDQIRQSQSSVMVPRFDKSAYKGAGDRTNPEMVTGVDIVLFEGWFVGVRPINTDVFDTAPPPIVTNEDRAFARDMNLRLHDYLPLWDRLDSLIVLYPTDYRCSLEWRKQAEQQMIAAGKSGMSNAEIEQFVNYFWRSLHPELFIKPLVKDATAVDLVVEIYADHSFGEVYCDRANS

SEQ ID NO: 26625 - protein, 422 aa, Pyrococcus horikoshii OT3
MDMVEQDPFEIAVKQLERAAQHMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAVYDIISPYEDIPAPDVYTNPQIMAWMMDEYETIARRKTPAFGIITGKPLSIGGSLGRNEATARGASYTIREAAKVLGWDGLKGKTIAIQGYGNAGYYLAKIMSEDYGMKVVAVSDSKGGIYNPDGLNADEVLKWKREHGSVKDFPGATNISNEELLELDVDVLAPAAIEEVITKKNADNIKAKIVAEVANGPVTPEADEILFEKGILQIPDFLCNAGGVTVSYFEWVQNITGYYWTLEEVRERLDKKMTKAFYDVYNTAKEKNIHMRDAAYVVAVQRVYQAMLDRGWVKH

SEQ ID NO: 26626 - protein, 641 aa, Bordetella parapertussis 12822
MCGIVGIWGPLRDKANVLAESCRRIRHRGPDSNGYWEDAEADLALAHVRLAILDLTEAGHQPMVSACGRYVIVLNGEIYNHMELRERLQQDGLAPAWRGHSDTETVLACFAGWGLEQTLQAAVGMFAIALWDRAERKLALMRDRMGEKPLYYGYSQANLLFGSELKAFMPVPGFGRELDRNALASFMRHNYIPAPQSIYAGIRKLPPGAWVEIDAAQMRRGELPEPQVYWSARRAADQGLGDRRRFESDAQAIDALEQVVSQAVRGQMLSDVSLGAFLSGGIDSSTVVALMQAQSAQPVRTFAIGFHEKGYNEAEHAKAVAAHLGTEHTELYVTAEDGLAVVPSLADMYDEPFADSSQIPTSLVTRMARQHVTVALSGDGGDELFGGYSRYFRVDNWWRKCAAMPGPLRHLAGAALRGSAALPGAGAWRGKVGKLGELLGADTRGEFYRLFVSYWADPGRVVIGGTEPLSPFEQPMEGSTFDAMMKLDTVTYLPDDILVKVDRAAMAVSLETRVPLIDHRVYEFAWQLPFEYKVRGGTGKWLLRQLLYRHVPQAMVDRPKRGFAVPLAAWLRGPLRDWAEALLDPARLRQEGWFEPEPILRKWREHLSGHRNWDSHLWGVLMMQAWLDRYRAGAGDEAGRR

SEQ ID NO: 26627 - protein, 314 aa, uncultured marine gamma proteobacterium EBAC20E09
MTVNIDITKELKAVEKLIKSDINKEKTILGLYNYIFKSDGKKIRSRLNLIASSSSKNSDRYKLASIIELLHTATLVHDDVVDNASTRRGAISVNSLWSNAHGVLIGDYIYSKAFMLMVEIGKTDILAELADATNDISQGELIQLDAISNIKISLNKLKKISYFKTGRLFEASAKTGAMLAGANKNFIKNISESAKNIGILFQIKDDLLDYSNSSKTGKQSFQDLKEGKITYPFFFALKNSSQKEKKQLISFLGNKRLNEKKALALISKLNGLIKTQQLAEKFYTSSINTAKTINNQFIRQEMIELANIALNREK

SEQ ID NO: 26628 - protein, 127 aa, Glycine max
  misc_feature (33)..(33): Xaa can be any naturally occurring amino acid
  misc_feature (40)..(40): Xaa can be any naturally occurring amino acid
  misc_feature (52)..(52): Xaa can be any naturally occurring amino acid
  misc_feature (99)..(99): Xaa can be any naturally occurring amino acid
  misc_feature (119)..(119): Xaa can be any naturally occurring amino acid
  unsure (1)..(127): unsure at all Xaa locations
MASSMISSPGATTVDRAGADMVAPFTELKTMAXGFPTRKXSDDITSIASNAXRVQCMQVWPFLGKKKFETLYYLPDLDNDNWERKYNTFLTKGSIPCLXFEMEHGFLYREHNRSPGYYXGRYWTMWK

SEQ ID NO: 26629 - protein, 491 aa, Archaeoglobus fulgidus DSM 4304
MVRRLRGDCMEEVERAKAVLKENNVRQVLCAFADVRGYLQMFSIPAREFVDGSAFENGIGFDGSSVRGFRTIEKSDMVWMPDASSLKIIPWIDDPIQKSAIMFGNVYEAWGTEIADCDPRGYVAKRYEDMLKSEGMSAIFGPEIEFFLFEGVDFTRLSWDMWVSPNGGAGDSWGPPRIMPISSELESGYMIRPKEGYFRPPPEDTTVEYRNELVYYLEQLGIDIEYHHHEVATAGQVELDFKPKQLVDVGDAFYLYKFAAKNIAAMHGLYATFMPKPLYLDNASGMHTHQSLWKGEPFSGEAVFADPDDEYMLSQKARYYIGGLLEHAKALTALCAPTVNSYKRLVPGFEAPIYICWSPRNRSALVRVPMYVKKPSAIRVEYRGVDPSCNPYLAITAQLAAGLDGIKKKIDPGDPLLEDVYELTPAQKRELGVGELPTTLRDAIDHLASDELMQEVLGSHIFDAFMELKIDEWNQYCLYITPWEFMKYFDI

SEQ ID NO: 26630 - protein, 1071 aa, Neisseria meningitidis MC58
MPKRTDLKSILIIGAGPIVIGQACEFDYSGAQACKALREEGYKVILVNSNPATIMTDPEMADVTYIEPIMWQTVEKIIAKERPDAILPTMGGQTALNCALDLARNGVLAKYNVELIGATEDAIDKAEDRGRFKEAMEKIGLSCPKSFVCHTMNEALAAQEQVGFPTLIRPSFTMGGSGGGIAYNKDEFLAICERGFDASPTHELLIEQSVLGWKEYEMEVVRDKNDNCIIICSIENFDPMGVHTGDSITVAPAQTLTDKEYQIMRNASLAVLREIGVDTGGSNVQFAVNPANGEMIVIEMNPRVSRSSALASKATGFPIAKVAAKLAVGFTLDELRNDITGGKTPASFEPSIDYVVTKIPRFAFEKFPAADDRLTTQMKSVGEVMAMGRTIQESFQKALRGLETGLCGFNPRSEDKAEIRRELANPGPERMLFVADAFRAGFTLEEIHEICAIDPWFLAQIEDLMKEEKAVSDGILSDLDFAALRRLKRKGFSDKRLAQLLNVSEKEVREHRYALKLHPVYKRVDTCAAEFATETAYLYSTYEEECESRPSDRKKVMILGGGPNRIGQGIEFDYCCVHAALALRESGFETIMVNCNPETVSTDFDTSDRLYFEPLTLEDVLEIVRTENPWGVIVHYGGQTPLKLANALVENGVNIIGTSADSIDAAEDRERFQKVLNDLGLRQPPNRIAHNEEEALVKAEEIGYPLVVRPSYVLGGRAMQVVHSAEELQKYMREAVQVSEDSPVLLDFFLNNAIEVDVDCVSDGKDVVIGGIMQHVEQAGIHSGDSGCSLPPYSLSEEIQDEIRRQTKAMAYALGVVGLMNVQFAVQDGVVFVLEVNPRASRTVPFVSKATGVPLAKVGARCMAGISLKEQGVEKEVVPDFYAVKEAVFPFIKFPGVDTILGPEMRSTGEVMGVGASFGEAYYKAQLGAGERLNPTGKIFLSVREEDKERVIKTAKNFQVLGYGICATRGTAQYLTEHGLIVQTINKVPEGRPHIGDALKNGEIALVVNTVSSDPQSVSDSHIIRQSALQQRVPQYTTTAGGEAMSEGAKSRDHLGVYSVQELHGRLKNRN

SEQ ID NO: 26631 - protein, 429 aa, Archaeoglobus fulgidus DSM 4304
MKYDYVIIGNSAGGIGCVEAIRELDVDSSILVISAEKYHAYSRALIPYYLDGKIEFEKMYYRPPDFYEKMDVETKLGVRAVGVDVEAKKVLLESGEEVEYGKLLIATGGKPFIPPMEGLGGQSNVFTFLKMDDVLAVEKAIKEAKKAVVLGGGIIGLMASEVLAKKGLDVKVVELADRVLAPVVDETTSRIVERKFEENGVEIILNNTISKVVGEERVEKVILRDGRELEADMLLVAVGVVPNVDIVKNTPIKVNRGIVVNRKMETSVKDVYACGDCAEIYDFVFGANRVLPLWPTAYTGGRIAGFNMVGIEREYNLATSMNAMHFFDYYIINAGLNVPNDSEEFEVIYRLEGDSYRKFALKDGRIAGFIIAGKMERAGIFLKLMEEGIDVSSFKEKLLKDNFGFLDIPEPTRWKLIEDKIKLGVVREI

SEQ ID NO: 26632 - protein, 316 aa, Oceanobacillus iheyensis HTE831
MKDIITLGEAMVVFNPASTGPMKFVNGFHKTIGGAELNLAIGCARLGLDTGYITRLGNDEFGKSIRNFVRGEGIDASEIDFIDHYPTSINFKEIMEDGSVRTFYYRDKSPTLSMTPDVLNESYFKNAKILHLTGIFPAIGEGALKVWKQAIHLAKKHGVKISFDPNIRLKMWSKEQARKVLLEILPDVDILLAGDEEMDIIIGKRDPVDIIETCKELGIPYVAIKQGENGSVGYSQGETMKAAPVKASKVVDTVGAGDGFNAGILYGYLHDWSLERTLTFGNTIGSMVVGITGDNEGLPYYEDVQERLGEIERIER

SEQ ID NO: 26633 - protein, 427 aa, Neisseria meningitidis MC58
MNRNEILFDRAKAIIPGGVNSPVRAFGSVGGVPRFIKKAEGAYVWDENGTRYTDYVGSWGPAIVGHAHPEVVETVCEAALGGLSFGAPTEGEIVIAEEIAKIMPSVERLRLVSSGTEATMTAIRLARGFTGRDKIIKFEGCYHGHSDSLLVKAGSGLLTFGNPSSAGVPADFTKHTLVLEYNNIAQLEEAFAQSGNEIACVIVEPFVGNMNLVRPTEAFVKALRGLTEKYGAVLIYDEVMTGFRVALGGAQSLHGITPDLTTMGKVIGGGMPLAAFGGRKDIMECISPLGGVYQAGTLSGNPIAVAAGLKTLEIIQREGFYENLTARTEQLVQGFRTAADAAGIEFTADSVGGMFGLYFAAHAPRNYADMARSNIEGFKQFFHGMLDRNVAFGPSAYEAGFVSAAHTPELIDETVAVAVEVFKAMAE

SEQ ID NO: 26634 - protein, 224 aa, Oceanobacillus iheyensis HTE831
MEYSDKQIAAQEAVRYIKDGMVIGIGSGSTVNEFLYCLAARMRKERLQVVGIPASKKSERLATELGIPLTTFATYQNVDIAIDGTDEIDDQLYLVKGGGGSLVREKMIDLVAETFIVIASGKKKIKKLGSFPVPVEVVPFGWQATEQRLQQFGCQTNLRMVEEDIFVSDNQNYIIDCDFKEIDDAEALHRSLKQIVGVIETGIFINMVDKAIVADNGELSILEK

SEQ ID NO: 26635 - protein, 297 aa, Brassica napus
MASVAASPAFSLRKSTTGATASSAATRARASLLPVPSKSISTRPLGFSAVLDSRFTVHVASKVQSFRGKGTRGVVSMAKKSVGDLTSADLKGKKVFVRADLNVPLDDNQTITDDTRIRAAIPTIKYLIENGAKVILSTHLGRPKGVTPKFSLAPLVPRLSELLGIEVKKADDCIGPEVESLVASLPEGGVLLLENVRFYKEEEKNDPEFAKKLASLADLYVNDAFGTAHRAHASTEGVTKFLKPSVAGFLLQKELDYLVGAVSSPKRPFAAIVGGSKVSSKIGVIESLLEKCDIRRL

SEQ ID NO: 26636 - protein, 577 aa, Erwinia carotovora subsp. atroseptica SCRI1043
MSEKYVFSEKHPGPLVVEGKLTDAERMKTESNFLRGTIAEDLNDGLTGGFKGDNFLLIRFHGMYQQDDRDIRAERAEQKLEPRHAMLLRCRLPGGVMTPQQWLRIDKFAGENTIYGSIRITNRQTFQYHGILKSNVKPVHQMLNSIGLDALATANDMNRNVLCTSNPIESELHQQAYEWAKTISEHLLPRTRAYAEIWMDQEKVATTDEEPILGSTYLPRKFKTTVVVPPQNDVDLHANDLNFVAIADNGRLVGFNVLVGGGLSIAHGDKETYPRTASELGYISIEHTLAIAEAVVTTQRDWGNRTNRKNAKTKYTLERVGVDNFKQEVEARAGVKFEAVRPYEFTERGDRIGWVKGIDNKWHLTLFIENGRILDYPGRPLKTGLAEIAKIHKGDFRLTANQNLIVAGVPARSKAKIDALAREHGLIDDSVSEQRKNSMACVSFPTCPLAMAEAERFLPEFVTKVEGIMQQHGVGDEHIVLRVTGCPNGCGRSMLAEIGLVGKAMGRYNLHLGGNREGTRIPRMYRENINETEILAEIDRLVGLWAQDRLQNEGFGDFVIRTNIIRPVLDPARDFYD

SEQ ID NO: 26637 - protein, 243 aa, Fusobacterium nucleatum subsp. vincentii ATCC 49256
MDNKKDEKILELVNILKNTKYLVFFGGAGTSTDSGVKDFRGKNGLYKTLYKDRYRPEEVLSSDFFYSHRDIFIEYVEKELNINGLKPNRGHMALVELEKMGILKAIITQNIDDLHQVSGNKNVLELHGSLKRWYCLGCGRTGDRNFSCECGGIVRPDVTLYGESLNQAIVNEAIYQLEQADTLIVAGTSLTVYPAAYYLRYFRGKNLVIINDMDTQYDGEASLVIKDNFSYVMNKVVEELKKF

SEQ ID NO: 26638 - protein, 354 aa, Bacillus cereus ATCC 10987
MEKRIVCLAGDGVGPEVMESAKEVLHMVERLYGHHFHLQDEYFGGSAIDLNGQPLPQRTLAACLASDAVLLGAVGGPRWDSAKERPEKGLLALRKGLGVFANVRPVTVESATAHLSPLKKADEIDFVVVRELTGGIYFSYPKERTDEVATDTLTYHRHEIERIVSYAFQLASKRKKKVTSIDKANVLESSKLWRTVTEEVALRYPDVELEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGCAIEEAISAVLKLGKCTADIGGTETTTSFTKAVMQEMEEQALVGRGR

SEQ ID NO: 26639 - protein, 106 aa, Glycine max
  misc_feature (52)..(53): Xaa can be any naturally occurring amino acid
  misc_feature (64)..(64): Xaa can be any naturally occurring amino acid
  misc_feature (73)..(73): Xaa can be any naturally occurring amino acid
  unsure (1)..(106): unsure at all Xaa locations
MGRKKGYVEFEESPPDDFDPAHPYKDPVAMLEMREHIVREKWIQIEKAKIIXXKLRWCYRIEGXNHLQKCRHXVNQYLEFTRGIGWGKDGRHPPFHAPKVDPVESE

SEQ ID NO: 26640 - protein, 229 aa, Myxococcus xanthus DK 1622
MTSALAPLRAVVFDMDGTLVDNMQFHNEAWVSFAQKLGLPLTANDFQSRFAGRKNEEIIPELLGRPVAPDEVERIAEEKENHYRTLYRPHLKLHRGAEAFIQRLKEAHVPAAIATAAPQGNRELVLDGLGIRPLFASIVGAEQVTRGKPAPDIFLAAAKALGVAPTECLAFEDAVLGIISAREAGMTVVGLTTAAPEADLRKAGAHWVVQDFTQLPPALEQRLFSAQAR

SEQ ID NO: 26641 - protein, 512 aa, Glycine max
  misc_feature (208)..(208): Xaa can be any naturally occurring amino acid
  unsure (1)..(512): unsure at all Xaa locations
MQPLRRKTPLFTSEMGTMKGRKNNNLSIFVVVFSIFLFGLFMYNEDVKSIAEFPFSSPKAHETQEGGEPNKHVDSVQDSVVVQRESEKKDVEDTATVKISSKRSTSRAQLEKSGAEDEDSDERVDLKTVVEKEKKIEMPRAEEEEEVEEEEEDEKVELPPEDCDLFTGEWVLDNVTHPLYKEDKCEFLTSQVTCMKNGRPDSLYQNCXWKPRDCSLPKFKPKLLFQKIRGKRLMFVGDSLNRNQWESMVCMVNSAVPSYNKTWYKTGSLAIFKIEEPEHVTTVEFYWAPFLVESNSDDPNMHSILNRIIMPESIEKHGMNWKDVDYLIFNTYIWWMNTFSMKVLRGSFDEGSTEYDEVPRPIAYGRVINTWSKWIDDNIDPNRTKVFFSSTSPLHIKSENWNNPNGIKCAKEITPVLNMSTPLDVGTDRRLFTIANNVTQSMKVPVYFINITSLSELRKDAHTSVYTIRQGKMLTPEQQADPTTYADCIHWCLPGLPDTWNEFLYTRIISQS

SEQ ID NO: 26642 - protein, 280 aa, Mesorhizobium loti MAFF303099
MVEATKKAFVTGHPIKHSRSPKIHGHWLAQHGIDGSYEAIDVAPQDFAEFIAALQANGFRGGNVTIPHKEAAFAVAQRRDQAAEEIGAVNTLWFEDGVLRGGNTDGHGFAANLDDCAPGWANTGPAVVLGAGGASRAVIQALKQRGFSDIRIVNRTLARAQELRDRFGAGVSAHGTAATDELLADAGLLVNTTALGMVGNEGLAADPALLPDHAIVTDLVYVPLETPLLAAARARGLKTVDGLGMLLNQAVPGFEHWFGVRPQVTAELRALIVADLVPKP

SEQ ID NO: 26643 - protein, 367 aa, uncultured marine gamma proteobacterium EBAC20E09
MSKRDYYETLEVSRDASASELKKAFKKKAMKFHPDRNPDNPEAAEKFKEAAEAYDVLSDPQKKSAYDQFGHSGVEGMGGGGPNFNDININDIFGDIFGDVFGTRSQSRRQRRGSDLQYNLELSLKDAVLGVQKKIKIPSHRECPDCLGSGAAKGTKPVTCMNCNGTGQVRMQQGFFSIQQTCSVCSGTGQVIKEKCGTCGGVGAIKENKTLSVNIPAGVDNGDKVRLSGEGEWMKGGRSGDLYVAIRVKDNPLFERDGRHLYIEAPIPFDVSILGGSIKIPTLEKTISLKIPSNTQTGKVFRIKGEGASIVRNKRRGDILCRVIVETPSNLDKAQLKALSELTKKLEPSKNYPGTDIFLKAISKNKE

SEQ ID NO: 26644 - protein, 319 aa, Mesorhizobium loti MAFF303099
MTADRHHGKYETRLDPALWAYIDRVDAWYPPEVIGLPIDKQRAVYDRMCRAFHQGRPPGVKASDGLVAAPGHGIPIRHYRPAGKAARAMVLYFHGGGFILGNLDSHDDICAEICAGTGFDVLSVDYRLAPEHVHPAAFDDAMAAFAWAAETSRLPLVLCGESAGGNLAAAVAQATRKHARTAVGQVLIYPGLGGDEGAGSYVEHAEAPLLSVGDIAFYRDVRSAKRQSPDDPTFSPLRDRHFSGLPPTVIITAECDPLSSDGETYRDRIAAAGGKAWWHEEKRLVHSFLRARTTVPAAAEAFSRIIAAIAALGRGEWPY

SEQ ID NO: 26645 - protein, 495 aa, Candida albicans SC5314
MKHCKVFVCMSGESRVMMDNFCMVKFFFFSFLFQHQQLNGKSPSFLPSFLSIHHLQPLQNMSGQQLLEEARKAVTNKQYDEAEIKYKQIINPSESSTSTTTTTTTTTTTAKQLQQQESAILELGKIYETLNEPTKLSDLIADSRSILGNFAKSKTAKIVKTLIEDFDKLSAKDEKSLDIQIDVTKSSMQWAIESKLSFLRQSLQLKLSDLLYQKKHHHEAIKIINELLREYKKLDDKSSLVEVQLLESKIYHALRNIPKAKAALTSARTSANSIYCPTILQAELDCQSGILNSEDKDYKTAFSYFYESFEGFNSQDDPRSIIVLKYMLLTKIMLNLIDDVNNILNNKNVIKYKSKDIDAMKSIAMAYSNRSLKEFENSLLTYANELKSDAIIKNHFNALYDNLLEQNLLKIIESYSCVELSHISKVIGLNLQQVEGKLSQMILDKVFYGVLDQGNGWLIIYDEPRKDAAYEASLELVKNLSNVVDLLYEKASSLN

SEQ ID NO: 26646 - protein, 190 aa, Triticum aestivum
MGEEEKKPKEEEKPKEEEKPKEGEEEKPKDDKPKEGEGEGEKPKEEEAAPPPPPPPPEEVVMRVYMHCEGCARKVKKILKRFDGVEDVIADSKAHKVVVKGKKAAADPMKVVERVQKKTGRKVELLSPLPPPPEEKQEEEKKEEPEPPKPEEKKEPTVISVVLKVHMHCEACAQAIKKRIEKMKGVQSAD

SEQ ID NO: 26647 - protein, 486 aa, Ralstonia eutropha JMP134
MTNRTIELKHPRQLYIDGVWVEPSTGGVFDVLDCSTEQVVATVARAESADMQRAVAAARKAFDDGPWPRMTPLERAGFLEKIAVRLEALNDEFARIWSLETGIVYKVAQPRIGLFISGAFRQYAAMASTFPFTQPCQSVTGNDAYRVYEPVGVVAEIIPWNGPAGLLAYKTAPALLAGCTLVIKSPPEAPCSGYLFAQVCEEVGLPPGVVNVITAERDVSEALVRSPEVDKITFTGSTAAGRRIASIAGDRVARVTLELGGKSPAVILDDYDVETAAATLGNSYFSYNTGQICHSLTRIIVPRAKHDAMVEALSAIAREIVLGDPLAATTTSGPLANARQRDTVERFVAMGVAEGAVLATGGKRPPHLARGFFFEPTVFGNVDNRSSIAQQEIFGPVLSVIPADDEASAIRMANDTPFGLNAAVFTNDRDRALAVARQIRAGTVGHNGPRTDFSIGFGGFKQSGIGREGGVEGLTAFMESKTIVLS

SEQ ID NO: 26648 - protein, 405 aa, Chromobacterium violaceum ATCC 12472
MSLVTGRIEYMNLNWLNGLLDLPWWGNIIAALILTHITIASVTIFLHRHQAHRALDLHPIPSHFFRFWLWLTTGMVTKQWAAIHRKHHARCETQEDPHSPQVLGIKKVLWEGAELYRAACKDQSIMDKFGHGTPDDWLERNVYSKHNAKGIVLMLLIDLALFGPIGLSIWAVQMVWIPFWAAGVINGLGHYWGYRNFENEDASTNLVPWGILVGGEELHNNHHTFGTSAKLSYKWYEFDIGWMYIRMLEICGLAKVRKVAPQLAHDPSRPQLDLEHLQAIIANRYAIAARYARELKAECRAELAKLSLPELPQVNLPRKMKVWLKQDAKDLPECERDQLARILEQSHVLATIYNMRQELTRLWERSNLTREQLLHELQDWCARAEASGIAALQRFSLNLRQTALA

SEQ ID NO: 26649 - protein, 396 aa, Brucella abortus
MMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAVVGWHFAADTPHQTYGVDSVPGDAMILDAGELSTDLIASAIDDAATLVWNGPLGAFELRPFDTATVKVARHVAKRTKEGKLVSVGGGGDTVAALNHAGVADDFTYISTAGGAFLEWMEGKPLPGVDVLKK

SEQ ID NO: 26650 - protein, 189 aa, Zea mays
MLLVSPSVLNEGVYEESLQDICTTPDELHQIPPIKDNNSSSKPNQKLKGKNFTEDEDRLLVSAWLNVSTDPVQGTNQTKATFWTRVYKFYDMNRGEFAERNQNSLLHRWGCIQEAVSKFCACLTQIEGRNQSGMTVHDRVEQAERLFKSQNPKEKSFQFRHNWLQLRNQPKWHDKLHQLTATKTSNKKQ

SEQ ID NO: 26651 - protein, 409 aa, Myxococcus xanthus DK 1622
MSKVLAMILAGGAGTRLEPLTRERAKPAVPFGGRYRIIDFVLSNFANSGVYRMKVLTQYKSDSLNNHLSRAWRMTAFLGHYVEAVPAQMRTGLDWYKGSADAIYQNLNIITDEEPDYIFVFGADHVYRMDTRQMLDFHCTKKAACTVAAIPVPIEQGREFGIIDVGPDGRMRQFLEKPKDPPPMPGNPKMCLASMGNYLFSTDVLVQEVVRDAANEASAHDFGKSIISELYKRAPVYVYDFAQNEVPGQEAKERGYWRDVGNIDVYYQSNMDLVEVDPTFNLYNDRWPIHTQPNNYPPAKFVFADEQNHRVGHAMDTLVAEGCIISGGSVRRSVLSPKVRVNSYSEVEDSLLFENVTIGRRCRIRRAIIDKNVEIPPGMTIGFDPVEDRRRFHVTPGGVVVIPKGMKVT

SEQ ID NO: 26652 - protein, 240 aa, Arabidopsis thaliana
MEKASNSNKSTKFSKMLQRAMSIGHSAAPFSPRRDFHQHRTTSTANRGIFFSSPLVPTAARVRRNTKYEAVFAEPTSPKVSCIGQVKLARPKCPEKKNKAPKNLKTASSLSSCVIKEEDNGSFSKLKRIFSMRSYPSRKSNSTAFAAAAAREHPIAEVDAVTAAPSLGAMKKFASSREALGGFDWTVQMKREKEDVMIPCSVGIPLTQLEDLSLCPKPKSEVNLWKRRTMDRPKPLQVIK

SEQ ID NO: 26653 - protein, 280 aa, Rhizobium leguminosarum bv. viciae 3841
MAQNRAFVMGHPIAHSRSPMLHGYWLKRCGIEGSYERLDVPPQDIDSFFSGFREAGWIGGNITVPHKTAVIPHLDHIDDAARKMGAVNTIWWEDGVLVGGNTDAIGFLGNIDELAPGWDKGKRAVILGAGGATRAATYGLLSRGLTVALCNRTVSKAEALASHFGAGVSAHGMNALPELIAECDLLVNTTSLGMIGQPPLDIDLSPLKKDAIVYDVIYVPLETELIKAAKARGHRSVDGLGMLLHQGVVGFNRWFRIKPEVTGELRQILIDDIRAKTPGA

SEQ ID NO: 26654 - protein, 647 aa, Cryptococcus neoformans var. neoformans JEC21
MSDGERITQASSGHGYKQKSRYPLTAAMTEGKPVTQHVEGGASEKPGIPRTSSDDASSEGHPKKATGNALGRKESHKVDLISNTNAKLANPLGDLTDEEVMDNAAAFAAANNLPVEVFRKGGLVAKRPNGFEKMSILTEKDKERLRREITHPYSQTKTLYNLVIACSVAAAVQGMDESVISGAQLFYPEQFGIGAINPDPRYAHNHEWLEGLVNGAPYLCCAVLGCWLTAPLNKWFGRFFLGLGIGPKSATVPVFAAECTPAKIRGSLVMQWQVWTAFGIMLGYVADLIFYHVPDTPNITGLNWRLMLGSAGFPALIVMAQIFFLPESPRWLMAKGKYEKAYRSMLRLRGDELLAARDLYYIFVLLEEEAAIVRGRNLFWELFSVGRNRRAMIGSTIVMFGQQFCGVNAIVYYTASIFTSAGFSEISALLASFGFGLINALFAIPGMLTIDKFGRRPLLLVTFPIMSILLLFTGFCFWIPDREARVGCIALGIYLYCMAYSPGEGPVPFTYSAEVYPLYIREVGMSLATATTWLFNFIVSLTFPKLLTAFTPQGAFGWYAAWCALLFVLILFFLPESKGYTLEELDQVFSVPTGVHAKYQLWNIKWHFNHYILRSKEPFKPLYQFEDDDEPASVRHEKHDGQAEHVA

SEQ ID NO: 26655 - protein, 300 aa, Rhizobium leguminosarum bv. viciae 3841
MEDGGSMVSPKRKRLVTGKTIVIPLVGHPVEQVKSPGPINNWFAEHGVDAVIVPMDIRPEKVASFFDVLRAMENCAGCSITMPHKQAAFVACDEVSERARRARAVNTIRRSPSGKLIGEMTDGMAFIAALGGHGVRVRGCNALLIGAGGAGMAIAFELASEGASSLTIIEPDQMRRRALEAELSRYHPALEVFDRVAAGRKIDIAVNASPLGMNFGDPLPFPIAELAGALIVADAVTKPVVTPWLKEAERHGLKVQNGEEMALAQLPIQLSYLRFMNSSSRSAGEATGEDELSVAPEAAK

SEQ ID NO: 26656 - protein, 801 aa, Zea mays
  misc_feature (621)..(621): Xaa can be any naturally occurring amino acid
  unsure (1)..(801): unsure at all Xaa locations
MEEEQSPRLGRDPATEPSPAPEWPDSDSKNDDSANDPEDPAGGSGSGSGNGISSLEQPLLKRSTTLTASHLAIVGAKVSHIESLDYEIIENDLFKHDWRSRSNVEVLQYIFLKWAMAFLVGLLTGVIASLINLAIENISGLKMLQMVNLVRGKRYWAGFLYFAGVNFALTFVAAVLCVVFAPTAAGPGIPEIKAYLNGVDTPNMFGAPQLIVKIIGSIGAVSSGMDLGKEGPLVHIGACLANLLSQGGEGRWRLRWRWLRYFNNDRDRRDLITCGASSGVCAAFRAPVGGVLFALEEVATWWRSALLWRTFFSTATVVVVLRGFIEVCRDGRCGMFGEGGLILFDVSDVTVRYHVGDLLPVTLVGVLGGVLGALYNHVLHQVLRLYNLINAKGRLAKLALALAVSVFTSAGLYLLPFAVPCTPCDPAFGDACPTVGKSGNFKQFNCPTGYYNDLASLLHATNVDATRNIFSTGTAGEFRLDSLLIFFGIYCVLGLFTFGIAVPSGLFLPIILMGSAYGRILALVLARFVRIDHGLYAVLGAAALMSGSMRMTVSLCVIFLELTNNLLLLPITMFVLLIAKTVGDAFNPSIYEIILDLKGLPFLEPKPETWMKDLAVGELAXAKPRVVTLQVIEKVSTVVEVLRSTPHNGFPVLDWPRPGVSELHGLVLRSHLMAVLKKRWFLTEKRRTEEWEARERFSSTELAEKSGSIDEVAVQLTPEELDMYIDLHPFTNTTPYTVVETMSVAKAVVLFRTCALRHMLIIPKFQGPEIAPIVGILTRQDLRAHNILGAFPHLANKRKVH

SEQ ID NO: 26657 - protein, 875 aa, Triticum aestivum
  misc_feature (112)..(112): Xaa can be any naturally occurring amino acid
  misc_feature (511)..(511): Xaa can be any naturally occurring amino acid
  unsure (1)..(875): unsure at all Xaa locations
FAIVAHMFNGFSELALATIKLPVFFKQRDYLFFPAWAYAIPTWILKIPISCVEVAITVFLGYYVIGFDPDVGRLFKQYLLLLFVNQMAAGLFRFIAALGRTMVVANTLGVLXFLCCSVLSGFVLSHHDVKKWWIWGYWMSPPQYAMSAIAVNEFLGGKWQPVLQGSNRTLGIDVLKSRGFFTEAKWYWIGVGALLGYVIVFNILFTLALSYLKPLGKSQQILSEDALKEKHANITGETPDDSISAAAGNINSSRRNSAAPDDSGRRGMVLPFAPLAVAFNNMRYSVDMPAEMKAQGVDEDRLLLLKGVSGSFKPGVLTALMGVSGAGKTTLMDVLAGRKTGGYIEGDISISGYPKKQETFARISGYCEQNDIHSPNVTVYESLVYSAWLRLPSDVESETRKMFIEQVMELVELNSLRDALVGLPGVNGLSTEQRKRLTIAVELVANPSIIFMDEPTSGLDARAAAIVMRTVRNTVDTGRTVVCTIHQPSIDIFEAFDELFLMKRGGEEIYXGPLGHQSCDLIQYFEGIERVSKIKPGYNPATWMLEVTSQAQEDILGVSFAEVYKNSDLYQRNQSMIRDISRAPAGSKDLYFPTQYSQSSITQCMACLWKQHLSYWRNPQYTVVRFFFSLVVALMFGTIFWQLGGKRSRTQDLFNAMGSMYAAVLFMGISYSSSVQPVVAVERTVFYRERAAGMYSALPYAFGQVVVELPYVLVQSLAYGVIVYAMIGFQWDVKKFCWYLYFMYFTLLYFTYYGMLAVGLTPSYNIASIVSSFFYGVWNLFSGFVISRPTMPVWWRWYSWVCPVSWTLYGLVASQFGDLTEPLQDSGVPIDAFLKSFFGFQHDFLGVVAVVTAGFAVLFAVAFGLSIKVLNFQRR

SEQ ID NO: 26658 - protein, 276 aa, Rhizobium leguminosarum bv. viciae 3841
MSIFEEAKIDCHAHVLDPAQFPYAEDAAYKPWGQEIGTTAQLVQVMQAYGTRHALLVQPNSGYGSDNSCMLDAIRRHPKLFKGVAIAALDAETATLRALRDQGIVGIALNPTFHGNAYYESASGLMEKLAKLDMFVQIQVEHDQLAMFRPWIEKIPVRVLIDHCGRPTPRDGLDYPGFETLLRLSDTGRVHVKLSGYAKFAGTAYPFEDTWPFLRALVGAFGLEQCMWASDWPYLRAADRQDYGPLLKLVEMLFPDVEDRRQILWETPRRLFGFGS

SEQ ID NO: 26659 - protein, 459 aa, Magnaporthe grisea 70-15
MGQNQSGMGGGQDGKDDKDKKKDKPKYEPPPRPTTRVGRKKRRGGGTSAAAKLPAIYPTSRCKLRLLRMQRTHDHLLLEEEFVENQERLRRVKAAKDSNAPASDLDAGDRMADERGRVDDMRGSPMGVGTLEEMIDDDHAIVSSTTGPEYYVSIMSFVDKDLLEPGASVLLHHKSVSIVGVLTDDADPLVSVMKLDKAPTESYADIGGLEQQIQEVRESVELPLLHPELYEEMGIKPPKGVILYGAPGTGKTLLAKAVANQTSATFLRIVGSELIQKYLGDGPRLVRQLFQVAAENAPSIVFIDEIDAIGTKRYDSTSGGEREVQRTMLELLNQLDGFDDRGDVKVIMATNKIETLDPALIRPGRIDRKILFENPDQNTKRKIFTLHTSKMSLNEDVDLEEFIAQKDDLSGADIKAICSEAGLMALRERRMRVQMADFRAARERVLRTKQEGEPEGLYL

SEQ ID NO: 26660 - protein, 529 aa, Oryza sativa (japonica cultivar-group)
MAMATLARRPPAEAALLRRAPAAAWASAWRGYAAAAAGEESDVVVIGGGPGGYVAAIKAAQLGLKTTCIEKRGTLGGTCLNVGCIPSKEVMNHFDPFYLAVPSIYYELRSTMGALLHSSHMYHEAKASFAHHGIKFSNLEIDLPAMMSQKDKAVAGLTKGIEGLFKKNKVEYVKGFGKFVSPSEVSVDLLDGGSTTVKGKNIIIATGSDVKSLPGVTIDEKKIVSSTGALALSEIPKKLVVIGAGYIGLEMGSVWNRLGSEVTVVEFASDIVPSMDGEIRKQFQRMLEKQKMKFMLKTKVVGVDTSGSGVKLTVEPAAGGEQSVLECDIVLVSAGRVPYTSGLGLNALGVETDKGGRILVDKRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGLVKVVAEKETDRILGVHIMAPNAGEIIHEAVLALQYGASSEDIARTCHAHPTVSEALKEACLQTYLKAIHI

SEQ ID NO: 26661 - protein, 397 aa, Saccharomyces cerevisiae
MLHQKIAHKVRKVVVPGISLLIFFQGCLILLFLQLTYKTLYCRNDIRKQIGLNKTKRLFIVLVSSILHVVAPSAVRITTENSSVPKGTFFLDLKKKRILSHLKSNSVAICNHQIYTDWIFLWWLAYTSNLGANVFIILKKSLASIPILGFGMRNYNFIFMSRKWAQDKITLSNSLAGLDSNARGAGSLAGKSPERITEEGESIWNPEVIDPKQIHWPYNLILFPEGTNLSADTRQKSAKYAAKIGKKPFKNVLLPHSTGLRYSLQKLKPSIESLYDITIGYSGVKQEEYGELIYGLKSIFLEGKYPKLVDIHIRAFDVKDIPLEDENEFSEWLYKIWSEKDALMERYYSTGSFVSDPETNHSVTDSFKINRIELTEVLILPTLTIIWLVYKLYCFIF

SEQ ID NO: 26662 - protein, 735 aa, Oryza sativa (japonica cultivar-group)
MNSFLFSALFFFWLLFCSCKASSAMGNSLPVESKFTFEEENDRIKYVVSSMQGWGEKMEDAHAAILNLDDTTSTSFFGVYDGHGGAEVALYCAKQFHIELCNHEDYHNDLINALDNVFLSMDENLQQSDAWRELVIPHDNGCMYFLKAGVCAKPFPQATYTGPAYEGSTACVVVIRGNQMIVGHVGDSRCVLSRQGGLAIDLSFDHKPCTRTESERERVQNAGGRSLGLRCEQVMGNYVVKEQWVLGDFGGGDFAFKKNKDLDREKQMLVCDPDILADDITDDMEFLVIASQGLWSCVDSADVVSYIHDRLSVEGAELRVICEEVVEFGLASGENTTVILVQFKPGAFQYQLVDPAGFGTAVSNIASTSAAPAGASDTSDEGVDDAATARPTVMGYDADSSTGSADATVDSDEVDPNATADSYNPRGHAEIVASHTDDEVYTSGSARVESGELAVPTPSANNTVADEVKVDAAVVAGGSTTAMAADEATVVSLLSTIVDNYYSINTSEEPARRLIPLPLSQPTTRFINININAENARMTYIVKRREYFLVKSSCRCGGRHQQREVTSGGAGVEHGSIGDVPPSIRRAGRWMEKGRRRGRRAGSKYAKKEEEEGASCHAGCRHFVPEIGPWSEATIPENPRLPNSDENDMDAGGEEAKQERHLVLAHELFLLSRPDLDDLANVALRSDALDAVKSDGMAPLFESLATAGVLLKPDDAAARRDARADRRGGPQARRE

SEQ ID NO: 26663 - protein, 125 aa, Zea mays
MDQSPPEFDYLFKLLMIGDSGVGKSSLLLRFTSDSFEDLSPTIGVDFKVKMVTIGGKKLKLAIWDTAGQERFRTLTSSYYRGAQGVIMVYDVTRRETFTNLSDVWAKEVDLYVTNQDCIKIAGGN

SEQ ID NO: 26664 - protein, 369 aa, Arabidopsis thaliana
MEMMKIDPLFDRASELKAFDETKTGVKGLVDSGVSQVPRIFHHPTVKLSTPKPLPSGLLHLKTIPTIDLGGRDFQDAIKRNNAIEEIKEAAAKWGFFQVINHGVSLELLEKMKKGVRDFHEQSQEVRKEFYSRDFSRRFLYLSNFDLFSSPAANWRDTFSCTMAPDTPKPQDLPEICRDIMMEYSKQVMNLGKFLFELLSEALGLEPNHLNDMDCSKGLLMLSHYYPPCPEPDLTLGTSQHSDNSFLTVLLPDQIEGLQVRREGHWFDVPHVSGALIINIGDLLQLITNDKFISLEHRVLANRATRARVSVACFFTTGVRPNPRMYGPIRELVSEENPPKYRETTIKDYATYFNAKGLDGTSALLHFKI

SEQ ID NO: 26665 - protein, 622 aa, Arabidopsis thaliana
MAMAVFKAPLKGEFHGARKMEGKQYKHHLLQQQSTGRRRVFVQTDTGCVLGVELDRNDNVHTVKKRLQIAFNFPTEESSLTFGDMVLKNDLSAVRNDSPLLLKRNLMHRSSSTPCLSPTGNDLQRKDRSGPIEILSHSPCFLSLKQTANDIVKAMKMGVEPIPVNGGLGGAYYFRDEKGQSVAIVKPTDEEPFAPNNPKGFVGKALGQPGLKPSVRVGETGFREVAAYLLDYDHFANVPPTALVKITHSVFNVNDGMDGNKSREKKKLVSSKIASFQKFVPHDFDASDHGTSSFPVASVHRIGILDIRILNTDRHGGNLLVKKLDDGGVGRFGQVELIPIDHGLCLPETLEDPYFEWIHWPQASIPFSEEELDYIQSLDPVKDCEMLRRELPMIREACLRVLVLCTVFLKEAAVFGLCLAEIGEMMTREFRAGEEEPSELEMLCIEAKRLTTEQDVLSPKSDGEGETEFQFDIDYNELDSVYGSETETDEFFAKNPFSNGRSSLGELKESIAEEEEDDEEEAKLTLSLSKLSTSMKNNLSNTMGSGYLKPPKDNQTDKALVSHKSANVQLPLSVNFVKLADMKEVEWVVFLERFQELLYSAFAERKTMTLRNTQRLGTSCKF

SEQ ID NO: 26666 - protein, 215 aa, Cenarchaeum symbiosum
MGRVPRVGIGGPVGAGKSMLIERVVPVLAARGYHVSIVSNDVISKEDADRMRASLATERGLLPEDLVVGVATGGCPHTAVREDPSMNISIIEEIEAGHPELDLVIIESGGDNITTTFSPALADYFIYMIDVAGGDKYPRKGGLGIESCDLLLINKTDLAGMVGADLGVMRADAERIRGERPFGFVNCMTDEGITEVAERIIHDALLGAPPGHPVG

SEQ ID NO: 26667 - protein, 101 aa, Zea mays
  misc_feature (10)..(10): Xaa can be any naturally occurring amino acid
  unsure (1)..(101): unsure at all Xaa locations
GSSPQDGYVXYHSARIDLCHASSSDNSKRGQVFTEMLNNCLDQIRAPTSETRVFMRCDVIFDQSAQGRNLNTMIGRAAHIEFLENDIYARFIMWSFPELFR

SEQ ID NO: 26668 - protein, 347 aa, Zea mays
MGSLPAPASAEFAPRPQGRATVVASDLAPLFSAQRRHLDHFFDRLDMAQAAAFAQALLDAPGAVFFTGVGKSGIVARKTAQTLASLGLARAGFLAPVDALHGDIGALFPGDVLVLLSKSGASDELLALAPCARAKGAYLVSLTSAASGDDCPLAAACDLNVHLPLQGEVCPFGLAPVTSTAIQMVFGDTVIAAIMEARRLSRDQYASNHPAGKIGKTLIFKVKDVMKKQNELPLCKEGDMIMDQLTELTSKGCGCLLVVDEEHHLIGTFTDGDLRRTLKASGPAIFSLTVGEMCNRNPRTITAEAMAVEAMEKMEAPPSPVQFLPVVNENNVVCGIITLHGLVSAGL

SEQ ID NO: 26669 - protein, 431 aa, Erwinia carotovora subsp. atroseptica SCRI1043
MSKIVKVIGREIIDSRGNPTVEAEVHLEGGFVGLAAAPSGASTGSREALELRDGDKSRFLGKGVTKAVAAVNGPIAQAVLGKDAKDQANIDKIMIDLDGTENKSQFGANAILAVSLAAAKAAAASKGLPLYAHIAELNGTPGKYSMPLPMMNIINGGEHADNNVDIQEFMIQPVGAKTLKEAIRMGSEVFHTLAKVLKSKGMGTAVGDEGGYAPNLGSNAEALAVIAEAVKAAGYELGKDITLAMDCAASEFYKDGKYVLAGEGNKSFTSEEFTHFLEDLTKQYPIVSIEDGLDESDWAGFAYQTKVLGDKIQLVGDDLFVTNTKILKEGIDKGIANSILIKFNQIGSLTETLAAIKMAKDAGYTAVISHRSGETEDATIADLAVGTAAGQIKTGSMSRSDRVAKYNQLIRIEEALGDSAPFNGLKEVKGQ

SEQ ID NO: 26670 - protein, 556 aa, Cryptococcus neoformans var. neoformans JEC21
MDGKPATQYQAWKKLQSLHGSKADKLVLKDLFKADPKRFSNLSKTFSSSSPNVSLLLDYSKNLVDDEVLSTLFDLAREAKVETFRDEMFAGKHINTSEDRSVLHIALRNPPADKGGFKISEAGVDEVHAVLAHMKEFSDSVRSGAWKGYTGKAIDTIVNIGIGGSDLGPVMVCEALKHYSKRDLKTHFVSNIDGTDMAEVLKACNRETTLFIVASKTFTTQETITNAESAKEWFLEQAKEKAHVAKHFVALSTNTKGVTEFGIAESNMFQFWDWVGGRYSLWSAIGLSICLSIGFDNFQELLNGAHEMDKHFKTAKLEDNLPVILALVGIWYNDFYGAQTQALLPYDQYLKKFADYFQQGDMESNGKSVTKDGSRVDYETGPIIWGQSGTNGQHAFYQLIHQGTKLIPCDFLAPVETLNPISGGKHHEILLSNFFAQPEALAFGKTEEEVIKELGPEQSKNSALVKSKIFEGNKPTNSIMFQKLTPGTLGALIALYEHKIHVQGAIWGINSYDQMGVELGKVLAKAILKQLGSENDVQGHDSSTTGLIHFYQKNRK

SEQ ID NO: 26671 - protein, 329 aa, Burkholderia thailandensis E264
MQVPLDVVTYGEAMAMFVAAEPGPLDCATQFMKRIAGADLNVAIGLARLGFRVGWVSRVGADSFGRYVLDTLARERVDASCVTVDARYPTGFQLKSRATGGADPAVEYFRKGSAASRLSLDDYAPDYVLGARHLHLTGVAPALSDSSRELAFHLAREMRAAGKTVSFDPNLRPTLWPSPEAMARALNALAEHADWVLPGLGEGRQLTGLDTPADIARFYLGQGARGVIVKLGAAGAYFRTADGREGTVAAERVEHVVDTVGAGDGFAVGAVSALLEGRAIDDAVARGNRIGALAIQVIGDSEGLPTRAALDRIENLSNARDRLEAPLAR

SEQ ID NO: 26672 - protein, 476 aa, Ralstonia eutropha JMP134
MQQRDKLFINGKWVSPHGTGLIDVIHSTTEAVMGRIPEGSARDAEDAIQAARAAFDGWAATPPAERAGYIRKIAEGLKARTEELAQLIAGEVGMPIKLARAIQVGGPVYNWGQAAKLLEGFDFEEEVGNSLVVREPVGVVAAITPWNYPLNQITLKVAPALAAGCTVVLKPSEVAPLNAFVLAEVIAEAGLPPGVLNLVTGYGPVVGEVLASHPEVDMVSFTGSTRAGKRVSELASQSVKRVALELGGKSASVILDDADLPAAVKGTINACFLNSGQTCSAHTRMLVPRSRYDEVKAIAAKVVEGFTVGDPLQETTRLGPLISAVQKDRVMGYIRRGLEEGAELVAGGPDAPAGLEKGFFVKPTVLGNVEPRATVAQEEIFGPVLSIICYNTEEDAVRIANDSIYGLGGGVWAGDEARAVRVARRIRTGQVDINGGPFNMSAPFGGYKQSGNGREAGKYGLEEFLEYKSLQFKKPA

SEQ ID NO: 26673 - protein, 420 aa, Bifidobacterium longum DJO10A
MPTAKPASLSAEALNIPRSGIRDVFDRVERVPDAISLTVGEPSATAAPHIVAAACEAAQAGRTRYTNVLGVPEYRKAVADYSARVKGLTYDPETEIQAVDGATIGLFLALKAVVGTGDEVIIPSPFFTSYDAEVMLCGGRPVTVALRPEHGMRVNAADIEAAITPRTRAVIINSPGNPTGAVTSAAELARIAEVCKQHNIWAISDEVYHPFVFGETFGETLGGEAAVAPSIAAVPGMKDRTIVVESLSKTYAMTGWRIGYLLAPEAVIEQTGKIAELMHSSVNSLAQYAGVAALAGPQDHVAAMREEYRAKRQIVLDGLAGCPVLRLIEPQGAFYAFVDVRLTGLDSGEFADRLLDEEHVAVVPGEAFGEEGRGFVRLSYAGDAGELREGVARLRAFAERVWNPITGHHTATYHPMEVLA

SEQ ID NO: 26674 - protein, 322 aa, Xanthomonas campestris pv. vesicatoria str. 85-10
MTASPSKLAQLRELSVVVADTGDYDAIKRLKPVDCTTNPTLVKKALDLPVYADLIERELAWGREHGGDDRTATVNEVADRLTIGVGVKLAELVPGRVSTEVDADLAHDTQATIAKARKFVAMYAERGVSKDKILIKIAATWEGIEAARQLQKEGIDCNLTLIFNRSQALACAEAGVFLISPFVGRILDYYVAQGQTPASIDEDPGVVFVRTVYNEFKQRGSSTVVMGASFRSTAQIEALAGCDRLTISPDLLEKLDAEHGELPRKLSPAKADNAQFTPIDSDSFASGLAADPMATEKLAGGIDTFAKDLHALRKTIADKLAG

SEQ ID NO: 26675 - protein, 369 aa, Arabidopsis thaliana
MESTKIAPSFDRASELKAFDETKTGVKGLVDSGISKIPRIFHHSSVELANPKPLPSDLLHLKTIPTIDLGGRDFQDAIKHKNAIEGIKEAAAKWGFFQVINHGVSLELLEKMKDGVRDFHEQPPEVRKDLYSRDFGRKFIYLSNFDLYTAAAANWRDTFYCYMAPDPPEPQDLPEICRDVMMEYSKQVMILGEFLFELLSEALGLNPNHLKDMECLKGLRMLCHYFPPCPEPDLTFGTSKHSDGSFLTVLLPDNIEGLQVCREGYWFDVPHVPGALIINIGDLLQLITNDKFISLKHRVLANRATRARVSVACFFHTHVKPNPRVYGPIKELVSEENPPKYRETTIRDYATYFNGKGLGGTSALLDFKV

SEQ ID NO: 26676 - protein, 391 aa, Brassica oleracea
MAMAAAAVIVPLGILFFISGLVVNLLQAVCYVLIRPLSKNTYRKINRVVAETLWLELVWIVDWWAGVKIQVFADDETFNRMGKEHALVVCNHRSDIDWLVGWILAQRSGCLGSALAVMKKSSKFLPVIGWSMWFSEYLFLERNWAKDESTLKSGLQRLNDFPRPFWLALFVEGTRFTEAKLKAAQEYAATSQLPVPRNVLIPRTKGFVSAVSNMRSFVPAIYDMTVAIPKTSPPPTMLRLFKGQPSVVHVHIKCHSMKDLPESEDEIAQWCRDQFVAKDALLDKHIAADTFPGQKEQNIDRPIKSLAVVVSWACLLTLGAMKFLHWSNLFSSLKGIALSALGLGIITLCMQILIRSSQSERSTPAKVAPAKPKDKHQSGSSSQTEVEEKQK

SEQ ID NO: 26677 - protein, 125 aa, marine gamma proteobacterium HTCC2080
MNGDQKLMSDTIFGKITRGEIPSEFLYEDEHCVVIQDIHPQAPTHVLIIPRKPIPRLVDAQQSDSELLGHLLLVAGKVANDLGVGEGFRLVINNGADGGQTVFHLHLHILAGRSMAEGELAGGLA

SEQ ID NO: 26678 - protein, 466 aa, Zymomonas mobilis
MADHFDLIVLGGGPGGYVAAIRAAQLNLKVALVERVHLGGICLNWGCIPTKSLLRSAEVYHEMQNAEAYGLTSFKPDFDLDKIIARSREVAARLASGVKTLLRKNKVEVISGVGQLTGNQQMRVETTEVEEKILEAKDIIIATGARARQLPNVHSDGKHIWTYHHALKPPAMPKKLLVIGSGAIGIEFASLYADFGAEVSIVEHAPQILPMEDAEVSAYVAKAFKKRGIRILTQSALQNLTPDDEGVTAEIAGADGKVTKERFSHAIVAIGVVANVENIGLDKLGIKLDRGFIAVDGFGRTNVDHVWAIGDVAGAPCLAHKASHQGVIAAEDIAGCDHVHPLNTQNIPACTYARPQVASVGLTEEKARQQGYNVKIGNFPFIANGKAIAQGATDGFVKTVFDADSGALLGAHMVGAEVTEMIHGYTVARTLETTEAEIMETIFPHPTLSEAMHESVLAAYGRALHF

SEQ ID NO: 26679 - protein, 575 aa, Escherichia coli
  misc_feature (1)..(1): Xaa can be any naturally occurring amino acid
  misc_feature (78)..(78): Xaa can be any naturally occurring amino acid
  misc_feature (98)..(98): Xaa can be any naturally occurring amino acid
  misc_feature (189)..(189): Xaa can be any naturally occurring amino acid
  misc_feature (193)..(193): Xaa can be any naturally occurring amino acid
  misc_feature (239)..(239): Xaa can be any naturally occurring amino acid
  misc_feature (302)..(302): Xaa can be any naturally occurring amino acid
  misc_feature (334)..(334): Xaa can be any naturally occurring amino acid
  misc_feature (345)..(345): Xaa can be any naturally occurring amino acid
  misc_feature (364)..(364): Xaa can be any naturally occurring amino acid
  misc_feature (389)..(389): Xaa can be any naturally occurring amino acid
  misc_feature (392)..(392): Xaa can be any naturally occurring amino acid
  misc_feature (429)..(429): Xaa can be any naturally occurring amino acid
  misc_feature (469)..(469): Xaa can be any naturally occurring amino acid
  misc_feature (477)..(477): Xaa can be any naturally occurring amino acid
  misc_feature (501)..(501): Xaa can be any naturally occurring amino acid
  misc_feature (518)..(518): Xaa can be any naturally occurring amino acid
  misc_feature (525)..(525): Xaa can be any naturally occurring amino acid
  misc_feature (562)..(562): Xaa can be any naturally occurring amino acid
  unsure (1)..(575): unsure at all Xaa locations
XISGILASPGIAFGKALLLKEDEIVIDRKKISADQVDQEVERFLSGRAKASAQLETIKTKAGETFGEEKEAIFEGHIXLLEDEELEQEIIALIKDKHXTADAAAHEVIEGQASALEELDDEYLKERAADVRDIGKRLLRNILGLKIIDLSAIQDEVILVAADLTPSETAQLNLKKVLGFITDAGGRTSXTSIXARSLELPAIVGTGSVTSQVKNDDYLILDAVNNQVYVNPTNEVIDKXRAVQEQVASEKAELAKLKDLPAITLDGHQVEVCANIGTVRDVEGAERNGAEGVGLYRTEFLFXDRDALPTEEEQFAAYKAVAEACGSQAVIVRTXDIGGDKELPYXNFPKEENPFLGWRAIRIAXDRREILRDQLRAILRASAFGKLRIXFPXIISVEEVRALRKEIEIYKQELRDEGKAFDESIEIGVXVETPAAATIARHLAKEVDFFSIGTNDLTQYTLAVDRGNDXISHLYQPXSPSVLNLIKQVIDASHAEGKWTGXCGELAGDERATLLLLGXGLDEFSXSAISIPRIKKIIRNTNFEDAKVLAEQALAQPTTDELXTLVNKFIEEKTIC

SEQ ID NO: 26680 - protein, 178 aa, Archaeoglobus fulgidus DSM 4304
MKKFSRKTEETEVEVVLGEELKVDTGIAFLDHMLKTLSRHSGIKLRVKAKGDLEHHVIEDVAIALGKALAGVDKKGLERFGDAIVPMDDAVAICGLDFSGRGVLVVEGTFGDGEMREEDFLHFLDTLCRNAGLNVYLSVKGSNSHHKMEAAVKAVAISLKKALTKNGNDYRSAKGVLD

SEQ ID NO: 26681 - protein, 765 aa, Oryza sativa (indica cultivar-group)
MATRVKPPPPPPSRPVVAKSPPRRQPHPPPPPPLPRHALHRQHEREGEATKSVWSVGFINARLSQRTPVLGLRLWVLVAAAAAAAVVLALLIVVCLCRRCRRRRCSRLAPAPPHHGRSNRSLKQQQSMASDKDIEEAARWPPPPSFQPPIEVIKAEQTAPLIMVEAARTSGETATSSGGSTRGWSTESGGSDAAEPEASRRGWGRRYTRRELEEATNRFAAENVLGEGGYGVVYKGILRDNTAVAIKNLHNNRGQAEKDFKVEVATIGRVRHKNLVSLLGYCSEGACRLLVYEYMENSNLDKWLHHGDDEISPLTWDMRMHILLGTARGLAYLHEGLEPKIVHRDVKSSNILLDRHWNARVSDFGLAKLLCSERSYVTTRVMGTFGYVAPEYARTGMLNERSDVYSFGVLIMEIISGRTPVDYTRPAPEVNLVEWLKRMVAERRVEEVVDPRLPETPPPKVLKRAILAALRCVDPDGGQRPTMGHVVHMLEDDLKFRDELQLARDLSPHASDSYEYELRYTAVMVASFSFVYVINLTRNHHPPAMAALLHQTPLQPPQTTTRPHPWTHTSTTNLSPPHVALPQRRRAPLRRLQAAGSGGAIGSSAVTDTESTTTAKSPSKKKSRKEKQRMRRQEKEQEQRQMVLEALDVKSGGEVDEDDDELPQPVFDRILRRIMFMVGVPMASGVGLLNLYGALERGRGVAVPSWLPLLTILVAFGTSALGIAFGTLSASWDPEKEGSLLGLEEARANWPVLWEEEIEKAKKKK

SEQ ID NO: 26682 - protein, 268 aa, Triticum aestivum
MADTLDMSLDDIITKNKHHHRRGRHNPASAASGGSAHPRRRFRSRAATRAVAAPYHQLSLPQQVPPAFGYVAQPMAMVTAPSALDSPTKLYISNLDYNVSNEDIKELFSEMGEIQRYSINYDKSGRSKGTAEVVFSARSSAVAALKKYNNVHLDGKPMKIEVIGTNIEAPAPIPAIFALAPPPGNFSFPSKSGPGMGVSGRGWSRGGGGFSGRSGGGFGGRGAGGFGGRGRGRTDRGRGKGGGGNLELSAADLDADLDKYHSAAMQIS

SEQ ID NO: 26683 - protein, 347 aa, Nocardioides sp. JS614
MTNAPRWTERLQIRVETLALRAAMGLPERVQRLLGGRAIVRDGQTLAADTQLMLRMQRLVREPGAETLPIPEGRAAIRRHAGMTGGRQRIGAVRDLTVADRPARLYTPTGAAASGPLLLFFHGGGFMYGDLGSHDASCRFLAERSGVRVLAVGYRLGPERPFPAAYDDALAAHGWLVDHASEVGADPARLAVGGDSAGGNLAAVVAIEAARAGLPLAFQLLVYPATDAVRETASAELFADGFYLTKAFMDLANTSYIGRTDPRDPRVSPLYAELPAGLAPAYVATAGFDPLRDEGEAYARRLSEAGATVELRRFTDQIHGFFNIVGAGRTSRAATAEIAAKLKSALH

SEQ ID NO: 26684 - protein, 539 aa, Ralstonia eutropha JMP134
MHDKILILDFGSQVTQLIARRVREAHVYCEIHPNDVSDEFVREYAPKGIILSGSHASTYEDHQLRAPQAVWDLGVPVLGICYGMQTMAVQLGGKVEWSDHREFGYAEVRAHGHTPLLKDIEDFSTAEGHGMLKVWMSHGDKVAALPPGFKLMASTPSCPIAGMADEARGYYAVQFHPEVTHTSKGREMIERFVLGICRAKADWVMKDHIEEAVALIRKQVGDEEVILGLSGGVDSSVAAALIHRAIGDQLTCVFVDHGLLRLDEGKMVMDMFAGRLHAKVVHIDASEQFLGHLAGVTDPEQKRKIIGREFVEVFQAEAKKLSNAKWLAQGTIYPDVVESGGTKTKKATTIKSHHNVGGLPETLGLKLLEPLRDLFKDEVRQLGVALGLPPEMVYRHPFPGPGLGVRILGEVKRDYADLLRRADAIFIEELRKTIATEQDAAAGLCEPQQVGKSWYDLTSQAFAVFLPVKSVGVMGDGRTYDYVVALRAVQTTDFMTAHWAHLPYSLLGRCSNRIINEVRGLNRVVYDVSGKPPATIEWE

SEQ ID NO: 26685 - protein, 1113 aa, Oryza sativa (indica cultivar-group)
MEIPAVESSAAGRMPPRIRRRLLEGSRVGGGAPTSAEEIEAKLKEAELRRQQFHEWVSCKARKKPRSPSWSSQEEDQGQRLEAKLQAAEQKRLSLLAKAQNRLAKLDELRQAAKNIVEMRIEKEREELGTRVESRVRQAEANRMRLLHAHMQKRAAMKERTARSLVRKQTSERKYTERVKSLILQKRNAAEKKRLALLEAEKRKAQARILHIQRAAKTVCSKRESERRQLQEQLESKLQKAKRQRAEYLKQRVSPRSSAHADYIKHAEFLSTKLARCWKRFLKSNKTTYALVQAYDALGINEMSVKSMPFENLAMLMESPTTLQTTKAVLDRFEKRLLLSQPTGSSSAENIDHLLKRLGSPKRKAPASRSRVAAKKPAKGSETSKLSRYSLRVVLCSYMILAHPGAVLSGQGEKENLLMESAENFVKEFELLVKTVLDRPGGASTQSTDAASQKKFRTQLAAFDKAWCAYLYHFVVWKLKDAKSLEQDLVRAACKLELSMMQTCKLSSDGQSHDLSHDMKAIQKQVTDDQKLLREKIQHLSGDAGIERMNSALSDTRSKFFEAKENGNPLATSVANVSTPLSINSSGQVPNPTSKPTVEGSSFTAQSLPGAASSSSSTSPMKPPTDNEQMVNEMLHEDDVSFARNSDNVSSAEKDFQAKVKATMEKAFWDLVTDSMRGDKPDNSQLINLVKEVRNSLHELASNELKEEILENIDLEILSQVLQSGSQDTRYLGQILQYSLDMVRKLSAPAKEDDMKRSHEKLLNELAASSEVNDNGISSFVIAVIKGLRFTLEEIKQLQTEVSKARIQLMQPIIKGSAGVEYLQKAFTDRYGPPANASVSLPITKQWVSATKSIVEQEWSSHLESLQALPADHAQHVVPVLRAGHGAPAPQASSSAASSSGLPECKGEKIDKLTRVGLLQLISNVEGLNMQSTPETFQINLLRLRAVQDQFQKVIVIATSMLVLRQVLMSKIAPPELQNTISELYDALVKLLDNNADASTREIVEAMTRSLASVGSLPEEQIQDTTELATKMLLKSLQAGDIVFGKVSRAVYFAFRGVVLGGGAKGKKLAEAPLRRLGTAKLADRVVKAGEVLIKMAVISEKVHGPWYKALAL

SEQ ID NO: 26686 - protein, 803 aa, Oryza sativa (indica cultivar-group)
MAVAAMELPAVRAYDALGINETSVKSMPFENLATLMQSPATLQATKAVLDRFEKLLPLLSSPVINIDHLLKHLGSPKKKKTPPPAAAASASRYSLRVVLCSYMILAHPGAVLSGQGEKEKLLMDSAGSFVKEFELLVKTVLEKQSTDAAAGQKMFSAQLADFDRAWCAYLYCFVVWKLKDAKSLEDDLVRAACKLERSMMQTCKLSSDGQSHNGLSHDMKAIQKQVADDQKLLREKVHQLSGDAGIERMNSALSDTRSKFFEAKENGNPLAASVANVSTPLSIGSSGSSFTAQSLPGAASSSSSSSLMKQPTDNEQMLNEMLHEDDVSFGGNSDNVSSAEEFQAKVKSTMEKAFWDLVTDSMKGDKPDYTQLINLVKEVRDSLHELASKELKEEILENIDLEILSQVLESGSQDTRYLGQIMHYSLDMIRKLSAPAKEDDMKKSHEKLLNELAASSEVNDNGISSFVIAVIKGLRFTLEEIKQLQSEVSKARIQLMQPIIKGSAGVEYLQKAFADRYGPPANASASLPITKQWVSATKSIVEQEWSSHLESLQALPADHAQRVVVPALRAGHGAPMAQASSSAASGSGLPECKGEKIDKLTRVGLLQLISNVEGLNMQSTPETFQINLPRLRAVQDQFQKVIVIATSILVLHQVLVSKVAAPELQNAISELYDALVKLLDSNPDASTEEIVEAMASSLATVGSLSLPEKQAQATAELATKMLLKSLQAGDVVFGKVSRAVYCAFRGVVLGGGGVKGKKLAEAPLRRLAAAKLADRVVKAGEVLVKMAAISEKVHGQWYKALAL

SEQ ID NO: 26687 - protein, 276 aa, Mycobacterium tuberculosis H37Rv
MSSFEGKVAVITGAGSGIGRALALNLSEKRAKLALSDVDTDGLAKTVRLAQALGAQVKSDRLDVAEREAVLAHADAVVAHFGTVHQVYNNAGIAYNGNVDKSEFKDIERIIDVDFWGVVNGTKAFLPHVIASGDGHIVNISSLFGLIAVPGQSAYNAAKFAVRGFTEALRQEMLVARHPVKVTCVHPGGIKTAVARNATVADGEDQQTFAEFFDRRLALHSPEMAAKTIVNGVAKGQARVVVGLEAKAVDVLARIMGSSYQRLVAAGVAKFFPWAK

SEQ ID NO: 26688 - protein, 503 aa, Mycobacterium tuberculosis H37Rv
MKNIGWMLRQRATVSPRLQAYVEPSTDVRMTYAQMNALANRCADVLTALGIAKGDRVALLMPNSVEFCCLFYGAAKLGAVAVPINTRLAAPEVSFILSDSGSKVVIYGAPSAPVIDAIRAQADPPGTVTDWIGADSLAERLRSAAADEPAVECGGDDNLFIMYTSGTTGHPKGVVHTHESVHSAASSWASTIDVRYRDRLLLPLPMFHVAALTTVIFSAMRGVTLISMPQFDATKVWSLIVEERVCIGGAVPAILNFMRQVPEFAELDAPDFRYFITGGAPMPEALIKIYAAKNIEVVQGYALTESCGGGTLLLSEDALRKAGSAGRATMFTDVAVRGDDGVIREHGEGEVVIKSDILLKEYWNRPEATRDAFDNGWFRTGDIGEIDDEGYLYIKDRLKDMIISGGENVYPAEIESVIIGVPGVSEVAVIGLPDEKWGEIAAAIVVADQNEVSEQQIVEYCGTRLARYKLPKKVIFAEAIPRNPTGKILKTVLREQYSATVPK

SEQ ID NO: 26689 - protein, 580 aa, Zea mays
EAAPSAAPPSSRGHRFRLCPRISLRHRFLRRGAATTEGDPVAVAFNTMVTPPTVEQEDEEMLVPRQEAVDTDAAQPMEVVAQTEVVSTAESQPVEDPQTSRFTWTIENFTRFSEKKHYLEVFVVGGFKWSVLIFPKGNNVDHFSMYLDVADSTSLPYGWSRYAQFSLAVVNQIQPEFTIRKETQHQFNARESDWGFTSFMPLSELYDASRGYLVNDTVVVEAEVAVRRMVDYWTYDSKKETGYVGLKNQGATCYMNSLLQTLYHIPYFRKAVYHMPTTENDIPSGSIPLALQSLFYKLQYSDSSVATKELTKSFGWDTYDSFMQHDVQELNRVLSEKLEDKMKGTVVEGTIEQLFEGHHINYIECINVEHKSNRKESFYDLQLDVKGCRDIYSSFDKYVEVERLEGDNKYHAENHGLQDAKKGVLFLDFPPVLQLQLKRFEYDYMRDSMVKINDRYEFPLQLDLDRDGGKYIAPNADRSTRNLYTLHRYKFDDERVTKEDAKKALEEQYGGDEELPQINPGFNNAPFKFTKYSNAYMLVYIRESAKEKIMCTVDEKDIAEHLRVRLKKKKKKKKKKKKKK

SEQ ID NO: 26690 - protein, 884 aa, Cenarchaeum symbiosum
MKNVYYFDEGDYKNRRLLGGKGAGLCEMTHLKLPVPPGFVITTEVCKSYYAKKGSLPGGFMAQVKKGIKRIERDTGKGWNSRDDPLLVSVRSGAAISMPGMMDTILNLGLNDTTVDALSRSSGDPRFAWDSYRRFVQLFGKVVFGVDDSKFDKILDGAKKDAGVSSDAALAEDSLRGVVKKYKEACRKHTGRSFPSDPDEQLELAIRAVFKSWMGERAIVYREKYGITPDVADGTAVNVVSMVYGNMGDDSATGVVFTRNPGDGTPGLYGDYLINAQGEDVVAGTRTPEPVASLRKTMPKSYAELERTCRRLEKHFREPQDIEFTIEKGRFYLLQTRAAKMNAVAMIKTSIDMVKEGLIGRERALVRLDAGQLEQLLHRRIDTEAAGSHERLTTGIAASPGAATGLAVFDVKKAAEMGEAGTSVILVREETKPEDVPAFFAAAGILTSRGGKTSHAAVVARGMGKPCVVGASDMKIDYSSGSCSAAGTAIKDGDEITIDGSSGHVFLGRVPTIEPSVTGGLRTILEWAGKAKKLGVRANADTPEAAKLARSFGAQGIGLCRTERMFNAADRIGLFVEMIMAGSAAERKGILDKLGRLQRSDFAKILRVMEGYPVTIRLLDPPLHEFLPNPEELAGRLREMKPGPEERRARTVLDRARELAETNPMMGHRGVRVGITYPEIYEMQIRAVFEAAAGLAAKGVDARPQIMVPQVGSLSELGAVRDIYDRIRAEMEKKHSRKLKINFGTMIEVVRAALTAAELAGPAEFFSFGTNDLTQATFSFSREDAEGKFLPEYMEKGLLDTSPFQSIDEDGVGRLMKMGAADGRGRRPGLEVGICGEHGGDPSSVRFCHGMGLSYVSASPHRIPIATVAAAQATIAGRAGARGR

SEQ ID NO: 26691 - protein, 126 aa, Pyrococcus horikoshii
MKEVIFTENAPKPIGPYSQAIKAGNFLFIAGQIPIDPKTGEIVKGDIKDQTRQVLENIKAILEAAGYSLNDVIKVTVYLKDMNDFAKMNEVYAEYFGESKPARVAVEVSRLPKDVLIEIEAIAYKE

SEQ ID NO: 26692 - protein, 365 aa, Glycine max
FVIMMGFWRGNWKNFTEPANPHNPSGFFPHGAAGVFKGAALVYLSYIGYDAVSTMAEEVRDPVKDIPVGVSGSVVVVTVLYCLMAASMTKLLPYDVINAEAPFSAAFSGRSDGWGWVSRVIGVGASFGILTSLLVAMLGQARYMCVIGRSNVVPSWFARVHPKTSTPVNASAFLGIFTAAIALFTDLDVLLNLVCIGTLFVFYMVANAVIYRRYVATGTTNPWPTLSFLCSFSITAIMFTLIWKFVPTGGAKAGMLSVSGVIAIAILQLFHCMVPQVRKPEFWGVPFMPWIPSISIFLNVFLLGSLDGPSYVRFGFFSAVAVLFYVFYSVHASFDAAGDGSLTAIKNGEIHVESKEIEDQISFKV

SEQ ID NO: 26693 - protein, 499 aa, Sinapis alba
EITCQENLPFTCGNTDALNSSSFSSDFIFGVASSAYQIEGTIGRGLNIWDGFTHRYPNKSGPDHGNGDTTCDSFSYWQKDIDVLDELNATGYRFSIAWSRIIPRGKRSRGVNEKGIDYYHGLISGLIKKGITPFVTLFHWDLPQTLQDEYEGFLDPQIIDDFKDYADLCFEEFGDSVKYWLTINQLYSVPTRGYGSALDAPGRCSPTVDPSCYAGNSSTEPYIVAHHQLLAHAKVVDLYRKNYTHQGGKIGPTMITRWFLPYNDTDRHSIAATERMKEFFLGWFMGPLTNGTYPQIMIDTVGERLPSFSPEESNLVKGSYDFLGLNYYFTQYAQPSPNPVNSTNHTAMMDAGAKLTYINASGHYIGPLFEKDKADSTDNIYYYPKGIYSVMDYFKNKYYNPLIYVTENGISTPGDENRNQSMLDYTRIDYLCSHLCFLNKVIKEKDVNVKGYLAWALGDNYEFNKGFTVRFGLSYIDWNNVTDRDLKKSGQWYQTFISP

SEQ ID NO: 26694 - protein, 605 aa, Legionella pneumophila str. Paris
MFGFISDLLTAAVSSLDELLQDTPAHQIILGTAALYFLYNQYHNPSISRWCRSRNNASMKQRIIDSAYALAKNLPGVNQIIEKELNKELSSTREKLRIQRSGMTLREEIPEEGLSPQDILSAFDVDVEKCHFDFLSVTNDSPEREFLVGRGDGKDSGALYAIHPKELTELLKEVYGATALTNPLHDKWPRINAMQAEVIRWCQNLFHGSKEGYGLLTHGGTTSIIEAMAAYVIRARAKGIDYPEIVVPETAHAAFKKAAELTGAILITVPVDKKTGAVNPNVMSSYITRNTAVMVGSAPSFMNGIHDPISELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIIRLRNAIQKELTALVEEGNGLTSEDIYVYGNPQWSILGFRSNTCNAHFIADELEKRGWKLNLLQNPDGFHLCLTHVHTLVGSFETQFIKDLREAVIDVKNYPPGKKPSGNVKVYGAVGMMPVELQKEICKQYQKARLDFTAASHGSLGIFAPSSTEEDDGLRNRKVGEQKVQTSL

SEQ ID NO: 26695 - protein, 177 aa, Zea mays
PTRPFFFFFAEKLKHFIIWNGVFDFREQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAEEEIKNAAAAEEETTNAAAAVDGS

SEQ ID NO: 26696 - protein, 420 aa, Rhodococcus sp. RHA1
MSIEAPRPLLPRRTPRKGSIRTVALLGPAFVAAIAYVDPGNVAANLTAGAKYGYLLVWVLVLANAMAVLVQYLSAKLGLVTGKSLPEMLGTRLRTGNRRAFWLQAEAMAVATDLAEVIGGAIALNLLFGVPLFAGGLITGVVSMGILSIQSRRGQRTFEFVVMGLLTIITVGFLTGLAFTDVSGTDALAGLVPRFEGTETVLLAASMLGATVMPHAIYLHSALARDRHGNDLEGPRLARLLRVTKWDVVGALIVAGAVNIGMLLLAASALSGIPGTDSIDGAHAAIQSSLGPTVAVIFAVGLLASGLASTSIGCAAGSEIMYGLLSMRIPLLLRRVVTLIPALVVLAVGVDPTFALVLSQVVLSLCIPFAVIPLVRMTSSHDLMGVHRNATATTVAAWVAASLIVVLNVSLLWLTFTGSA

SEQ ID NO: 26697 - protein, 413 aa, Glycine max
MECNDQRVSVSLKRKSPENGDHVLFNTFSLDDLNEDLFERILSWLQTSTFFRLNSVCKRWKSVAASASFKLACSHIPSREPWFLMVAPNLNQSVIFDSAESTWKRLNHPSLLQEESNQDCMPVAASGGLICYRKSSGNFIVTNPVTGSCRELPPLQLASQNQPLDAIVMSTSSKDQISFKIVLVFGELPNLLFKVYNSGSNCWEGETALRRKTEDNSMEYDSTDDNVVYFLSKAGIVVASNMQRSPSKQFSSVITNKNDQEIVYFLSYSGNVVACNLTCKCFSEYPRLLPVYNEYSIDVVECNGEMLVVLLSEFLETTTLRVWKYDEANRGWHQIAAMPAANSHEWYGKKADINCVGAGNQIFICLNSTELCTYVMCDLETNKWVELPNCCINGQVIDFMSAFSFEPRIEASV

SEQ ID NO: 26698 - protein, 353 aa, Oryza sativa (indica cultivar-group)
MKEVVLHVYDVTNSDSEKTNNTILQINRIFKDRIGLGGIFHSAVQVRLRAASQIPLVRGAFAFASPSPSFLLQISLILVGAQVYGEEEWSFGFCENGSGVFSCPIGKNPMYTYRECIVLGETECSIATVNRILRELSREWPGHSYDLLSRNCNHFCDVLCERLAVPKLPGWVNRFANAGDTAVVVAENTAVKGRFLFVDFVIVTIVHTFRQAKTEIVNASRVAYRFMAGLASKNQNPQPESPSNQSRNGPTFQGTWFKNIISNGAKPSSSESTSSHDTGTGGDESSLQNQKPSEQSTRICKFIPFTPCASDFYPCSRCPYYKGGGRRVGAKDVHAAPTTRAEAEEWGLRLYRY

SEQ ID NO: 26699 - protein, 258 aa, Brassica napus
MASLSSMQMVHTSQIGVKSQLVSSANRTSQSVCVGARSSGSALSSRLHYAASFPLKKQFPGAYATIKNQRTACVKSMAAEEEEVIEPQAKVTNKVFFDVEIGGEVAGRIEMGLFGDVVPKTVENFRVLCTGEKKYGYKGSSFHRIIKDFMIQGGDFTEGNGTGGISIYGAKFEDENFTLKHTGPGILSMANAGPNTNGSQFFICTVKTPWLDGKHVVFGQVIKGMKLVRTLESQETRAFDVPKKGCRIYACGELPLDA

SEQ ID NO: 26700 - protein, 171 aa, Vibrio cholerae O1 biovar eltor str. N16961
MAGSSIIVMGVCACGKSTIGELLAKQTGRKFIDGDDLHPRANIQKMASGQPLNDEDRKPWLERIRDAAYSLESKNEHGVIVCSALKKQYRDQIREGNQNVTFLFLDGSKELIMERMRARQGHFMKENMVNSQFETLERPDGEPQTLIIPIDCSVQEVVSCAIQALQEQEGL

SEQ ID NO: 26701 - protein, 89 aa, Monoraphidium braunii
  misc_feature (1)..(1): Xaa can be any naturally occurring amino acid
  unsure (1)..(89): unsure at all Xaa locations
XADLALGKAVFDGNCAACHAGGGNNVIPDHTLQKAAIEQFLDGGFNIEAIVYQIENGKGAMPAWDGRLDEDEIAGVAAYVYDQAAGNKW

SEQ ID NO: 26702 - protein, 570 aa, Oryza sativa (japonica cultivar-group)
MAASSRHGPFINWSDGLFLFLSSSSSRNRFLRVFLPFPDPSTMMAGLEVATTAVTGGDASLVVVVGVLFLMVAVVVMTRLGDGGAAPSPPAMPVLGHLHLIKKPLHRSLAEVAARVGAAPVVSLRLGARRALLVSTHAAAEECFTACDAAVAGRPRLLAGDVLGYGHTTVVWASHGDHWRALRRLLGVELFSNARLAALAADRRAEVASLVDAVLRDAAAGGGGGGTVTLRPRLFKLVLNVMLRAVTARRHAGDETRRFQEIVEETFAASGSPTVGDFFPALRWVDRLRGVVATLQSLQKRRDAFVAGLVDDHRRTRRAAAAAADKDQKKNGIIDALLTLQETDPDHYTDNVVKGIVLVLLTAGTDTSALTTEWAMAQLVAHPEAMTKVRAEIDANVGAARLVEEADMASLPYLQCVVKETLRLRPVGPVIPAHEAMEDCKVGGYHVRRGTMILVNAWAIHRDGDVWGSPEEFRPERFMDDGAGAGAVTAVTAPMLPFGLGRRRCPGEGLAVRLVGLTVAALVQCFDWEIGEGGAVDMAEGGGLTMPMATPLAAVCRPREFVKTVVSDCF

SEQ ID NO: 26703 - protein, 707 aa, Haloferax mediterranei
MPRNLRFLSVVNHVTKQVPTTCMRCAVGCGHVHLGSENAYGLETVRGDPSHPVNNGLACGRGIRESADPAGEWLTRPLVREDGELVQTSWSDAMARVGATIRTAVATDPDEVAVLGSGQQTNEAAYALGKLARAGIGTRNYDANTTLCMASAVTAYYRAFGSDAPPPTYDDIPNAETHLVWGANPAVAHPVMFRWIRQSRTDGRLVVVDPVETKTAAVADDHVSVAPGGDLALARAILRHIVDTDQIDESFVRSNTEGFDDVVSALPSVTDAAARAGVSLDTVEELAALLDAPTLIYWGMGVNQSVRGTATAGALVNLCLASGNLGPGTGPFSLTGQANSMGTRVCPRKNVSGHRPFEHPDHRRAVAEAWDVPVSRLPDDSGPGPVGILDSSPSVVWTVATNPLAGFPDATAAREVLRDSFLVVQDAFRSDTVELADVVLPAASWGESEGTPMNMERTVSRIRAATETPPGVRQDLDIIADVAARVAPGLLPRPPVSPSAIFDEFAALTEGTDADCSGISYTRLDGERAVRWPAPERNSDAGYRYYDPSTSRWRFPTPSGKARFSTLDGEPLPEPVDGDYPLTLTTGREADGYNTGVRSRSDTPEEPVARSTPRPSDTYHDAVADTDGELRTTVVSRRASVSVTLDRDDAVPPGLVWLSIHHPMTNQLTSPAVDPQSNEPNFKQCAVRFVHPDAPAKADFLAAEVSD

SEQ ID NO: 26704 - protein, 400 aa, Arabidopsis thaliana
MNSEENTDSIPIDLILDILSRLPSKSIARCRCVSKLWESMIRQSYFTELFLTRSSSRPHLLIAVEQEGEWKFFSLPQPKNYLGKSSLVVAANLHLKFFEDKRPQHGCSYASSLIYFPNMTIRKKGDDHLGVICNPSTGQYGYVILPPLLDFKSVPYGKFLGFDPIDKQFKVLIPIFDFDKHQTDHHILTLGAETVGWRKIQSPLRYLPHSNGTICINGILYYLAKINYAMDKNVLVCFDVRSENFVFLRLNTYCSSTKLVNYKGKLGMINQEYVDDGGFPLKLSVWVLEDVGKEEWSTYVYTLRDDNKVDQVKYNLSVVGVTASGEIVLVKKTQTLKPFYVLYFNPDKNTLLTVEVKGLHRGLYAVHRIYAFVDHVEDLEFNIMKTTYAAKSKFSQEDRF

SEQ ID NO: 26705 - protein, 301 aa, Oryza sativa (indica cultivar-group)
MSRRRKREVAPPPQAVVSSTAPFAVPTSQAAPYPYGGLGFRPPPTAWLASPQPQAMPGSSAFHPSAAGKTDVHPDLEEWTDKRLSWMKDEDLRLISAWLNNSNDPIESNIKKNDKYWGDVAAAYNSTTPKNRARLVKQVKDRFGKIRKKVGNFCCSWKEVNSLYSSGESNEDLMNKAQKIYENDFKDEDIPRPIGAKASKAQRSCKEKSKVQVCTTELEDDIRKFMDAHAATKEGQNEVLETQIRVSSDNHAAKKLSRQTAMIETYRDLMNKDTRKMPDDMRSELVHMLKCMREEIFNKNQ

SEQ ID NO: 26706 - protein, 178 aa, Zea mays
  misc_feature (26)..(26): Xaa can be any naturally occurring amino acid
  misc_feature (63)..(63): Xaa can be any naturally occurring amino acid
  misc_feature (72)..(72): Xaa can be any naturally occurring amino acid
  misc_feature (99)..(99): Xaa can be any naturally occurring amino acid
  misc_feature (130)..(130): Xaa can be any naturally occurring amino acid
  misc_feature (135)..(135): Xaa can be any naturally occurring amino acid
  misc_feature (140)..(141): Xaa can be any naturally occurring amino acid
  misc_feature (147)..(147): Xaa can be any naturally occurring amino acid
  misc_feature (159)..(159): Xaa can be any naturally occurring amino acid
  unsure (1)..(178): unsure at all Xaa locations
MATVSMFVRSLLSTTNLIQTSHPNRXGAAVVSFSRRHRRLSVCASVSKASTSLPPQPAAAAAXVPIHCFCGXADAYVYCEAVRMQHSMTVGEGIRLYLXRNAHIVRNFAALREALQGVGSSWRIARRSNXLLVLXVLREXXCGVVPXIGGELLSPYQGXLDPGWCIFTGQGKTLHILN

SEQ ID NO: 26707 - protein, 503 aa, Oryza sativa (japonica cultivar-group)
MEISQAFVFASLLLLLLLTWLLFHLLSYQAPPPNGDGGRRIPSPPALPVVGHLHLLKKPLHRSLAALAARYGGGAGLLLLRFGARPVVLVSSQAAADECFTAHDAALAGRPGLASRRLLTDGCPTIATAGPSARWPQLRRLATVHALCARRLAATSPACNPEARAMAPRLYSFLLVVVGGVDRRCRPLAEEDVLRFKAITEAGLAAAGAANRQDFLPFLRLLDFGRARRRLAGIAKERHDFGQRIVDEYRRRHRRRLAVAADDFSSSPPRRTVIGDLLRQQESSPESYADEVIRTVCLSLLQAGTDTSASTIEWAMALLLNNPDVLRKATDEINSVVGMSRLLQEPDLANLPYLRCIITETLRLYPLAPHLVPHEASRDCMVAGHVIARGTMVLVDVYSMQRDPRVWEDPDKFIPERFKGFKVDGSGWMMPFGMGRRKCPGEGLALRTVGMALGVMIQCFQWERVGKKKVDMSEGSGLTMPMAVPLMAMCLPRVEMESVLKSL

SEQ ID NO: 26708 - protein, 498 aa, Triticum aestivum
  misc_feature (161)..(161): Xaa can be any naturally occurring amino acid
  misc_feature (178)..(178): Xaa can be any naturally occurring amino acid
  unsure (1)..(498): unsure at all Xaa locations
MAGTGVFADVLDGEVYKYYADGEWRASASGKTVAIVNPTTRQTQYRVQACTQEEVNKVMDAAKVAQKSWARTPLWKRAELLHKAAAILKEHKTPIAECLVKEIAKPAKDAVSEVVRSGDLVSYTAEEGVRILGEGKLLVSDSFPGNERNKYCLSSKVPLGXVVLAIPPFNYPVNPGGXLRLGPALIAGNSLVLKPPTQGAVAALHMVHCFHLAGFPKGLISCVTGKGSEIGDFLTMHPGVNCISFTGGDTGIAISKKAGMVPLQMELGGKDACIVLEDADLDLVAANIVKGGFSYSGQRCTAVKVVLIMEAVADTVVEKVNAKLAKLKVGPPEDDSDITPVVTESSANFIEGLVMDAKEKGATFCQEYRREGNLIWPLLLDHVRPDMRIAWEEPFGPVLPVIRINSVEEGIHHCNASNFGLQGCVFTRDINKAIMISDAMESGTVQINSAPARGPDHFPFQGLKDSGIGSQGITNSINMMTKVKSTVINLPSPSYTMG

SEQ ID NO: 26709 - protein, 224 aa, Triticum aestivum
  misc_feature (199)..(199): Xaa can be any naturally occurring amino acid
  misc_feature (207)..(207): Xaa can be any naturally occurring amino acid
  unsure (1)..(224): unsure at all Xaa locations
MAALLARQAALALRARQTARLGPSATAMQGHLRTYMDAGAPKRFKEDEEKEQLAKELAKDWSAVFERSINTLFLTEMVRGLMLTLKYFFERKVTINYPFEKGPLSPRFRGEHALRRYDTGEERCIACKLCEAICPAQAITIEAEEREDGSRRTTRYDIDMTKCIYCGFCQEACPVDAIVEGPNFEFSTETHEELLSDKXEKLLQNGXRWETKIAENLKSEALYR

SEQ ID NO: 26710 - protein, 759 aa, Rhodococcus sp. RHA1
MSILGNEKAPPSGAPAPGPTLGERLRDNARYDLPASLVVFLVALPLSLGIAIASDAPIMAGLIAAIVGGVVAGSIGGSPLQVSGPAAGLTVVVAELVATFGWKATCAITVAAGFLQIIFGLSRIARAALAIAPVVVHAMLAGIGITIALQQIHVLLGGSSHSSTVENITQLPGQLTSARYSDVLVGSVVIAVLLFWKKIPGKLQVLPGPLVAVVAATVLSLVFPLDIDRITLDGSLFDAVALPSMPEGPWLAVATGVLTVALIASVESLLSAVAVDKMHGGTRSEFNRELVGQGSANMISGLIGGLPVTGVIVRSSTNVAAGARTRASAVLHGVWILVFAALLTGLVEQIPMAALAGLLIVIGIQLVKMAHLRTARRTGDLWVYGVTVAGVVFLNLLEGVIIGLALAVVLLLWRVIHPKMRAEPVGSEDSGRWRVTVEGSCSFLSMPALTGLLAKVPEGAHVTVELAVDFLDHAMFEAIDDWKRHHERNGGTVVIDALGPVDMDAVGVSPPRRGIGVVSPRGFAPWKSWQPRHSDTAESTTTPAALRPVLAGVSEYHRRNAAQLQPHLDELRDGQRPDSLFLTCSDSRIVPNVITSSGPGDLFTVRNVGNLVPTGKQDVSVEAGLAFALDELEVSSVIVCGHSGCGAMKAVLANAQPENDGSDRDAVEQWLTFAQPSRNAFLSGHPVARAAAELGFDEVDQLGMVNVAVQVQTLGRHPLVGAAAAEGRVRVAGMFFDIPSARVLEITSTGVSYLDHVPT

SEQ ID NO: 26711 - protein, 820 aa, Bacteroides thetaiotaomicron VPI-5482
MNISYNWLKEYVNFDLTPDETAAALTSIGLETGGVEEVQTIKGGLEGLVIGEVLTCEEHPNSDHLHITTVNLGDGEPVQIVCGAPNVAAGQKVVVATLGTKLYDGDECFTIKKSKIRGVESTGMICAEDEIGIGTDHAGIIVLPAEAVPGTLAKDYYNIKSDYVLEVDITPNRADACSHYGVARDLYAYLIQNGKQATLQRPSVDGFKVENHDLDIEVVVENSEACPHYAGVTVKGVTVKESPEWLQNKLRLIGVRPINNVVDITNYIVHAFGQPLHCFDAGKIKGNEVIVKTLPEGTPFVTLDEVERKLSERDLMICNKEEAMCIAGVFGGLDSGSTEATTDVFIESAYFHPTWVRKTARRHGLNTDASFRFERGIDPNGVIYCLKLAALMVKELAGGTISSEIKDVCVAVPQDFMVELSYEKVNSLIGKVIPVETIKSIVTSLEMKIMNETVDGLTLAVPPYRVDVQRDCDVIEDILRIYGYNNVEIPTTLNSSLTTKGEHDKSNKLQNLVAEQLVGCGFNEILNNSLTRAAYYDGLENYSSNHLVMLLNPLSADLNCMRQTLLFGGLESIAHNANRKNADLKFFEFGNCYYFDADKKNPEKVLATYSEDYHLGLWVTGKKVANSWAHPDENSSVYELKAYVENILKRLGLDLHNLVVGNLTDDIFATALSVHTKGGKRLASFGVVTKKLLKAFDIDNEVYYADLNWKELMKAIRSVKISYKEISKFPAVKRDLALLLDKNVQFAEIEKIAYDTEKKLLKEVELFDVYEGKNIEAGKKSYAVSFLLQDETQTLNDKMIDKIMSKLVKNLEDKLNAKLR

SEQ ID NO: 26712 - protein, 975 aa, Saccharomyces cerevisiae
MLSRLSLLSNSRAFQQARWRIYRLKVSPTVHASQYHILSGRKLAQSIREKANDEIQAIKLKHPNFKPTLKIIQVGARPDSSTYVRMKLKASKDSNVDCIIEKLPAEITEVELLKKISDINDDDSIHGLLIQLPLPRHLDETTITNAVDFKKDVDGFHRYNAGELAKKGGKPYFIPCTPYGCMKLLEEAHVKLDGKNAVVLGRSSIVGNPIASLLKNANATVTVCHSHTRNIAEVVSQADIVIAACGIPQYVKSDWIKEGAVVIDVGINYVPDISKKSGQKLVGDVDFDSVKEKTSYITPVPGGVGPMTVAMLVSNVLLAAKRQFVESEKLPVIKPLPLHLESPVPSDIDISRAQSPKHIKQVAEELGIHSHELELYGHYKAKISPNIFKRLESRENGKYVLVAGITPTPLGEGKSTTTMGLVQALSAHLGKPSIANVRQPSLGPTLGVKGGAAGGGYAQVIPMDEFNLHLTGDIHAISAANNLLAAAIDTRMFHEATQKNDSTFYKRLVPRKKGIRKFTPSMQRRLKRLDIEKEDPDALTPEEVKRFARLNINPDTITIRRVVDINDRMLRQITIGEAATEKGFTRTTGFDITVASELMAILALSKSLHEMKERIGRMVIGADYDNKPVTVEDIGCTGALTALLRDAIKPNLMQTLEGTPVMVHAGPFANISIGASSVIADLMALKLVGSEKNPLNDKNIHEPGYVVTEAGFDFAMGGERFFDIKCRSSGLVPDAVVLVATVRALKSHGGAPNVKPGQSLPKEYTEENIDFVAKGVSNLVKQIENIKTFGIPVVVAINRFETDSQAEIEVIKKAALNAGASHAVTSNHWMEGGKGAVELAHAVVDATKEPKNFNFLYDVNSSIEDKLTSIVQKMYGGAKIEVSPEAQKKIDTYKKQGFGNLPICIAKTQYSLSHDPSLKGVPRGFTFPIRDVRASIGAGYLYALAAEIQTIPGLSTYAGYMAVEVDDDGEIEGLF

SEQ ID NO: 26713 - protein, 586 aa, Haloferax mediterranei
MASKKEQWKSDLYGDAVRDELEAFAEEGFESIPEDERDKWFTRFKFWGVFQQRTGQESYFMMRLTNANGVLEPGQLRTIAEVARDYATGPVDNPEFGNGWVDLTTRQSIQLHWLELEDIPEIWEQLESVGVTSRSAGGDTMRNITGCPVAGKDTHELVESKPLLDRFQSELREDNALSNMPRKFNISVTGCREGCAQDSINDIGWNPPGKRSTERLFTGFNVRVGGGLGSRKPRVARSLDVFVADEERAYEVVRGFVELYHDHGNRDVRARARSRFFVDDWGTEKIRDRLESEYLDFELQSAGEDIRDEYTYNAGRPQSAGKSDHVGVHEQSDGRYYVGLSVAVGRLTAADALELADLADKYGSGQIRLTRRQNPIVMDVPAGALDDLLAEPLLSKHTPEPNPFQRGTVACTGTEFCSLALTETKARTARMLRWLRDNVEVPDDVHQLKIHYSGCTADCGQANTADIGLFGMRAQKDGEMVEAMDIGVGGGIGDEPSFVEWIHQRVPADEVPGAIASLVEAFAAHRTAGQTFRQWVEAEGPDAVAEYCEPIETDFEAPYMHDAKQSWYPFADEDEPPKTEQPMTSD

SEQ ID NO: 26714 - protein, 418 aa, Bacteroides thetaiotaomicron VPI-5482
MMKNIFQDLKRKDHKRYLGGLDVFKYIGPGLLVTVGFIDPGNWASNFAAGSEFGYSLLWVVTLSTIMLIVLQHNVAHLGIVTGLCLSEAATKYTPKWVSRPILGTAVLASISTSLAEILGGAIALEMLFDMPIMWGAVLTTLFVSIMLFTNSYKKIERSIIAFVSVIGLSFIYELFLVEIDWPAATMGWVTPAFPKGSMLIIMSVLGAVVMPHNLFLHSEVIQSHEYNKKDDASIKKVLKYELFDTLFSMIVGWAINSAMILLAAATFFKSGIQVEELQQAKSLLEPLLGSNAAIVFALALLMAGISSTITSGMAAGSIFAGIFGESYHIKDSHSQVGVILSLGIALLLIFFIGDPFKGLLISQMILSIQLPFTVFLQVGLTSSRKVMGNYVNSRWSTFVLYAIAVIVSVLNIMLLFS

SEQ ID NO: 26715 - protein, 636 aa, Gibberella zeae PH-1
MGDIIPQSIPRTSRAWAVPGSTNIIPAKFPSASPKPTSSDPQEIATSVVNAFNKALQSKDYPALSQLFTDDGFWRDHLALTWSFRTVQGPSNILSFLKTSSESKNGFRLAKIGLDTTSALRKPQAIPIDGKGEVQGIQFFFTIETVLGTGLGIARLAEVDGQWKIFTFYTRINDLKGHEETVNDHRPRGVEHGGMPGRKNWAQRRAETAEFKKDDPPVLIIGAGQAGLTAAARLKMLGVEALAIDQNDRVGDNWRKRYHQLVLHDPVWYDHMPYLQFPPQWPIFTPKDKLAQFFEAYATLLELNIWMKTSLIDTKWDEATKTWTVTVERKNDDGTTEKRTLHPRHIIQATGHSGKKNMPDMKGISDFKGDRLCHSSEFSGAKENSQGKKAIVVGSCNSGHDIAQDFLEKGYHVTMVQRSTTHVVSSKAITDIGLKGVYSEDGPPVDDADLLIHGLPIPVFKALSVETTKKQAECDKDLLDGLDRAGFKVDAGPDAAGLLMKYFQRGGGYYIDVGASQLIADGKIKVKHGQEIETVLPHGLRFADGTELEADEIVFATGYQNMRTQSRTMFGDAVADKVNDVWGFNEEGEMRTIWQKSGLPGFWFHGGNLAMCRYFSKLLALQIKGLEEGLYTYDDI

SEQ ID NO: 26716 - protein, 354 aa, Gordonia sp. TY-5
MSALMKTFTMLEVGKTAIVEKPIPTPGPNEALVKTTAALICTSDVHTVKGALPVENGRTLGHESVGVIAALGSAVTGFTEGQRVAVNAVTPCFECSYCQRGFTSQCGGLLGGYKYTAQVDGNMAEYFLVPAAQGNLAPIPDELSDDAAVYACDMLSTGLMGAEHAQIEIGDTVAIFAQGAVGLCATIGAKLRGAGRIIAVESRPERIALAQRFGADDIVDFTDGDPVAQIMDLTGGVGVDASIEALGFPQTFEAALACLKAGGTLSNIGYHGENPAPLPLDLTAWGLGMGDKTIRTGLCTGGSDRMSRLFTLMTTGKVDPTVMTTHRFGFDDVEEAFVMMAEKRDNIVKPLITF

SEQ ID NO: 26717 - protein, 410 aa, Pseudomonas putida GB-1
MTAPFTLLAEAVRQHGSPLWAYDTGTIAERVEQLKVFDTVRFAQKANPNLHVLRLMRAHGLVLDAVSLGEMERAFAAGASVGGDPAGVVLTCDALDRPTLERVVASKIEVNAGSIDMLRQLGERSPGHRVWIRINPGFGHGHSRKTNTGGENSKHGIWHEELDEALACIKAHGLHLVGVHMHIGSGVDYQHLEQVARSMIELIGRLGVDIEAFSIGGGLSTPYRKTDKPVDLQRYAQTWAVARKEIEAMLGHPVRMEIEPGRFLVAESGYLVAEVRAVKQVGRNTFVMIDAGFNDLMRPAMYGAYHGMTLLDANGQPVDRPRQPTVVAGPLCESGDVFTQDDQELTPQELPQAQVGDLLVIHDAGAYGASMSSSYNSRPLLPEFLIEDGALRMIRRRQTVQDLLDLEAGF

SEQ ID NO: 26718 - protein, 288 aa, Enterococcus faecalis V583
MKEITGATRLAGLFAKPSQHSISPLIHNTAFQNLGVDARYLAFDVGQETLPQAIEAIRTFHMLGANLSMPNKVAAVSYMDELSPTAQLVGAINTIVNKDGKLYGDSTDGTGFMWSLKEKKVDVFQNKMTILGTGGAALSIIAQAALDGVKEIAVYNRKSAGFNDSQKKLANFTERTNCVIHLNDLADTEKLAKDVAESVLLVNATSVGMHPHAHSSPIENYAMIQPKLFVYDAIYNPRETQLLKEARLRGAETSNGLDMLLYQGAAAFEQWTGQKMPVSVVKRKIENR

SEQ ID NO: 26719 - protein, 57 aa, Brassica napus
  misc_feature (47)..(47): Xaa can be any naturally occurring amino acid
  unsure (1)..(57): unsure at all Xaa locations
MAIARTGVYVDDYLEYASTFPAELQRLLNTVRELDERSQSLLNQTRXQPTKYCLGLA

SEQ ID NO: 26720 - protein, 873 aa, Clostridium symbiosum
AKWVYKFEEGNASMRNLLGGKGCNLAEMTILGMPIPQGFTVTTEACTEYYNSGKQITQEIQDQIFEAITWLEELNGKKFGDTEDPLLVSVRSAARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTANGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 26721 - protein, 117 aa, Prochlorococcus marinus str. MIT 9301
MKIFKFLFVIPLITLIIIFQTSLQNRYLMASDIRDGETIFRNVCAGCHVRGGSVVLKGSKSLKLSDLEKRGIADVNSITIIANEGIGFMKGYKNKLNDGEDKVLAQWIIQNAEKGWK

SEQ ID NO: 26722 - protein, 638 aa, Magnaporthe grisea 70-15
MARIRHRGLKPGGGQASMMSSVINLLNTIVGAGTLAMPSALSHMGITLGTAVIIWSGLASAFGLYLQSRCARYIDRGHSSFFALSQLTYPNAAVFFDAAIAIKCFGVGVSYLIIIGDLMPGVARGLVSDTGYGDGADVLPPYMLDRNFWITAFMLVIIPLGFLRRLDSLKYTSIIALVSIGYLIILVVYHFAAESHPNRGQVHYVTWEGPVSVLGAFPVVVFAYTCHQNMFSILNELKDGSPGSVVGVIGTSIGSAASIYILVAITGYLTFGNLVVGNIISMYPASIASTIGKAAIVVLVMFSVPLQIHPCRASLDAVLKWRPNRNNSAGGAHPDSTLIPPASSANDSHGSPTTPMSDLRFAILSTIIIVCSYATALTVSSLDRVLAYVGSTGSTAISFILPGLFYYKISDPNSIHHQRLTKDEDDAEDDNLDASTDEENGNLDPAGAGLLESVASLRSGMSAASRPRGTRWRRRLRWDLEHIEHGLLRKMALGLAIYGMCVMTVCLIMNTFFVHTKDLNADVVFSRTSSRLLDPVGISGLAGVSRYPSQGHGAATDVGSKTLDAGGSRDANLLHFRVGDDHPTSLKPARRPRRLLEAAECAAFVETGIRTPDTPPLRVQWFFFFLYWGRGSVRRQRR

SEQ ID NO: 26723 - protein, 497 aa, Glycine max
MAAGTGLFAEILDGDVYKYYADGEWKKSASGKSVAIINPTTRKTQYKVQACSQEEVNKVMDLAKSAQKLWAKTPLWKRAELLHKAAAILKEHKAPIAECLVKEIAKPAKDAVTEVVRSGDLVSYTAEEGVRILGEGKFLVSDSFPGNERTKYCLTSKIPLGVILAIPPFNYPVNLAVSKIAPALIAGNSIVLKPPTQGAVSALHMVHCFHLAGFPKGLINCVTGKGSEIGDFLTMHPGVNCISFTGGDTGIAISKKAGMIPLQMELGGKDACIVLEDADLDLVAANIIKGGFSYSGQRCTAVKVVLVMESAADALVEKVKAKVAKLTVGPPEDDCDITPVVSESSANFIEGLVLDAKEKGATFCQEYKREGNLIWPLLLDNVRPDMRIAWEEPFGPVLPVIRINSVEEGIHHCNASNFGLQGCVFTKDVNKAIMISDAMETGTVQINSAPARGPDHFPFQGIKDSGIGSQGITNSINMMTKVKTTVINLPSPSYTMG

SEQ ID NO: 26724 - protein, 380 aa, Burkholderia xenovorans LB400
MAKRDYYEVLGVAKNASDDEIKKAYRKLAMKHHPDRNPGNKDAEGHFKEVKEAYEMLSDSQKRAAYDQYGHAGVDPNMGGAGAQGFGGFADAFGDIFGDIFGQAAGGAARGGGGRAGPQVYRGADLRYSMEITLEQAAHGYDTQIRVPSWVSCEVCHGSGAKPGTKPETCPTCSGSGSVRMSQGFFSIQQTCPKCHGTGTYIPDPCGHCHGAGKVKETKTLEVKIPAGIDDGMRIRSAGNGEPGINGGPSGDLYVEIHIKQHSVFERDGDDLHCQMPIPFTTAALGGEIEVPTLAGRASFTVPEGTQSGKTFRLRGKGIKGLRSSIAGDLYVHVQVETPVKLTEPQRDLLKQFEKALVEGGSRHSPQSKSWFDRVKSFFD

SEQ ID NO: 26725 - protein, 374 aa, Zea mays
MAIPLVLVVLPLGLLFLLSGLIVNTIQAILFVTIRPFSKSLYRRINRFLAELLWLQLVWVVDWWAGVKVQLHADEETYRSMGKEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDDDVSKWCKDIFVAKDALLDKHLATGTFDEEIRPIGRPVKSLLVTLFWSCLLLFGAIEFFKWTQLLSTWRGVAFTAAGMALVTGVMHVFIMFSQAERSSSAKAARNRVKKE

SEQ ID NO: 26726 - protein, 72 aa, Glycine max
  misc_feature (50)..(50): Xaa can be any naturally occurring amino acid
  unsure (1)..(72): unsure at all Xaa locations
GAGVATAYGNGASTETKKSPFTVEVGMVQKHGGGRTMEDVNEERRRIAEXEVGACAIMCRERGTPRCPTLLF

SEQ ID NO: 26727 - protein, 252 aa, Listeria monocytogenes str. 4b F2365
MNKVVVKNVTFGEGAPKICVPMVGKTVAALKEEAEMLQTIDLDVVEWRVDFFEDVKDLAKVEAALDEIRTILPETPILFTFRSAKEGGELAVGDEFYFELNETLASTGKIDLVDVELFNEETDVLRLIETAHKNNVKVVMSNHDFDKTPAKEEIVSRLTRMEALGADLPKIAVMPKSAGDVLTLLDATNTVSEKANQPIITMSMAGTGVISRLAGEVFGSAMTFGAAKKASAPGQIDVNELRHVLDLLHKQF

SEQ ID NO: 26728 - protein, 441 aa, Synechococcus sp. WH 8102
MTQPQTKGLAPRRLAWEVLQAVAAGAYADVALERALREHPLAGADRGLATELAYGAIRRRRPLDAWLDRLGRIPASKQPPKLRWLLHVGLYQLLWMERIPASAAVNTTVDLAKAVGLARLAPVVNGMLRSALRARESGQLLDTPADWAAALALEHSLPDWLPPLLLQWRGAEGAAAVAAACNQVPSLDLRVNPLRASRAEVMAALESAGISSHPIDGCPQGLQVEGHKGDLRSWPGYDDGHWCVQDRAAQWVTPLLAAQPGDRILDACAAPGGKTTHLAELVNDQAEIWAVDRSAGRLKRVAANAARLGHGSIQALAADAEQLLKDRPEWRGRFQRILIDAPCSGLGTLARHPDARWRMTPSAIEGLLPLQRSLLEGLLPLLAETGTLVYATCTIHPAENTAQVRWLLELHPALKLLDETQRWPDAESGGDGFYAAVLQRR

SEQ ID NO: 26729 - protein, 880 aa, Arabidopsis thaliana
MICHVLVIFTILVSAVVDATASYEPTDVFLINCGDTSNNMDYSGRNWTTENPKFMSSNAVDDASFTSSASYQESGIPQVPYLKARIFRYDFTYSFPVSPGWKFLRLYFYPTRYGSDFDAVKSFFSVNVNRFTLLHNFSVKASIPESSSLIKEFIVPVNQTLDLTFTPSPNSLAFVNGIEIISMPDRFYSKGGFDDVVRNVGRDVDFEIDNSTAFETVYRVNVGGKVVGDVGDSGMFRRWLSDEGFLLGINSGAIPNITGVKINYTDKTPAYVAPEDVYTTCRLMGNKDSPELNLNFNLTWLFEVDAGFAYIVRLHFCETQPEVNKTGDRVFSIFFGYQLAMREMDVFRLSGGFRLPMYLDFKVLVDADGTSQRPSLRVDLTPYKEDYPTYYDAILSGVEILKLSNSDGNLAGLNPIPQLSPPPQSITPLKGKGKSSHVLPIIIAVVGSAVALAFFVLVVVLVVMKRKKKSNESSVDTTNKPSTNSSWGPLLHGTGSTNTKSASSLPSDLCRRFSIYEIKSATNDFEEKLIIGVGGFGSVYKGRIDGGATLVAVKRLEITSNQGAKEFDTELEMLSKLRHVHLVSLIGYCDDDNEMVLVYEYLPHGTLKDHLFRRDKASDPPLSWKRRLEICIGAARGLQYLHTGAKYTIIHRDIKTTNILLDENFVAKVSDFGLSRVGPTSASQTHVSTVVKGTFGYLDPEYYRRQILTEKSDVYSFGVVLLEVLCCRPIRMQSVPPEQADLIRWVKSNFNKRTVDQIIDSDLTADITSTSMEKFCEIAIRCVQDRGMERPPMNDVVWALEFALQLHETAKKKNDNVESLDLMPSGEVGTTTDGEDDLFSRTTGHVGKSTTTDDSVLVVGDERSGSSWGVFSEINEPKAR

SEQ ID NO: 26730 - protein, 319 aa, Geobacter metallireducens GS-15
MKKIGILTSGGDCSGMNAAIRAAVRTAIRLNIEVVGFRKGYLGLMKGDAIPLDTKAVSGILHRGGTFLQSARSPEFKTPEGQQKAIDNLKELGVEGLVVLGGDGSLTGALALHRLGLPVVGIPSSIDNDIPYTDMALGVDTALNNIIYAVDCIKDTASSHARAFVIEVMGRNSGYLASISAIATGAEFALVPEREYDLAEICQQLRARFEEGRDNAIIILAEGAGHAREISDSIKDAIGFETRITVLGHYQRGGAPTVFDRLLASRFGKRAVELLISGNSGVMVGLSCNAILATPLEDVIKGEKRPQDEVLRLAEVLGV

SEQ ID NO: 26731 - protein, 548 aa, Triticum aestivum
MPHRSLLARAHSEDDADAAMGDAVAGAVDYRGRPASRAATGGWKSSVFVMAMEIAERFAYKGVAANLITYLTGPLGQPMARAAASIDAWKGVSQMLPLPVACVADAWLGRYRAIVLASILFVVSMGTLSLSSAFHIFRSGGHVAVFYVALYLVALGEGAHKPCAQAFAADQFDEKDPKENVARSSFFNWWYFGMCAGTAVTTMVSSYVQDNVGWGLGFGIPCIVILVSLAVFLIGTPSYRYYTTKEPSPVARVGKALLVLIKSWRSKHRTNPASGKVEAHKNSDEDLVEEVSSVFRLLPIWASCIIYAIIFSQTSTFFTKQAATLDRRIGPNFKVPPAALQTFISVSIVAFIPVYDRLFVPLARRYTGRPTGITMLQRVGAGLSLSLVAVVLSALVEMKRLAVARDAGLLDAPKASHLPMTLWWMVPQYVLIGVSDVFAMIGLQEFFYDQVPDAVRSLGLALFLSIFGVGHLLSSFLISVIDRATARRGASWFSNNLNRAHLDYFYWLLAGLCVVELVAFFFFSRAYVYKKKSDDGDYRGGDADATLV

SEQ ID NO: 26732 - protein, 358 aa, Oryza sativa (indica cultivar-group)
MALIATGATATATAAPVASPAASSTASELMAQGRESAAVLEALLHGASLPPAHGGAHALAAEILRCCDRALAASRAGGDAESSSADTKRKPATAQPSTRRRRRYIYMYVSSRSCDGARDRAATQQEIFCRATASGGGAAAAAEPARVEKARTSEDGFLWRKYGQKEIKNSKHPRLYYRCSYKDDHGCTATKQVQQSEEDPSLYVITYFGDHTCSCQTAAAAAMDDDDDDENSQHFVINFGPATASRSGSPPLLYDDGDDGDVWRETAATPPSSRQSRCSPEGDGEESGVKMSKEEPVDSCPAPSAVSSPADVVSCSSPAMEPDLLGCLNWDDDFGDSSFVDADEFMNFDEIDLFQIYS

SEQ ID NO: 26733 - protein, 296 aa, Lyngbya aestuarii PCC 7419
NSRLCMSSAVSGYIQSFGTDGPPCCYDDLEQTDCAFLIGTNTAECHPIIFNRLRVYHKKNKSVKMIVVDPRCTQTAEAADLHLAIKPGTDIDLLNGIAHLLMKWGLFDSLFIDDCTQGFPEYAEIIRHYKPELVARKCGIRLDDLEKAARWWGESNRVLSLWSMGMNQSSEGTAKVRTLINLHLMTGNIGKPGAGPFSLTGQPNAMGGREAGGLAHILPGYRVVKNPQHRAEVEEFWGLKPGSISPHPGLAAWDMILGLEQNKVGLLWIAATNPAVSMPDLERTKAAYRKSPFTVY

SEQ ID NO: 26734 - protein, 536 aa, Nostoc sp. PCC 7120
MTDTVTTPKASLNKFEKFKAEKDGLAIKSEIEKIASLGWEAMDATDRDHRLKWVGVFFRPVTPGKFMMRMRMPNGILTSDQMRVLAEVVQRYGDDGNADITTRQNIQLRGIRIEDLPHIFNKFHAVGLTSVQSGMDNIRNITGDPIAGLDADELYDTRELVQQIQDMLTNKGEGNREFSNLPRKFNIAIAGGRDNSVHAEINDLAFVPAFKEGIGDWVLGNGEESSTYQKVFGFNVLVGGFFSAKRCEAAIPLNAWVTPEEVLPLCRAILEVYRDNGLRANRLKSRLMWLIDEWGIDKFRAEVEQRLGKSLLPAAPKDEIDWEKRDHIGVYKQKQEGLNYVGLHIPVGRLYAEDMFELARIADVYGSGEIRMTVEQNIIIPNITDSRLRTLLTDPLLERFSLDPGALTRSLVSCTGAQFCNFALIETKNRALEMIKGLEAELTFTRPVRIHWTGCPNSCGQPQVADIGLMGTKARKNGKAVEGVDIYMGGKVGKDAHLGSCVQKGIPCEDLHLVLRDLLITNFGAKPRQEALVTSQ

SEQ ID NO: 26735 - protein, 118 aa, Glycine max
  misc_feature (31)..(31): Xaa can be any naturally occurring amino acid
  unsure (1)..(118): unsure at all Xaa locations
ASTMASSSSESAVSERRGIPGTQFVEDVQTXLTQSGLDVGSALAFLQERLQQYKVVEMKLLAQQRDLQAKIPDIEKCLDVVATLKAKKGTGEVTIARVYNWDVHQRRVQQAVATTAQD

SEQ ID NO: 26736 - protein, 630 aa, Cryptococcus neoformans var. neoformans JEC21
MSIIPPSSPGSDHSFPTSSGDKPEKFQQVDHLEDVDVEDSRGQDIRNRHRNVSAKIQNPLYGLSKTKLFSMADQFSSDNGFEDKQDLFRRAALLSQRPNEAEDIPELTEEDKHWVRREKTNRWDQTRSLYFLVIVCSIGSAIQGWDNTGANGANLSFPTEFGIADNTWLVGMVNSAPSITVGAVSAMLTDPINYYIGRRGTIFVTGLFCVFPVLCQAFTRNWWELFICRILLGVGMGMKITTIPIMTAETAPASIRGALVMSFQLWVAFGIFFGFCSNLMFYQIGRIAWRVQLAAAFVPAVPLLALIWFVPESPRWLMKKMRYREAFASFCRLRKSEIQAARDMFYAHCQLEEEREAFKGTTYFSRFKDLFVQPRLRRANLASWVVMISQQLCGINIMSFYSSTIFSEAGYDTRQCLLASFGFGLVNTVFAFPAIWTIDTFGRRNLLLTTFPCMALMLFWAGSMFFMDESNSARVPILALAIYLFTAFYSPGMGPVPFVYAAEAQPLTHREIGMSWAVQQNNMWAAVLGLTFPSMLVAMKPWGAFYFYAGTNLLAWVLIFFFTPETAQRTLEELDYVFAVPVPVFAKYQATRWLPWVIKRYIFFRKGARLEPLYKLEGVATEGTVVERFH

SEQ ID NO: 26737 - protein, 296 aa, Gloeothece membranacea PCC 6501
NSRLCMSSAVAGYVQSFGSDGPPCRYDDLELTDCAFLIGTNTAECHPIVFNRLHKHIKKNRKAKLIVVDPRTTKTAEAADLHLAIKPGTDIDLLNGIAHLLMRWGKIDTYFIDECTQGFPEYAEVIRQHPPELVARKCNIRIDKLEEAAKYWAESERVLSLWSMGVNQSSEGTAKVRTIINLHLMTANIGKPGAGPFSLTGQPNAMGGREAGGLSHILPGYRLVKNPSHRTQLEQLWGLQPGQISPYPGRDCWSMITGLETGEVGLLWVAATNPAVSMPDLVRTKAALLKSPLTVY

SEQ ID NO: 26738 - protein, 376 aa, Sulfolobus solfataricus P2
MKDATRAVREDIDDLTGAITTPIYQTSAYHYPEGEKYRYSRESNPTVLELAKKIVELENAEMGIAFSSGMGAISTTALALLKPGNSVLVHRDMFGRSYRFFTDYLKNWGVNVEASYPGNNNIIEKAKSKRYDVIFVENITNPLLRVIDVAELSKVAKEQGSILIVDATFSTPINQKPLELGADIVVHSASKFLAGHNDVIAGLAAGYSKYLNVIDQMRRTLGTSLDPHAAYLTLRGIKTLKIRMDVINRNAEQIAEFLEGHPKVVKVYYPGLKSHVDYDIARKVLKGFGGVLSFEVNGGQESALKVMKSLKLIIPAQTLGGVNSVISHPATMSHRTLSLEERKIVGITDSLLRLSVGIEDVNDLIEDLDRALSTLY

SEQ ID NO: 26739 - protein, 311 aa, Ostreococcus tauri
MRRVFLLFLLHLLATLVTADRVHLPHDYRDERLDDDDDALQREESIDYFSSRRFHGVDAADGGSSGWIEKISDSPRAYVFREFLTDAECDRVIERAYPTMEASEVTDDDSGEARPDDARSSIGGWVSGDDDEVIRNIELRASTWAMLPMNRGETMQVLRYEKGQKYDAHDDFFHDEHNVKNGGQRVATILMYLSDVEEGGETVFPLGTPLGGRDPEKSGVTGDNACELASQNDPRVLAVKPRRGDALLFFNAHLSGEMDEKANHAGCPVNRGTKWTMTRWHRVGAIGVGTFASDPKATSDSEQPHAPAGEP

SEQ ID NO: 26740 - protein, 296 aa, Gloeothece membranacea PCC 6501
NSRLCMSSAVAGYVQSFGSDGPPCCYDDLELTDCAFLIGTNTAECHPIVFNRLHKHIKKNRKAKLIVVDPRTTKTAEAADLHLAIKPGTDIDLLNGIAHLLMRWGKIDTYFIDECTQGFPEYAEVIRQHPPELVARKCNIRIDKLEEAAKYWAEPERVLSLWSMGVNQSSEGTAKVRTIINLHLMTANIGKPGAGPFSLTGQPNAMGGREAGGLSHILPGYRLVKNPSHRTQLEQLWGLQPGQISPYPGRDCWSMITGLETGEVGLLWVAATNPAVSMPDLVRTKAALLKSPLTVY

SEQ ID NO: 26741 - protein, 746 aa, Nostoc sp. PCC 7120
MTESTKTLCPYCGVGCGLEVTPPAQLNKATNRDSQGNPTWRVRGDKAHPSSQGMVCVKGATIAESLDKNRLHYPMVRESLDQEFRRVSWDEAFDLITKRIQSVRFTQGAEAICMYGSGQFQTEDYYIAQKLMKGCLGSNNFDANSRLCMSSAVSGYIQSFGADGPPCCYEDLELTDCAFLIGTNTAECHPIVFNRLEKYHRKNHKVKMIVVDPRRTPTAEAADLHLAIKPGTDIDLLNGIAHLLMRWNMIDVGFIDDCTRNFSAYAEVIRHYSPEVVARQCGITIEDLETASRYWGESQRVLSLWSMGVNQSSEGTAKVRTIINLHLMTGQVGKPGAGPFSLTGQPNAMGGREAGGLAHLLPGYRLVKNPQHRAELEAFWGFQPGQISPHPGLTAWDMITGLEDGNVGLLWIAATNPAVSMPDLERTKKALLRSPFTIYQDAYHPTETTAYAHVLLPAAQWGEKTGIMTNSERRVTLCQAFRQPPREAKPDWEIFAEVGRRLGFEDKFAFTNSAQVYAEFTQLTKGRPCDMSGISHQQLQAQGPTQWPHSSINIETQKPTQHPTVNSQQSTVTSQQSKRLYTDLRFHTPDGRARFGAYYSKGLAEPPDPSYPFVLTTGRLYGHWHTQTRTGRIEKIRAMHPEPFIEIHPRDAAKLGITDNVVVEVRSRRGSAKFPAKVTKAISPGTVFVPMHWGKLWADDAEANALTHSESCPDSLQPELKACAVQLIPISVENTAQNYQLQSSQW

SEQ ID NO: 26742 - protein, 482 aa, Burkholderia thailandensis E264
MSFASLGLAEPLVRAVNELGYTQPTPIQAQAIPAVLGGGDLLAGAQTGTGKTAGFTLPILQRLHAFYAENRGARRAVRALILTPTRELAAQVEESVRAYSKYVKLRSTVMFGGVSINPQIDALKRGVDIVVATPGRLLDHMQQKTIDVSSLDILVLDEADRMLDMGFIHDIKRVLAKLPAKRQNLLFSATFSDEIKSLADSLLDSPALIEVARRNTTAETIAQKIHPVDRDRKRELLTHLIREHNWFQVLVFTRTKHGANRLAEQLTKDGISAMAIHGNKSQSARTRALSEFKNCTLQVLVATDIAARGIDIDQLPHVVNFDLPNVPEDYVHRIGRTGRAGANGEAVSLVCVDEKQLLRDIERLIKREISQEVIPGFEPDPNAKPEPIQRRGQRGGNGGGANGGNGGGSAGNAGRGNRAPRAASQPQAQQGQPAARRDGGTQAKAAKPQARGGGRPAGNGASNGGGAHANRNRSSRSGQRGR

SEQ ID NO: 26743 - protein, 906 aa, Bacteroides thetaiotaomicron VPI-5482
MDKKRVYTFGNGQAEGKADMKNLLGGKGANLAEMNLIGIPVPPGFTITTEVCTEYNTLGRDKVVELLKDEVVKAIARVEELMKSKFGDIENPLLVSVRSGARASMPGMMDTILNLGLNDEVVEGIIRKTGNARFAWDSYRRFVQMYGDVVLGMKPTNKEDIDPFEAIIEEVKESKGVKLDNELEVADLQELVKKFKAAVKEQTGKDFPTCAYEQLWGAICAVFDSWMNERAILYRKMEGIPDEWGTAVNVQAMVFGNMGDTSATGVCFSRDAGTGEDLFNGEYLINAQGEDVVAGIRTPQQITKVGSQRWAVLAGVTEDIRAAKFPSMEEAMPEIYKELDALQTKLENHYKDMQDMEFTVQEGKLWFLQTRNGKRTGAAMVKIAMDLLRQGMIDEKTALMRVEPNKLDELLHPVFDKSALKQAKVLTRGLPASPGAATGQIVFFADDAAEWHAAGKKVVMVRIETSPEDLAGMAVAEGILTARGGMTSHAAVVARGMGKCCVSGAGALNIDYKTRTVEIDGIVLKEGDYISLNGSTGEVYNGKVETQAAELSGDFADLMKLSDKYTRLQVRTNADTPHDAEVARNFGAVGIGLCRTEHMFFEGEKIKAMREMILAENAEGRRKALAKILPYQQADFKGIFKAMVGCPVTVRLLDPPLHEFVPHDTKGQQEMADTMGVSLQYIQQRVESLCEHNPMLGHRGCRLGNTYPEITQMQTRAILGAALELKKEGVETHPEIMVPLTGILYEFKEQEKVIREEAAKLFEEVGDSIDFKVGTMIEIPRAALTADRIASSAEFFSFGTNDLTQMTFGYSRDDIASFLPVYLEKKILKVDPFQVLDQNGVGQLVRMATEKGRAIRPDLKCGICGEHGGEPSSVKFCHRVGLNYVSCSPFRVPIARLAAAQAAIEG

SEQ ID NO: 26744 - protein, 271 aa, uncultured bacterium
NSRLCMSSAVAGYTRSLGSDGPPCCYDDLDHCSVAFLIGTNTAECHPVLFQRLLKRKKRNPGSVTIVVVDPRRTDTAKAADIHLPIAPGSDLALLHGTAHLVLRENGQDPAFIDDHTENYEAFFDVVARWTPRRVARFYNLPEKRLREVAQLFHRRENVLSLWSMGVNQRQEGTAVVCGLINLHLLTGQIGKEGAGPFSLTGQPNAMGGREAGGLSHLLPGYRLVTNDQHRQDVEQAWKFPAGSIAATPGLAAWQQIEAMERCEIDRWWVA

SEQ ID NO: 26745 - protein, 155 aa, Nostoc sp. PCC 7120
MQPMRKIIRQILGITKDENFMHAIEHIEVLVSKVLSIFMVVVILVAIADLAIFIIKEVFTTPYGSINTTLFKVFGLFLNILIALEILENITAYLKRHVFQVELVIVTSLIAVARKIIILDLEKVKGIDIIGLGVAILALSISYLIIRFSNSNNRH

SEQ ID NO: 26746 - protein, 200 aa, Listeria monocytogenes str. 4b F2365
MDKQAILDNIHQTWQEEANAISRLPEVTSEEALVKTVEKIAECTGKIVVAGCGTSGVAAKKLVHSFNCIERPAVFLTPSDAVHGTLGVLQKEDILILISKGGNTGELLNLIPACKTKGSTLIGVTENPDSVIAKEADIFFPVSVSKEPDPFNMLATASTMAVIASFDAVIVCLMTYMNYTKEQFSVIHPGGAVGNKLLNK

SEQ ID NO: 26747 - protein, 516 aa, Pisum sativum
MASMAAIGVLKVPPSSSSSSSSSSSSSKAIARNLSFTSSQLCGDKIFTVSGTRRSSGRNPFIVSPKAVSDSKNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLVLAGDHLYRMDYERFIQAHRESDADITVASLPMDEARATAFGLMKIDEEGRIVEFSEKPKGEQLKAMKVDTTILGLDDERAKEMPYIASMGIYVVSKHVMLDLLRDKFPGANDFGSEVIPGATELGLRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGGVPIGIGKNSHIKRAIIDKNARIGDDVKIINSDNVQEAARETEGYFIKSGIVTVIKDALIPSGTVI

SEQ ID NO: 26748 - protein, 507 aa, Pisum sativum
MSSIVTSSVINVPRSSSSSKNLSFSSSQLSGDKILTVSGKGAPRGRCTRKHVIVTPKAVSDSQNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLILAGDHLYRMDYEKFIQAHRESDADITVAALPMDEKRATAFGLMKIDEEGRIIEFAEKPKGEQLKAMKVDTTILGLDDERAKEMPFIASMGIYVISKNVMLDLLRDKFPGANDFGSEVIPGATSVGMRVQAYLYDGYWEDIGTIEAFYNANLGITKKPVPDFSFYDRSSPIYTQPRYLPPSKMLDADITDSVIGEGCVIKNCKIFHSVVGLRSCISEGAIIEDTLLMGADYYETEADKRFLAAKGSVPIGIGKNSHIKRAIVDKNARIGENVKIINSDNVQEAARETEGYFIKSGIVTIIKDALIPSGTVI

SEQ ID NO: 26749 - protein, 526 aa, Ehrlichia canis str. Jake
MSKVAIIDFGSQFTQLLARRIRELNVYCEIFTPDVEFDLVKDSKAFILSGGPKSVASLAEIPKIVHNIIELNKKSSIPVLGICYGLQLLSNYFNSAIVSDCSKEFGKATLNIIKESEITKNVWEVGKRVDVWMSHADSVYNVPRGFEVIAYSVLKNVIAMICNEERKIYGMQFHPEVYHTTDGIALLSNFIKIAGCKTDWTMNSFLDEQQRVIKKQVGDKKVIAAISGGVDSSVAAALTYRAIGDQLHCIFIDNGLLRYNEAEKISQLLVNQFQMPITIVDKSSVFLNKLKSITDPEQKRKIIGKTFIEVFEGEANKIGGVEFLMQGTIYPDVIESGGAVGKESVTIKSHHNVGGLPDVMRLQLVEPLKLLFKDEVRLLGKELGISDEILMRHPFPGPGLAIRIIGEVTQEKIKMLQAADDIYINLIKKYNLYNIIWQAFAVILPVKTVGVMGDSRTYGYTCALRAVTSSDGMTAGCFPFGVDTDTKLIFYEFLQEVSNAIVNNVDGINRVVYDTTSKPPATIEWE

SEQ ID NO: 26750 - protein, 109 aa, Bifidobacterium longum DJO10A
MKPAEEIPAFRPGDTVDVNVKIQEGNNSRIQTFTGVVIARKGAGVRETFVVRKISFGTGVERRFPVHSPSIDSIKLVRKGRVRRAKLYYLRALRGKAARIAERRDNSAK

SEQ ID NO: 26751 - protein, 416 aa, Ehrlichia canis str. Jake
MVKEAVLELDGQKVKLPVLCDTNGNKVIDITSLYKGTGILTYDPGFMSTAACESKITFIDGNKGILCYRGYNIADLVNNNKSFIEIVYLLFYGSFPSVDNLKDFMLQISQEYMPPEMVCDVIKSFSQDSHPMTILMACFSALASYYHDQAVDKDGLKHPKLAVAKVASIIAMIYRYTTNQDFIEPNHGLSYSENFIHMMFDISSYKFTQVVAKALDVIFTLHADHEQNASTATVRLAGSSGADLFACLVAGIATLWGPAHGGANEAVINMLMAIEKPSNVKQFIQKVKDGNKSTRLMGFGHRVYKNYDPRAKIICEICKEVLNDLGVNDPLLEIALELENIALQDSYFIERSLYPNVDFYSGIILKAIGIPVRMFTTLFALARTSGWSAQWYEMVADKNYKICRPRQLYTGHIAKI

SEQ ID NO: 26752 - protein, 286 aa, Alkaliphilus metalliredigenes QYMF
YGILQEEVRATKDALIIGDKTIQFTAHRDPAQIPWKEMGVEIVVESTGIFLTKEAASKHFEGGAKKVILSAPAKSGEDLTIVMGVNHDQYDPKKHHILSNASCTTNCLAPVAKVLEDSFGIESGMMTTVHAYTNDQRILDLPHKDPRRARAAAESIIPTTTGAAKAVAKVIPSLEGKLNGMAMRVPIPVVSVVDLVAELKTKTTAEEVNQKLREAAVGKMEGILGYNEEPLVSIDYKKDPRSSIVDALSTMMVGDKMVKVVSWYDNEWGYSNRIVDLAGYIAEKGL

SEQ ID NO: 26753 - protein, 564 aa, Triticum aestivum
AHYRANGTAPPSRSFDSFFFFFRRKTGGYIEGDIRIGGYPKVQETFVRILGYCEQVDIHSPQLTVEESVTYSAWLRLPSHVDEQTRSKKLTIFFFAGRIWEADGPPHRMEMATAACQTGTARSQGVRSRPPPRSRASPSEPDGEGKRRRRWEGRALRGHEIGKTRFMFSNKIVLKSRLVPVRNSRDIVDPRVRRTIYRGPIRERSCKVIQYFERIAGVPKIKSNCNPPTWMMDVTSTSMEVQHNMDFAILYEESSLHIEAEDLVEQLSIPLPNSENLCFSHNVTQNGWIQLKACLWKQDITYWRSPQYNLRRIMMTVISALIYGILVWKHAKVLNNEHDMLSVFGAMYLGFTPIGAYNDQTIIPFSTTERIVMYRERFAGMYSSWSYSFAQALVEIPYVFIQVVLYTLIVYRSTGYYWTAPKFLWFFYTTFCSILSYVYVGLLLVSITPNVQVATILASFFNTMQTLFSGFILPAPQIPKWWTWLYYLTPTSWALNALLTSQYGNIEKEVKAFGETKSVSIFLNDYFGFHQDKLSVVAAVLVAFPFVLIILFSLSIEKLNFQKR

SEQ ID NO: 26754 - protein, 510 aa, Pisum sativum
MASGCVSLKTNTHFPNSKKGSFFGERIKGSLKNSSWVTTQKKIKPASFSAILTSDDPKGSLNLQVPSFLRLRADPKNVISIVLGGGPGTHLYPLTKRAATPAVPVGGCYRLIDIPMSNCINSGINKIFVLTQFNSASLNRHIARTYFGNGVNFGDGFVEVLAATQTPGEAGKKWFQGTADAVRQFTWIFEDAKNINVENVLILAGDHLYRMDYMDLLQSHVDRNADITVSCAAVGDNRASDYGLVKVDDRGNIIQFSEKPKGADLKAMQVDTSRLGLSPQDALKSPYIASMGVYVFKKDVLLKLLKWRYPTSNDFGSEIIPSAIREHNVQAYFFGDYWEDIGTIKSFYDANLALTEESPKFEFYDPKTPIFTSPGFLPPTKIDNSRVVDAIISHGCFLRDCTIQHSIVGERSRLDYGVELQDTVMMGADYYQTESEIASLLAEGKVPIGIGRNTKIKNCIIDKNAKIGKEVVIANKEGVQEADRSEDGFYIRSGITIIMEKATIEDGTVI

SEQ ID NO: 26755 - protein, 414 aa, Thermobifida fusca YX
MTAPARTRRLVVVGASLAGLRVVEGARDAGFDGELTLIGDEPVAPYDRTVLSTRFLEDREEPQTPVYRPADDLRRDLDVDLRLGVAAHTLDPRSRTVHAGGHTIPYDALVIATGVRPRTPGWAVNLAGVHLLRTVADARALRKSLARSRRVVVVGGGFIGSEVASSARTLGLHVTIVEARDVPFAAALGETAGRLCAALHRAHGTELRCGVTVTALDGTGRVEKVLLSDGSVLKADTVVVGVGSHPNTEWLKGSGVACTDGVECDAALRTTVPGVYAVGDVARWFNPWLGRKVRVEHWTNAAHQAAAVARGIATGQPDTPHASIPYFWSDWYGRRIQFIGEPTADETAVVGDPARGEFACLYRTGERITGALTVGGKGAIARYRTAIRRRAAWQDVLHTALDRAKTVQTGGTRA

SEQ ID NO: 26756 - protein, 279 aa, Triticum aestivum
MRTHAHAHRVISPEREMAAGGMSREARWSLAGATALVTGGSKGIGHAIVEELAGHGARVHTCARSTAELEECRCRWEAKGLPVTVSVCDVSLRASREQLAETVKQVFDGKLDILVNNAAQAVAKAAVECTSEEYTHLMATNLESCFHLSQLTHPLLLGASIAGGGSIVNISSLGGTLGFPGLAIYSMTKGGINQLTRSLATEWAHNKIRVNCVAPGATKSDMLNSVPPEIKENELAKNPMRRAGEPEEVAAVVSFLCMPAASFVTGQVITVDGGRTISA

SEQ ID NO: 26757 - protein, 295 aa, Pseudomonas putida GB-1
MSTSVIRGVIGYTITPFTADGTLDLDALGMSIDSLIAGGVHAIAPLGSTGEGAYLSDSEWETVVRFSQARIAGRVPSVVSVSDLTTARTVQRARLAQACGATAVMVLPISYWKLTEAEVIAHYKAVGAAIDIPIMLYNNPGTSGTDLSVELILRILGEVPNVTMVKESTGDIQRMHRLFKATDGQVAFYNGCNPLTLEALVAGATGWCTAAPNLIPALNLALWDAVQHGELAEARTLFYRQYELLEYITRRGLPTTIKAGLKMLGQDVGAPRLPLQPLDGQGSTYLKSLLVALAN

SEQ ID NO: 26758 - protein, 506 aa, Marinobacter sp. ELB17
MIYAQPGKEGSVVSFKARYENYIGGEWVAPVKGQYFDNITPITGNVICEIPRSTAEDIELALDAAHKAAPAWGQTSVQERSRILLKIADRIEENLELLAVAETWDNGKAVRETLNADIPLAADHFRYFAGCIRAQEGHMGEIDHNTVAYHFHEPLGVVGQIIPWNFPILMAAWKLGPCLAAGNCTVLKPAEQTPASILILMELIGDLLPPGVLNVVNGYGIEAGQALATSKRIAKIAFTGSTPVGTHVLKCAAENLIPSTVELGGKSPNIYFADVMKAEPAFIDKCIEGLVLAFFNQGEVCTCPSRALVQEDMYDEFMEKVIARTKAIKRGNPLDTDVQVGAQASKEQFDKILSYLEIGKQEGAEVLTGGGREHLEGEFANGFYIQPTLFKGDNKMRVFQEEIFGPVVGVTTFKTEEEALAIANDTEFGLGAGVWSRDTHVAYRMGRNIKAGRVWMNCFHAYPAHAAFGGYKKSGIGRETHKLALDHYQQTKCMLTSYDINPLGFF

SEQ ID NO: 26759 - protein, 410 aa, Arabidopsis thaliana
MLSSIKPSSSSFSTAISGSVRRSIPTKLKFSPLLIIKNCHNQSFNANVVSHQKPLHISSASNFKREVKVEAYEADRSRPLDINIELPDEQSAQKLKIGIYFATWWALNVVFNIYNKKVLNAFPYPWLTSTLSLACGSLMMLVSWATRIADAPKTDLEFWKTLFPVAVAHTIGHVAATVSMSKVAVSFTHIIKSGEPAFSVLVSRFFMGETFPLPVYLSLLPIIGGCALAAITELNFNITGFMGAMISNLAFVFRNIFSKKGMKGKSVSGMNYYACLSMMSLVILTPFSIAVEGPQMWAAGWQNAVSQVGPNFVWWVVAQSVFYHLYNQVSYMSLDQISPLTFSIGNTMKRISVIVASIIIFHTPIQPVNALGAAIAIFGTFLYSQVNKQTYSCLPTSSTWFFSEQFLVLI

SEQ ID NO: 26760 - protein, 464 aa, Phaseolus vulgaris
MELSTILCLGASFLFIFLFRTLIKQFLSKRPHFPLPPGTMGWPYIGETFQMYSQDPNVFFASKIKRYGSMFKSHILGCPCVMISSPEAAKFVLNKAQLFKPTFPASKERMLGKQAIFFHQGEYHANLRRLVLRTFMPEAIKNIVPDIESIAQDSLKSWEGRLITTFLEMKTFTFNVALLSIFGKEEILYRDALKRCYYTLEQGYNSMPINVPGTLFHKAMKARKELAQIVAQIISSRRQRKQDYKDLLGSFMGEKAGLTDEQIADNVIGVIFAARDTTASVLTWIVKYLGENPSVLEAVTEEQECILKTKEESGEDKGLNWEDTKKMPITSRVIQETLRVASILSFTFREAVEDVEYQGYLIPKGWKVLPLFRNIHHSPDNFKEPEKFDPSRFEAAPKPNTFMPFGSGIHSCPGNELAKLEILVLLHHLTTKFRWSVVGAKNGIQYGPFSLPQNGLPITLYPKK

SEQ ID NO: 26761 - protein, 491 aa, Zea mays
VSLASCLLYKLFSSSNTSSEKARRRAPGPAPLPLVGNILELRGEPHHALARLAETHGPVMSLRLGTTDAIVVSSAAAARDVLQRYDNVLAARSVTDAGRALGNHERSVIWLPATSQLWKRLRAVCTNHLFSARGLEATRATREEAVRQLVSCLGRRTGETLEVGRVVFSCVLNLVSGALFGYLEAGLSSDRARELETLVRDTVEEATKPNLSDLFPVLARLDLQGRRRRSAEFIGRFYDFFDPIIARRVKARGSGEHVGDDFLDVLLQLHSMDQLSLQTVKSFLLDLFAAGTDTNTIAVEWTMAELLRHPAVMSKVRAELRDALGSKPCPDESDVGRLPYLRAVVMESMRLHPPSPMLVPHLAMADGAEVGGFTVPAGTKVIINLWAIMRDPASWAEPEAFVPERFVGASDADFRGTDRLEFMPFGAGRRACPGAPMATRVVTLLLASMLHAFEWRLPEGMKPCDVDVRDWFGTSLNMVTPLKAVPVPSSR

SEQ ID NO: 26762 - protein, 446 aa, Enterococcus faecalis V583
MKVVVVGCTHAGTSAVKSILANHPEAEVTVYERNDNISFLSCGIALYVGGVVKNAADLFYSNPEELASLGATVKMEHNVEEINVDDKTVTAKNLQTGATETVSYDKLVMTTGSWPIIPPIPGIDAENILLCKNYSQANVIIEKAKDAKRVVVVGGGYIGIELVEAFVESGKQVTLVDGLDRILNKYLDKPFTDVLEKELVDRGVNLALGENVQQFVADEQGKVAKVITPSQEFEADMVIMCVGFRPNTELLKDKVDMLPNGAIEVNEYMQTSNPDIFAAGDSAVVHYNPSQTKNYIPLATNAVRQGMLVGRNLTEQKLAYRGTQGTSGLYLFGWKIGSTGVTKESAKLNGLDVEATVFEDNYRPEFMPTTEKVLMELVYEKGTQRIVGGQLMSKYDITQSANTLSLAVQNKMTVEDLAISDFFFQPHFDRPWNYLNLLAQAALENM

SEQ ID NO: 26763 - protein, 229 aa, Zea mays
MTKSSGSHVMGVPVTSTAYAIEDATRDRPPAAAKKDGEDRLAVSLTHPSPYTSFGYKQGHVIHWMNKLGRRAQSFRDHVTLGPKLSETVRGKLSLGARILQAGGVERAFRRAFSAEKGERLVKALQCYLYTTGGPIAGMLLVSTRRIAFRSDRSLAVTSPAGDVLARVPYKAAVPLRRIKRVRPSESAETPEHKYVQVATVDGFEFWFMGFVSYQRCCKYMQQVVSDLQ

SEQ ID NO: 26764 - protein, 642 aa, Azoarcus sp. EbN1
MCGIAGLFDLRGKRDFSRDLVRRMNDVQVHRGPDEGGYHFEPGIALAHRRLSIIDLSTGQQPLFNEDGSVAVVFNGEIYNFQELVPELEALGHAFHTRSDTEVIVHAWEAWGEDCVQRFRGMFAFALWDRNRETLFLARDRLAVKPLFYALLPDGTFAFGSELKVLMQHPLLDRRIDAHAVEEYFALGYVAEPRTIFAGAKKLGAAETLCVRRGQPVPQPRCYWDVHFMLDNPLSLAEASAELTARLRESVRLRMIAEVPLGAFLSGGVDSSAVVATMAGLSDEPVHTCSIAFDDPAFNESDFAQKVADRYRTNHYVETVKSDDFDLIDTLAGLYDEPYADSSAIPTWRVCQLARKRVTVALSGDGGDESFGGYRRYRLHLMEERMRGALPLGVRQPMFGLLGRLYPKADWAPRMFRAKTTFQALARDSLQAYFHSVSILRDAMRRQLFSNRFRSELAGYNAIEVFRRHAATAHTDDALALIQYVDLKTYLVGDINTKVDRASMAHSLEVREPLMDHKLVEWLATLPSGLKVKGQEGKYLFKKAMEPLLPNDVLYRPKMGFSVPLSRWFRGPLRERVRQTVLGETLAATGIFNPDYLRHLVDAHQSGARDYSSPLWSLMMFEAFVRSSGGCPARAPELAAAV

SEQ ID NO: 26765 - protein, 169 aa, Saccharomyces cerevisiae
MSTPARRRLMRDFKRMKEDAPPGVSASPLPDNVMVWNAMIIGPADTPYEDGTFRLLLEFDEEYPNKPPHVKFLSEMFHPNVYANGEICLDILQNRWTPTYDVASILTSIQSLFNDPNPASPANVEAATLFKDHKSQYVKRVKETVEKSWEDDMDDDDDDDDDDDDDEAD

SEQ ID NO: 26766 - protein, 255 aa, Triticum aestivum
  misc_feature (143)..(143): Xaa can be any naturally occurring amino acid
  unsure (1)..(255): unsure at all Xaa locations
VRKAQYTPLKGTKVELPRVAPGLDLGIPGVQDLPGPLPWTSLWLNKWSYGCEPTRSASTLVIADAPDAEDPPGAGRQGQGQRHPGWAGAGPDSSPPEPRPTPTVQKLQSDGNPPPLSRPNQTPHRTRTRTAHRRPRRRREKKXEMEAAAAAAGVQLGTSKPQIATQAEMAEARLPIPYRDQCAHLLIPLNKCRVAEFYLPWKCEPERHSYEKCQYELVMERMLQMQKIREAQAGAKVKGSVTIGVPLAPSTAKLA

SEQ ID NO: 26767 - protein, 219 aa, uncultured bacterium
NSRLCMSSAVAGYTRSLGSDGPPCSYEDLDHCSVAFLIGTNTAECHPVLFQRLLKRKRKNPGSVKIIVVDPRRTDTAKAADIHLPIAPGSDLALLHGIAHLVLRENGQDPAFIDDRTENYDAFFDVAARWTPRRVARFCNIPEKRLREVAALFHRREKVLSLWSMGVNQRREGTAVVQGLINLHLLTGQIGNEGAGPFSLTGQPNAMGGREAGGLAHLL

SEQ ID NO: 26768 - protein, 219 aa, uncultured bacterium
NSRLCMSSAVAGYTRSLGSDGPPCSYEDLDHCTVAFLIGTNTAECHPVLFQRLLKRKRKNPGSVKIVVVDPRRTDTAKAADIHLPIAPGSDLALLHGIAHLVLRENGQDPAFIDDHTENYDAFFDVAARWTPRRVARFCNIPEKRLREVAALFHRREKVLSLWSMGVNQRREGTAVVQGLINLHLLTGQIGKQGAGPFSLTGQPNAMGGREAGGLAHLL

SEQ ID NO: 26769 - protein, 348 aa, Listeria monocytogenes str. 4b F2365
MKALKLYGKRDLRYEEADMPTIEQPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGAKRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 26770 - protein, 565 aa, Bacteroides thetaiotaomicron VPI-5482
MEQKIKFPRSQKVYLPGKLYPNIRVAMRKVEQVPSVSFEGEEKIATPNPEVYVYDTSGPFSDPSMSIDLKKGLPRLREEWIVGRGDVEQLPEITSEYGQMRRDDKSLDHLRFEHIALPYRAKKGEAITQMAYAKRGIITPEMEYVAIRENMNCEELGIETHITPEFVRKEIAEGHAVLPANINHPEAEPMIIGRNFLVKINTNIGNSATTSSIDEEVEKALWSCKWGGDTLMDLSTGENIHETREWIIRNCPVPVGTVPIYQALEKVNGVVEDLNWEIYRDTLIEQCEQGVDYFTIHAGIRRHNVHLADKRLCGIVSRGGSIMSKWCLVHDQESFLYEHFDDICDILAQYDVAVSLGDGLRPGSIHDANDEAQFAELDTMGELVLRAWEKNVQAFIEGPGHVPMHKIKENMERQIEKCHDAPFYTLGPLVTDIAPGYDHITSAIGAAQIGWLGTAMLCYVTPKEHLALPDKEDVRVGVITYKIAAHAADLAKGHPGAQVRDNALSKARYEFRWKDQFDLSLDPERAQGYFRAGHHIDGEYCTMCGPNFCAMRLSRDLKKNAKSDK

SEQ ID NO: 26771 - protein, 219 aa, uncultured bacterium
NSRLCMSSAVAGYTRSLGSDGPPSCYEDLDHCSVAFLIGTNTAECHPVLFQRLLKRKKRNPGSIKIVVVDPRRTDTAKAADIHLPIAPGSDLALLHGIAHLVLRENGQDPAFIDDHTENYHSFFDVAARWTPRRVARFCNIPEKRLRDVAQLFHRREQLLSLWSMGVNQRREGTAVVQGIINLHLLTGQIGKEGTGPFSLTGQPNAMGGREAGGLSHLL

SEQ ID NO: 26772 - protein, 278 aa, Zea mays
MTSPAPTSWFSGLSRSSSTMAGGVASASASASASGPASAFLPDAPKSVIGAGSGGGKRNHLCGALFKYGPKSAQVAFRTGDFNHQVIFIGGLTDGLLATDYLEPLSLALEVEKWSLVQPLLSSSYTGYGISSLQQDALELEQLISYLINKENSEGVILLGHSTGCQDIVHYMRTNFACSKAVSGVILQAPVSDREYRATLPETAEMIDLAAKLISEGRGMDLMPRKANSDAPITAYRYHSPLSYMGDDDMFSSDLSEDQLRQRLGHMSNTQWPVYFFM

SEQ ID NO: 26773 - protein, 419 aa, Myxococcus xanthus DK 1622
MNTSATEFDIIAWGATGFTGRLVAEYLARTQDSHRARWALAGRDLDKLEKVRQGLAAIAPSFAELPLLVADARDAASLDALVPRTRVVCTTVGPYARYGSELVAACVRAGVSYCDLTGEVQWMRRMIDAHHEQARQSGARIVHTCGFDSIPSDLGVLMMQEHMREHHGGHLEAVRLYMGPMRGGASGGTAASMVQAMEEASTDRSVRRIMAHPHALDPVPGRWRPESKDALGVHYSQELGQWTGPFLMATVNTRVVRRSNALLGHPWGEHFRYAEVASYGAGPKGLLRATGVTAGLGGVVAAMQVKPLRTLLEKKVLPAPGEGPSLEAREKGFFVAQLRGEGTSPRTGKQVRLKGKVAAQGDPGYAATSRMLAESALCLAFDDTPTTGGVLTPASAMGMRLVERLRRAGMTFEVEELST

SEQ ID NO: 26774 - protein, 1521 aa, Issatchenkia orientalis
METISVGKESDVSSDGNVAYGGFNEGTNKQIRDLAREFTRQTSVGDGVQDSDDATDSNEVEKFGVDHASPNSPPKSNQYDLLRTLTSMSQVPGVNPVDQTIDPRLDPNSDEFESKFWVKNMRKLLDSDPDYYRPTSLGFAAKNLIAKGISSDADYQANFLNYPFKVVRDTYMDLFRGNDESRYFEILKSMDVLIKPGTLTVVLGRPGAGCSTFLKTVAAQTYGFKVDDSSIISYDGLTPKEINKNYRGEVIFSAEMDNHFPHLSVGQTLEFAAKMRTPQNRFPGVSRNEYAKHMSEVYMATYGLSHTVNTKVGDNFIRGVSGGERKRVSIAEASLCGANLQCWDNATRGLDAATALEFVRALKTSAHILDTTPLIAIYQCSQDAYDLFDNVVLLYEGYQIYFGPGDRAKDFFERMGYECPDRQTTADFLTSITSPAERVAKKGWENKVPQTPKEFSDYWRASAEYKELVADIDEYLSHCHNNNTREEFAEAHAIKQANHARPSSSFRVSYWMQIKLIAQRNIWRTKGDPSIMMFSVIANIIMGLIISSLFYNLSATTGTFYYRSAAMFFAVLFNAFSSLLEVMSLFESRPIVEKHKMFALYHPSADAFASIFTELPAKIATSLGFNLMFYFMVNFRRNPGRFFFYLLMNFMATLVMSHIFRSIGSCFKTLSESMPPATVFLTAMVIYTGFALPTPSMHGWSRWINYLDPVAYVFEALMANEFDGRRFECSQFIPSYPNADLANQVCSVVASVPGFSYVNGTDYIYESYRYKITHKWRNFGIVVGFIIFFLFVYVTLVELNKGAMQKGEIILFQQSKLREMRKEKKSKQISDIEGGSEKPAGVYDHGNEDSEDGVNNLTVGSDIFHWRDVCYEVQIKDETRRILNHVDGWVKPGTLTALMGASGAGKTTLLDVLANRVTMGVVSGSMFVNGRLRDQSFQRSTGYVQQQDLHLQTSTVREALRFSAYLRQSRTISKKEKDEYVESIIDILEMRSYADAVVGVAGEGLNVEQRKRLTIGVELAAKPKLLLFLDEPTSGLDSQTAWSVCQLMRKLADHGQAILCTIHQPSALLLKEFDRLLFLAKGGRTVYFGDLGENCQTLINYFESHGAHPCPAEANPAEWMLEVIGAAPGSHANQDYHEVWMSSDERRAVQEELHRMETELLQIPVDDSAEAKRSFASSYLIQYICVTKRVLQQYYRTPQYIWSKLFLAGANSIFNGFSFYRAGTSLQGLQNQMLSIFMLSVMLNTLVQQMLPLYITQRSIYEVRERPSKTFSWWVFLAAQVTAEFPWNLICGTISYFCWYYPIGLQNNASVTHTTAERGALTWLLIVGFFNYASSLGLMCIAGVEQEQNGANISNLLFTMCLNFCGILKYPTGFWKFMYRANPFTFWIASVLGAGVGDTPLVCSSKEIVYFAPPKGETCTTYIQPYIDEAGGYLVDSEREGYCGFCTASNTNAYLKSVHVEYSKRWQNWGIFICFIAINNIFMFLFYWLARVPKKDNRVKDASALKSDEKATLGPQTTSEA

SEQ ID NO: 26775 - protein, 467 aa, Burkholderia thailandensis E264
MSLFRKKNVDRMIAGAHAAGLKKALGAVDLTFLGIGAIIGTGIFVLTGTGAVQAGPALMLSFVIAAIACGLAALSYAEFASTIPVAGSIYTYSYATLGELVAWIIGWDLMLEYGLAASAVSVGWSGYLQSLLQGFGVSLPAALTAAPGALPGVVTYFNLPAFLVMLVITTLLSIGIRESTRVNNIMVFIKVAVVLLVIAVGIFHVTPANWKPFMPHGWNGVFGAAAVMFFAFIGFDAVSSAAEEVKNPKRDLPVGIIASLGVCAFLYVAVAAIATGIVPWAQYANVSHPISYALQVAGEKWVAGFIDLGAVIGMLTVILVMSYGQTRIIFAMSRDGLLPAALSRVHPRFATPFLTTWLVGLFFGLIAALIPLNVLAELINIGTLAAFSMVSIAVLVLRRTHPDLPRAFRCPGVPFVPILAVAACLFLMLNLQPVTWIAFLTWLVIGLFVYFAYSRSRSKLAHGAQQH

SEQ ID NO: 26776 - protein, 131 aa, Synechococcus sp. WH 8102
MGDSAIEHPTELLDQRSHARALRSMRCLPFAAALYRELQQQGLDADSIWNNRSRFGRGPAWPRNGERLEDDLRWLITVGVLRREVDGQGLTSRFRLTPLGRDLLDGHQAELLLPAGWNDRLRQVLRRRWPF

SEQ ID NO: 26777 - protein, 310 aa, Oryza sativa (indica cultivar-group)
MVQWTRAEKRTFLRQRVEARLAALLLENQEYTEALTLLTGLIKEVRRLDDKLLLVDIDLLESKLHFSLRNLPKAKASLTAARTAANAIYVPPAQQGTIDLQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDTLLEQNLCRLIEPYSRVEIAHIAEMIELPVDHVEKKLSQMILDKKFAGTLDQGAGCLIIFEDPKTEAIFPATLETISNVGKVVDSLYMRSAKIMA

SEQ ID NO: 26778 - protein, 266 aa, Ralstonia eutropha JMP134
MNPTTHAGTALVTGASSGIGAIYADRLARRGYDLILVARSRDRLSALADRLTTETRRNVEVIGADLNDRDELAVVENRLREDESIALLVNNAGIGTHTPLLDSDVDRMTRLIELNVTALTRLTYAAAPRFVARGKGAIINIASIVAIAPEILNGVYGASKAFVLGLSQSLHHELSGKGVRVQAVLPGATATDFWATGGQPVENLDPSIVMSATALVDAALVGFDRGEFVTIPSLHDVAKWEAYAAARMAMMGELSTSTPAPRYLGV

SEQ ID NO: 26779 - protein, 547 aa, Cryptococcus neoformans var. grubii
MSAIIPQVQQLLGQVAQFIPPWFAALPTSVKVVIAVIGIPALVICLNVFQQLCLPRRKDLPPVVFHYIPWFGSAAYYGEDPYKFLFECRDKYGDLFTFVLMGRRVTVALGPKGNNLSLGGKISQVSAEEAYTHLTTPVFGKGVVYDCPNEMLMQQKKFIKSGLTTESLQSYPPMITSECEDFFTKEVGISPQKPSATLDLLKSMSELIILTASRTLQGKEVRESLNGQFAKYYEDLDGGFTPLNFMFPNLPLPSYKRRDEAQKAMSDFYLKIMENRRKGESDHEHDMIENLQSCKYRNGVPLSDRDIAHIMIALLMAGQHTSSATSSWTLLHLADRPDVVEALYQEQKQKLGNPDGTFRDYKYEDLKELPIMDSIIRETLRMHAPIHSIYRKVLSDIPVPPSLSAPSENGQYIIPKGHYIMAAPGVSQMDPRIWQDAKVWNPARWHDEKGFAAAAMAQYSKAEQVDYGFGSVSKGTESPYQPFGAGRHRCVGEQFAYTQLSTIFTYVVRNFTLKLAVPKFPETNYRTMIVQPNNPLVTFTLRNAEVK

SEQ ID NO: 26780 - protein, 476 aa, Ralstonia eutropha JMP134
MQRIDHMYINGEFVTPLGREWFDLHNPSTEEIIGQVRLGDEKDAQRAIAAAQAAFPAWSRTTREERIAALRRIHRAVAAREEELLEAIVTEYGAPSVRSRWMAEYPAQTVAQAIDALESFEFEERAGAARVVMTPVGVAGLITPWNSNAGFICNKLATALAAGCTAVIKPSEMSAMQTQIVAEALHEAGLPPGVFNIVNGRGDVVGEEIVRNPGIAKISFTGSSAVGKRLASAGAATMKRVTLELGGKSPTVVLDDADFADIMPLVLQAGFLNSGQACIAGTRILVPRHRLAEFEQIARGAVSHVKSGDPRKADTDIGPMVSARQWERVQNYIRIGMEEGAALLAGGAGRPDGFHKGWFVKPTLFTNASNQMRIAREEIFGPVLTIIPYTDDADAVAIANDTTYGLSAMVLGKDIERCERIARQIDAGRVLVNTLAHEPRAPFGGFKHSGLGREMGKWGISAYLEPKTLMMASTQA

SEQ ID NO: 26781 - protein, 602 aa, Alkaliphilus metalliredigenes QYMF
MPSDRQRKIRNFSIIAHIDHGKSTLADRLIERTGLISQREMQAQVLDNMELERERGITIKLQSIRLIYKAKDGQDYYLNLIDTPGHVDFTYEVSRSLAACEGAILVVDAAQGIEAQTMANVYLALEQNLEIIPVINKIDLPSARPDEIKREIEDIIGLDASEAPLISAKDGLNIDDVLEAIVKNIPPPTEDEEAPLKALVFDSYYDNYKGVVAYTRVVEGTVKKGMKIRMMATKKEFEVTEVGVYSPGPIQLDQLSAGDVGYIAASIKDVRYCRVGDTITDALNPTEHSLPGYRKVTPMVYCGVYPAEGEKYEDVRDALDRLQVNDAALVFEAETSAALGFGFRCGFLGLLHMEIIQERLEREFNLDLVTTAPSVIYRVTKTNGEVVMIQNPANLPVTQEISVIEEPIVKATIMVPSEYAGIVIELCQDRRGEMKGMDYIEETRVNLHYELPLNEVIYDFFDALKSKTKGYGSLDYEMKGYKPSTLVKLDILINSEQVDALSFIVHESKAYARGKGMCEKLKDEIPRHQFPVPLQASIGTKIIARETIRALRKDVLAKCYGGDISRKKKLLEKQKKGKKRMRQVGSVEVPQKAFMSVLKLDT

SEQ ID NO: 26782 - protein, 472 aa, Ralstonia eutropha JMP134
MIQWNEHLINGARRAVREGRTVRIHDAATEAPLGDVHLGNAGDVDEAVEAARVALPGWQQMGVDARAALLRAVADALESMGQDLAHGISREVGMPLKLSQRIQVEAPIAAWRATAALADTFSFVSEVGNSRVTQVPVGVVAAITPWNYPLHQITGKLAPALLAGCTVVLKPSELAPAASTGLMAACERAGLPPGVLNIVLGDAEVGHALVTHPDVHMVSFTGSTAVGRKVAALAAGDMKRLSMELGGKSAAMVLPGADLARAVKATVASCFLNSGQTCSAITRLIVPREDYPACRALLAEAVAGMPMGDPSDASTRIGPLLSALQRERVLAHIAEAEQGGFDRIAGGPDAPVPAHGYFVAPTIYGNVAPDSRLANEEVFGPVLAVLCYESVEGAIALANGTRYGLAASVWAVDEASGEAVANALRAGQVDINGARFNAAAPFGGFGMSGVGREGGVYGLEEFLEPRAIQFPR

SEQ ID NO: 26783 - protein, 440 aa, Bifidobacterium longum DJO10A
MTNAVADIEQETPEIEKERQLAGVGAGAGTVANGKKKPHDHALASILGPAFVAAVAYVDPGNVAANITSGARYGYLLVWVLVLANAMSVLIQYQSAKLGIVTNKSLPELLGERMSDAGRFMFFMQAEVIAIATDLAEVIGGAIALNLLFGLPLFIGGLVIGAISTVMLWFQGGKTQTTFERIIIVMLLIITFGFIAGLFVDPPSPGEVVKGMIPRFQGTDSVLMAASILGATVMPHAIYLHSTLVNDHYAGGEKPSIKTQLKGSKIDVVWALLLAGTVNLAMLVLAANSLHGMSGTDSIDGAQRAIAQVLGPVIGTIFSIGLLASSLSSTSVGTYAGSEIMHGLLHVNAPMWACRVVTLVPALIVLWFAKDPTQALVIGQVVLSIGIPFAVIPLMRYTHDKELMGKWADGTVKHVIFMIVVALIVALNVLLIVLTLMGRA

SEQ ID NO: 26784 - protein, 642 aa, Azoarcus sp. EbN1
MCGIHGIYRFDAAPVSPAQLSAMGDVTRHRGPDDEGRYIDADGRCGIAMRRLSIIDLAGGHQPISNADDTLWGVCNGEIYNFRELRAELQERGYRFKTGSDSEVLVHLYDAFGDDFVHRLDGMFNFALWDARRKRLLIGRDPLGVKPLYVHRSASMLAFATEAKALLELPGVTRELDHDVVADYLHLGYVAAPHSMFRDIRKLPPATLLSVENGEVRQWRYWRLPSSVARYVTEAEWIGRIRDGMERAVHRQMVSDVPIGAFLSGGVDSSAVVAFMAKHSAHPIRTYAIGFEGGEAEQLYNELPYARQVAQLIGTEHHEIVVTPDVVGLLPKLLWHMDEPVSDSAFITTFLVSEFARRDVKVILSGVGGDELFGGYRRYLGGHYVRKLQRLPRWSRQLMSRTAAMLPSDRHSKVLNTMRLARGFLASAELSPDERYRHYLQVLDRASIAELMNGRTGTTDALRDAFAAAGDEDALNRMFAVDAETQLPDDLLLLTDKMSMAVSLECRVPLLDRELVELAAAIPEALKVRDGRLKHLMKEALADVLPASILDRKKRGFGTPMGAWLKRDLAPVLRRLLSADVVRDRALFEPKVIARLMADHDANRIDGTDALLALMNLEIWSRIFLDRRSPDDVTTELKAYLP

SEQ ID NO: 26785 - protein, 352 aa, Triticum aestivum
  misc_feature (79)..(79): Xaa can be any naturally occurring amino acid
  misc_feature (91)..(91): Xaa can be any naturally occurring amino acid
  unsure (1)..(352): unsure at all Xaa locations
MERIGDKVISRAEITDAASATFADSTVIPDRYARPDEVRDGVVVGSDESYELPVVDMARLLHPEFSEAEIAKLGSACRXWGFFHLPNHGVXEQVVQDMKDNTLQFFGLPLEKKKAVAIQANGFEGFGHHYNRASSEKLDWAESLILVTQQHEQRNNEFWPADPSTFRVALDKYSVEMSNLTSRLTVFMASDLGVEQEALMATFQGKTQSVAFHYYPPCRHPDKVIGITPHHDGLGLTLLLHVDDTPGLQVRKNGRWYPLNPLPGALVINVGDILQILTNGTYKSAEHRVLPDVEKGRATVVMFQNACVAGIVKPLPELGEATYKAIDHVEYVKGNFRALAEGTRFVDSLKIM

SEQ ID NO: 26786 - protein, 223 aa, Glycine max
MASGRSYGDANQKVDYVFKVVLIGDSAVGKSQILARFARNEFSLDSKATIGVEFQTRTLVIQHKSIKAQIWDTAGQERYRAVTSAYYRGAVGAMLVYDITKRQSFDHIPRWLEELRNHADKNIVIILIGNKSDLENQRQVPTEDAKEFAEKEGLFFLETSALEATNVETAFMTVLTEIFNIINKKNLAASDNQGNDNSASLSGKKIIVPGPAQEIPKRSMCCQ

SEQ ID NO: 26787 - protein, 301 aa, Triticum aestivum
  misc_feature (134)..(134): Xaa can be any naturally occurring amino acid
  unsure (1)..(301): unsure at all Xaa locations
MDVPLASKTFPSPSPSKREQCNVDGHKSSSKHADLNPHANDSVLGIILGGGAGTRLYPLTKKRAKPAVPLGANYRLIDIPVSNCLNSNISKIYVLTQFNSASLNRHLSRAYGSNIGGYKNEGFVEVLAAQQSPXNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDDNQC

SEQ ID NO: 26788 - protein, 319 aa, Oryza sativa (japonica cultivar-group)
MSSHHRYAHLLDDPFFPFPPPSSSSCPFLSPPAASSTCPFFALDSPFAADPFHLHPFLPTPPTSSLLDPFLLHTLTDRVSQLELALAARAPHPRPTSRKCTYVTESTGRKVKWTTEDKPRAGERVLKWEAELDSPYDDGFDRKWKWEAKAKTASAAATKLKWATHLKGKGCLEPWSHSYTWEEDFSATDDDDDEEIEDQLHHKALQDHSKLKTKAKDDKKKKKKDNNTVVVNKEQKKCPFSVKIEEIPPEEDNTAGCVAIRKAFALGNGKAKKKELSPQDAALLIQLNYRAHLAHRSQVLRCLRDLAVAKAKLKEIRCA

SEQ ID NO: 26789 - protein, 510 aa, Vibrio cholerae O1 biovar eltor str. N16961
MSAKKPMALVILDGWGYREDNANNAINNARTPVMDSLMANNPHTLISASGMDVGLPDGQMGNSEVGHTNIGAGRIVYQDLTRITKAIMDGEFQHNKVLVAAIDKAVAAGKAVHLMGLMSPGGVHSHEDHIYAAVEMAAARGAEKIYLHCFLDGRDTPPRSAEASLKRFQDLFAKLGKGRIASIVGRYYAMDRDNNWDRVEKAYDLLTLAQGEFTYDSAVEALQAAYAREENDEFVKATEIRAAGQESAAMQDGDALLFMNYRADRARQITRTFVPDFAGFSRKAFPALDFVMLTQYAADIPLQCAFGPASLENTYGEWLSKAGKTQLRISETEKYAHVTFFFNGGVENEFPGEERQLVASPKVATYDLQPEMSSKELTDKLVAAIKSGKYDAIICNYPNGDMVGHTGVYEAAVKACEAVDECIGRVVEAIKEVDGQLLITADHGNAEMMIDPETGGVHTAHTSLPVPLIYVGNKAISLKEGGKLSDLAPTMLALSDLDIPADMSGQVLYS

SEQ ID NO: 26790 - protein, 681 aa, Saccharomyces cerevisiae
MAQFSDIDKLAVSTLRLLSVDQVESAQSGHPGAPLGLAPVAHVIFKQLRCNPNNEHWINRDRFVLSNGHSCALLYSMLHLLGYDYSIEDLRQFRQVNSRTPGHPEFHSAGVEITSGPLGQGISNAVGMAIAQANFAATYNEDGFPISDSYTFAIVGDGCLQEGVSSETSSLAGHLQLGNLITFYDSNSISIDGKTSYSFDEDVLKRYEAYGWEVMEVDKGDDDMESISSALEKAKLSKDKPTIIKVTTTIGFGSLQQGTAGVHGSALKADDVKQLKKRWGFDPNKSFVVPQEVYDYYKKTVVEPGQKLNEEWDRMFEEYKTKFPEKGKELQRRLNGELPEGWEKHLPKFTPDDDALATRKTSQQVLTNMVQVLPELIGGSADLTPSNLTRWEGAVDFQPPITQLGNYAGRYIRYGVREHGMGAIMNGISAFGANYKPYGGTFLNFVSYAAGAVRLAALSGNPVIWVATHDSIGLGEDGPTHQPIETLAHLRAIPNMHVWRPADGNETSAAYYSAIKSGRTPSVVALSRQNLPQLEHSSFEKALKGGYVIHDVENPDIILVSTGSEVSISIDAAKKLYDTKKIKARVVSLPDFYTFDRQSEEYRFSVLPDGVPIMSFEVLATSSWGKYAHQSFGLDEFGRSGKGPEIYKLFDFTADGVASRAEKTINYYKGKQLLSPMGRAF

SEQ ID NO: 26791 - protein, 980 aa, Methylobacterium extorquens
MLIKRKSGDAARTKHQAVAAGLAAGVLDRRAFLRKSGLTAGALAAAGTIQLGSVRKAQAAGSSAVGPDTVIKKNVCTHCSVGCTVTAEVVNGVWVGQEPSYASPINRGTHCAKGAAIRELVSSDRRLKYPMKLEGGQWKRISWDQAYEEIGDKLVQIREKNGADSVYWLGSAKFTNEASYLMRKFAALWGTNSIDHQARICHSTTVAGVANTWGYGAQTNSYNDIRNAKTMIILGGNPAEAHPISMQHVLSGKEINRANMIVIDPRFTRTAAHATEYVRIRSGTDIPVVWGILWHIFQNGWEDKEFIAQRVYAMDDVRKEVAKWTPDEVERVSGVPGEQLKRVAEKFAKEKPATLIWCMGATQHTVGTANVRALCILCLATGNVGKPGTGANIFRGHTNVQGATDLGLDVTSLPLYYGLVEGGWRHWARVWDVEYEWLQSRFDEVPAKGGRKARTRKENMEAPGITSTRWFDAVNLPPEQIDQRSPIKAFMVFGHGGNTVTRMPEAIDGMNKLELLVVADPHPTTFAALDARQDNTYLLPICTSLEMDGSRTASNRSIQWGEQIVKPAFESKSDYEVLYRLAQKLGFADKLCKNIKIVDGAPEAEDILREINRGGWSTGYCGQSPERLKAHMRNQHKFDLVTLRAPKDDPEVGGDYYGLPWPCWGKPELRHPGSAILYNTSLHVKDGGGGFRARFGTERNGQTLLAENSFSKGSDLTDGYPEFTFGVFKKLGWDKDLTPDELATILKIGGEKPDTVSWATDLSGGIQRVCLDHGVSPFGNGKARANAWNLPDPVPVHREPVYSPRPELVAKYPTRPDERQLRMPNIGFSVQKSVVDRGVAKDFPIILTSGRLVEYEGGGEETRSNPWLAELQQDMFVEINTGDAAARGIKDGQWVWVSGPENGAKTKVKALVTDRVGKGVAFMPFHFSGWYQGKDMRDFYPKGTDPVVLGESVNTVTTYGFDPVTGMQETKCTLCQIAAA

SEQ ID NO: 26792 - protein, 113 aa, Oenococcus oeni
DIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILN

SEQ ID NO: 26793 - protein, 201 aa, marine gamma proteobacterium HTCC2080
MATVTTPRSASVERTTLETSISVELCLDGSGQVEFDTGVPFLEHMLDQIARHGMIDLKVIAKGDLHIDGHHTVEDIGITLGQAFYKAVGEKTGLARYGHAYVPLDEALSRVVVDFSGRPGLVWEVPFTRGMIGSFDVDLFVEFFQGFVNHALVTLHVDNLRGHNAHHQAETVFKAFGRAMRMALTPDPAMAGITPSTKGTL

SEQ ID NO: 26794 - protein, 113 aa, Oenococcus oeni
DIKLLVVSDGEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILN

SEQ ID NO: 26795 - protein, 131 aa, Triticum aestivum
  misc_feature (77)..(77): Xaa can be any naturally occurring amino acid
  misc_feature (124)..(124): Xaa can be any naturally occurring amino acid
  misc_feature (127)..(127): Xaa can be any naturally occurring amino acid
  unsure (1)..(131): unsure at all Xaa locations
MVKTSVLNDALNAINNAEKSGKRQVLIRPSSKVIVKFLSVMQKHGYIGEFEEVDDHRSGKIVIQLNGRLNKTGVISXPRYNVRLGDLEKWVVKLLPSRQFGYMVLTTSAGIMDHEEARRKHVAXKIXGFFY

SEQ ID NO: 26796 - protein, 244 aa, Aspergillus niger
MPLPARTASITRITNETKIQISLSLDGGILPPYEPCAHFPAPTDPAEVEASKKGIIPNKAAPHATQFTPTQQITINTGIGFLDHMLHALAKHGGWSLAVRAKGDLFIDDHHTTEDTFLALGSAFTEALGARQSLARFGRGDAPLDEALSWAVIDLSSRPWAVINIGFRREKIGDLSTEMITHGLQSFAQAAGVTLHVGCTYGDNDHHRAESAFKALAVAIRTACTRRVEGEVGAGDVYLVGGGV

SEQ ID NO: 26797 - protein, 505 aa, Gibberella zeae PH-1
MAHELPFKIPTLQVKQQAPSQVQPLTSSVILPSNSLTTLTTPDPGTNKPWAKVKDNSADDVDHTVQVAYDAFQTFKKTSPRLRAQWLLKWDALIREHKADLATLLVYETGKPYAEAIGEMDYSLTFTSWFAGEAERIQGTCFMPSAPNRRVFTIKQPLGVAVALVPWNFPVAMVLRKAAAALAAGCTMVVKPSPETPVTAMALAKLASEAGFPNGVLNILPTSLDNTPSLSEALCKHDLVKKVTFTGSTRVGTLVANLCSLGLKKVVLELGGNCPCLIFNDADIEAALRELVGLKWRHAGQACVTVNRFLVQSAVYDKFLQRFAEETAKYVVGHGASEGTTLGPVTKPESLDRAERLIKDAVSKGARIVTGGNRLSPKDGEGGYFFEPTILADMTHDTLISCEECFAPIAAFYKFETEEEAVRVANDTPMGLASYAFTKDADRIWRLFENLEAGMIALNTGNSSAAESPFGGIKMSGYGKEAGKDVAVNEYMIQKTGTITVDGLV

SEQ ID NO: 26798 - protein, 474 aa, Aspergillus niger
MAFARLAARRLPVARRLVPSIDSLPQQRFFSMSQHVKSQNKASVPNPDPAADSVSVAFVNDQSPYMLPTYVRPAPVMVKGQGCYLWDMENRKYLDLTAGIAVNSLGHCDPEVAQIIAEQAEVLVHASNLYYNAWTGALSKLLIDVTQKSGAMRDASQVFICNSGTEANEAAIKFARKVGRSLDPSGAKHEVVSFHNSFHGRTMGALSATPNPKYQTPFSPMLPGFKYGNYNDVAQLESLVTEKTCGVIVEPIQGEGGINVATPEFLVALRKRCDEVGAVLIFDEIQCGLSRTGSFWAHAHPSLAPASGEAAHPDILTSAKALGNGIPIGATIVSEKTVAKHIKPGDHGTTYGGNPLVCRVAHHIVNRLADPELQKSVEIKGDLLVSGFKDLQKKFPNVISEIRGRGLIRGLQLSPEFVSKAGDLVGAARERGMLIITAGEGCIRFVPPLTITEEQIKSGLKILEQALEAVVAQA

SEQ ID NO: 26799 - protein, 236 aa, Mycobacterium tuberculosis H37Rv
MSPPNQDAQEGRPDSPTAEVVDVRRGMFGVSGTGDTSGYGRLVRQVVLPGSSPRPYGGYFDDIVDRLAEALRHERVEFEDAVEKVVVYRDELTLHVRRDLLPRVAQRLRDEPELRFELCLGVSGVHYPHETGRELHAVYPLQSITHNRRLRLEVSAPDSDPHIPSLFAIYPTNDWHERETYDFFGIIFDGHPALTRIEMPDDWQGHPQRKDYPLGGIPVEYKGAQIPPPDERRGYN

SEQ ID NO: 26800 - protein, 125 aa, Glycine max
MAGSGSSMLYSFLLFTVILSLQEMYRGKLASSELYTILGGFVSSLLFLVLLTFIGNFQETIGARTGWGAVIVAEAVALIAASTVHRVCITTCFLFSAALLYEVNKISGSALSTSDSRTKKQSGRA

SEQ ID NO: 26801 - protein, 440 aa, Mycobacterium tuberculosis H37Rv
MTAIADSAGGAGETVLVAGGQDWQQVVDAARSADPGERIVVNMGPQHPSTHGVLRLILEIEGETVVEARCGIGYLHTGIEKNLEYRYWTQGVTFVTRMDYLSPFFNETAYCLGVEKLLGITDEIPERVNVIRVLMMELNRISSHLVALATGGMELGAMTPMFVGFRAREIVLTLFEKITGLRMNSAYIRPGGVAQDLPPNAATEIAEALKQLRQPLREMGELLNENAIWKARTQGVGYLDLTGCMALGITGPILRSTGLPHDLRKSEPYCGYQHYEFDVITDDSCDAYGRYMIRVKEMWESMKIVEQCLDKLRPGPTMISDRKLAWPADLQVGPDGLGNSPKHIAKIMGSSMEALIHHFKLVTEGIRVPAGQVYVAVESPRGELGVHMVSDGGTRPYRVHYRDPSFTNLQSVAAMCEGGMVADLIAAVASIDPVMGGVDR

SEQ ID NO: 26802 - protein, 619 aa, Azoarcus sp. EbN1
MINRPWISSDMHRKVEGPRLLARITGAISRNAPLHGAGRSNSLSGLVEFRSGFCSHDGGVAVHRAGDLVCMALGSPRFEPGALHERASTAGIAAAWLDAFRERGARAPAAAKGRFAVVVLNGGEGSAWLAVDRFGTHPLCHAIEDGMLAFATRADEVPVVAKALDTQALFDYLYFHMIPAPRTVFAGVERLLPGHVLHWRDGKARSERYWTPRFAPDRSLDLEAGKLRFLEIVESAVARETSDGQPGAFLSGGTDSSTVSGMLCRVLGRPAPTYSIGFDAAGYDEMAYARIAAKHFGTDHHEYYVTPDDLIEGIPKVAAYYDEPFGNSSVVPSWLCARNARNDGITRMLAGDGGDELFGGNSRYAKQRIFGFYDAVPGVLRSSMLEPMLGLRGMDRVPVVKKAASYVSQARVPLPDRMGMYNLLLRLGPTHVLTADFLGLVQQEAPLAAQRTVWAETAGQPLVNRMLAFDWKYTLADNDLSKVLGSTALAGVEVAFPLLSDELLEFSLTLPAEWKLKGLTLRWFFKEALRGFLPDEIIAKKKHGFGLPFGVWASQHAGLRSMARDSLETLKQRGIVRGAFIDDLLTNLLPAHPGYYGEMVWILQMLELWLREHAPEYRL

SEQ ID NO: 26803 - protein, 376 aa, Arabidopsis thaliana
MSDLPPDLVEDILSRVPATSLKRLRFTCKQWNSLFKNRRFTEKHFCKAPKQSHVLLWKDYTVCPMSINLNFSGSSIEFKSVLSLKDSHYNSEQVYIAKVFHCDGLLLCTTKDHRLLVWNPCLGETRWINFENDYKPYSRFSLGYKNNKSCRSYKILRFWTSYLTPNHIGLRYNIYEFTTDSWRVLIDKVSLNYFLIESENGVSFKGNTYWLALDEETNFLLGFDFTMERFKRLCLPSNKNCDTMVLSVVREEKLSVSHQNFCSSKMDIWMTNRIDSETAMSWKRYFSVEFKILSMCHSLPFCNSFLIDEEKKIVISTVRGNENMVNIIGAYNAYYAEVPVESTNWPCSPYFVSYVPSLVQIQQCKSKENNKTSLEM

SEQ ID NO: 26804 - protein, 469 aa, Enterococcus faecalis V583
MVKQFKNDFLWGASSSAFQIEGAWNEDGKGLTVADYNSFKKSAVQADTKVASDFYHRFKEDIALMKELGLKTYRFSLSWARIIPTGDGEINQAGIDFYNAVIDTLLENDILPFVTLYHFDLPFALVEKYNGWADRRCVSAFQRYAQVCYQAFGDRVKNWQVTNEQNLMIRVDERMNMYDVAPENVEKIRAQMDYHMFVAHALATNDCHQLVAGGKVGPSVSSTMTYPSSNKPEDVWAARMNDNFKTNYALEMYCFGEYPGYYQEYLTKCGIYPETQPEDQAILKAAKPDFIALNYYRTLVASYLPTDEQHPLGTKEKDIDFDLYGYFKIEKNQHLKTSKYGAQIDPTGLRLVLNDYYRQYRLPLIITENGLGTPDHLTEDGKIHDDYRIAYLHDHIAACHAAISDGVELFGYCPWSVMDILSSHQGFKKRYGFIYVNREDHELKDLRRIKKDSFYWYQSVIKNNGLSEE

SEQ ID NO: 26805 - protein, 250 aa, Helianthus annuus
MVKLAIGSIGDSLSAGSIKSYLAEFIATLLFVFAGVGSAIAYGKLTTDAALDPAGLVAIAIAHAFALFVGVSMAANISGGHLNPAVTFGLAIGGNITIITGLFYWIAQCLGSIVACFLLQFVTGGLAVPTHGVADGMNGVQGVVMEIIITFALVYTVYATAVDPKKGSLGTIAPMAIGFIVGANILAAGPFSGGSMNPARSFGPAVVSGDFSQNWIYWVGPLIGGGLAGFIFGDVFIGSYETLPDSGDYA

SEQ ID NO: 26806 - protein, 211 aa, Mycobacterium tuberculosis H37Rv
MANTDRPALPHKRAVPPSRADSGPRRRRTKLLDAVAGFGVTLGSMFKKTVTEEYPERPGPVAARYHGRHQLNRYPDGLEKCIGCELCAWACPADAIYVEGADNTEEERFSPGERYGRVYQINYLRCIGCGLCIEACPTRALTMTYDYELADDNRADLIYEKDRLLAPLLPEMAAPPHPRTPGATDKDYYLGNVTAEGLRGVRESQTTGDSR

SEQ ID NO: 26807 - protein, 416 aa, Azoarcus sp. EbN1
MSNSVTVKAPPTHAPMTQFSVAKGELVVGGISLTRLAARVGRTPFYAYDRGLLTQRVSELRTALPREVRLHYAMKANPMPALVCHMAKLVDGIDVASAGELKVALDAGADPGEISFAGPGKQDAELQQSVAAGILVNLESFREIAPLVAASVALGLPARVAVRVNPDFELKSSGMKMGGGPKQFGVDAEQVPQLLAEIGRAGLAFEGFHLFAGSQNLKAEAIVEAQRKSFELALRLAEHAPAPVKFLNLGGGFGIPYFPGEQRLELAPIGDNLAALVAEAARKLPQAQLVIELGRYLVGEAGIYVCRVIDKKVSRGHTYLVTDGGLHHHLSASGNFGQVIRKNYPVAIGNRMGDAATENYSVVGPLCTPLDLLGEKINLPQVQPGDLVVIHQSGAYGASASPTGFLGHPEIIEILT

SEQ ID NO: 26808 - protein, 90 aa, Glycine max
  misc_feature (69)..(69): Xaa can be any naturally occurring amino acid
  unsure (1)..(90): unsure at all Xaa locations
TILSSASSLFTFLVSLAFLGERFTWLKLFSVLLCMAGTIIVSLGDSQSGLATVASNPLLGDIFALASAXLYAVYITLIRKKLPDDDGKSG

SEQ ID NO: 26809 - protein, 821 aa, Nostoc sp. PCC 7120
MVEIIIDPHTSDSVFKEQALVLPLNQVGIADIPLVGGKNASLGEMIQQLRRKGVKVPTGFATTAHAYRYFITSAGLEAKLREIFADLDVEDVQNLRQRGKQARLLMLQTPFPQELQTAIAQAYATLCQEYGDDTDVAVRSSATAEDLPDASFAGQQETYLNVHGLQAVLESCHKCFASIFTDRAISYRQIKGFDHFNIALSVGVQKMVRSDLATSGVMFSIDTETGFKDAVLITAAYGLGENVVQGAVNPDEYLVFKPTLKQGYRSIIEKRLGTKEIKMIYDLGGSKLTKNISVTPSERSVFALNDEDILQLAHWGCIIEEHYSQVRGVYTPMDIEWAKDGLTNELFIVQARPETVQSQKVNNVLRNYRLSPSLIPNPQPLIPLITGRSVGEMIGQGKARVILDVHQISQFQAGEVLVTNRTDPDWEPIMKRASAIVTNSGGRTCHAAIIAREMGIPAIVGCGNATTVLKTGQEITVSCAEGETGKVYSGLLPYEVQEIPLEKLPCTHTQIMMNVGNPEEAFGLTSIPNDGVGLARMEFIINNHIKAHPLALIHFDELEDELAKYKIAELTAQYEDKTLFFVDKLAQGIATIAAAFYPKPVIVRLSDFKSNEYANLLGGKQFEPKEENPMIGWRGASRYYDPRYREGFALECQAMKRVREEMGLTNVILMVPFCRTPNEGRRVLDEMAKHGLVQGENGLQVYVMCELPSNVQLADEFSQVFDGFSIGSNDLTQLTLGLDRDSELVAHLFDERDEAVKRMIAKAIATVKQHGRKIGICGQAPSDYPDFARFLVEQGIDSISLNPDSVLKTLLEIAAAEGKKV

SEQ ID NO: 26810 - protein, 550 aa, Oryza sativa (japonica cultivar-group)
MALLLRHSPKLRRAHAILGCERGTVVRHFSSSTCSSLVKEDTVSSSNLHPEYAKKIGGSDFSHDRQSGKELQNFKVSPQEASRASNFMRASKYGMPITANGVHSLFSCGQVVPSRCFSSGADLPPHQEIGMPSLSPTMTEGNIARWVKKEGDKVSPGEVLCEVETDKATVEMECMEEGYLAKIIHGDGAKEIKVGEIIAVTVEEEEDIGKFKDYKAPSSAESAAPAESKPQSEPTEPKKEKEQPKAPEPKATKTEESFLSEDRTFSSPIARKLAEDNNVPLSSIKGTGPDGRILKADIEDYLASVAKGAKKETAAAPGLGYVDLPNTQIRKVTANRLLHSKQTIPHYYLTVDTRVDKLIKLRSELNPLQDTSGGKKISINDLVIKAAALALRNVPECNSSWMNDFIRQYHNVNINVAVQTEDGLFVPVIRDADKKGLATIADEVKQLAQRARDNSLKPEDYEGGTFTVSNLGGPFGIKQFCAIVNPPQSAILAIGSAEKRVIPGAEGQFEVGSFMSATLSCDHRVIDGAIGAEWMKAFKGYIENPTTMLL

SEQ ID NO: 26811 - protein, 595 aa, Prochlorococcus marinus str. MIT 9301
MIKVEKVKKKKDSAKEETVCLANGLEVSKFENFKKSSQFLKEPLATELVNESDHFTNDAVQLLKFHGSYQQDNRENRRPGKSKDWQMMLRLRNPGGEVPGKLFLALDELSDKLGNGTLRATTRQAFQMHGIRKEKLKEVIQTIVNSMGSTLAACGDINRNVMAPAAPFDSPEYNIARALAKKVADLLTPMAGQGTFLELWADGDLEYTIKPDKDIEAIRKLQFKDNVFSGIKDEPLYGSTYLPRKFKCAVTVPGDNSVDLLTNDIGIVAFTSKDGNLEGCNFYVGGGMGRTHNNEETFARIADPLGYVEEPDVYELIQSIVAIQRDYGDRKSRKNSRMKYLLHKKGIKWFKKILSDKYFKKEIKKIRKEPDKALIDYLGWHKQNKTSHFVGLPLLSGRLSGEKKNTISSIVKKYNLDLRLTPNQDILLCNIANKNKSAIQNSLSKIGYENLDNINEIQRHALACPALPLCGLAMTEAERILPDVLKRIENLLLDLKIQKTILFRMTGCPNGCTRPYMAELALVGSGQNKYQLWLGGSKNLQRLAKPFLQRMELNDLEKTLQPLFDNWKSNLDLDFGDFINTQDENYILNLLNENQ

SEQ ID NO: 26812 - protein, 513 aa, marine gamma proteobacterium HTCC2080
MNKAEQGPTLLVILDGFGHREDPRDNAIAAANTPTWDRLWQTAPKTLISGSGQDVGLPEGQMGNSEVGHMSLGSGRVIYQSISKIDNAVNDGSFHTNEAYCHGIESAVSQGKAVHIMGLLSSGGVHSHERHIFEMVRMAAAKGATEIYLHGFLDGRDTPPRSASSALRAADEVFEQLGVGRLATITGRYWAMDRDQRWDRIEKSYRLLCLGEAEHAADSSTAGLEAAYDRGETDEFVAPTRIGEPAVIADGDVVLFMNFRADRARQLTEALINENFDGFERTSIPNISLVCTTEYSSQFNCPVAFPPDIVNDGFGEILANNGLSQLRIAETEKYAHVTFFFSGGREELFEGEKRILIPSPNVATYDLQPEMSAIAVTDAVIDAIESRSVDCIIVNFANGDMVGHTGVFDAAVKAVETLDTCLERIEAALLAANGQALITADHGNCEQMLDYDSGQNHTQHTTEHVPLVYVGNHQLVLRQEEGILADVAPTLLALIGVEQPNAMTGTSLLEPEG

SEQ ID NO: 26813 - protein, 425 aa, Magnetospirillum magnetotacticum MS-1
MATASFDSAPGAPRALTSIEKTPEVTALSILPGRKASLVGQTREGLKQALIGIGVPEREARMRTSQIWHWLYVRGAREFSEMTNVGKGLKAQLAQHFTLDRPEVVTEQVSRDGTRKWLLRMAPTGAHDHNRGAEIECVYIPGDDRGTLCVSSQVGCTLTCSFCHTGTQRLVRNLSTAEIVSQLVVARDALGDFTGQMPGKDGGEAGRLVTNIVFMGMGEPLYNLDAVIDAIAVMSDPEGLALSRRRITVSTSGVVPQIERLGLEANAMLAISLHAVRDELRDELVPLNRKYPIAQLLEACRNYPGLSNARRITFEYVMLKGVNDSDADARALVRLLKGIPAKINLIPFNPWPGSKYECSDWERIERFSEFVFNAGYASPVRTPRGRDILAACGQLKSETEKLRARARMMLESGMGAEAIYADQVD

SEQ ID NO: 26814 - protein, 559 aa, Ostreococcus tauri
MATVTIKEIPTTPIEGQKTGTSGLRKKAAVFSEGNYLANWVQSLFSALGDESRGEAMVLGGDGRWFNKEASQIILKLACGNGVKKMYVGRDGYLCTPAASAVIRARKAFGGFIMSASHNPGGPNEDWGIKFNYSSGEPAPEKITDAIYGFTQTVSTLKMADIPDVDLSVCGVTKFGDFEVEVIDPVEDYLKLLKEVFDFDLIKSLLSRSDFKMQFDAMHAITGAYAKPIFVDQLGAPPSSCVNDEPKEDFAGGHPDPNLTYAEELVKVMFSASAPDFGAASDGDGDRNMILGNNFFVTPSDSVAIIAANAVECIPYFKSGLKGLARSMPTAAALDRVAAGLGVECFETPTGWKFFGNLMDAGRCSVCGEESFGTGADHVREKDGMWAVLAWLSILAYRNKDVPVGGKLVGVKEITEEHWAKYGRNFFSRYDYEGCESDPCNAMVEALRAKAASAKKGDKYGDYELDYADDFEYTDPIDGSVAKKQGVRFVFTDGSRFIFRLSGTGSSGATVRMYIEQYEADKSKQGVDAQVALAPLIKIALDTSDLEKFTGRNAPTVIT

SEQ ID NO: 26815 - protein, 355 aa, Haloarcula marismortui ATCC 43049
MQAVLLEEFQEPLTVQEVERPEPEPDGAVAEVIGCGICRSDWHCWQGDWDWFGYRPDPPHVLGHEPTGRIVSVGEDVENIEEGQEVAIPFNFACGNCDLCRNGRENICENHIGLGFMNQAPGAFAEEVHIPNADLNAVPLPDDIDAESAAGMGCRFMTSFHAMAHRAPVSAGDDVVIHGCGGIGLSAVHIANALGGNVIGVDLMDEKLDRAEELGAVATVNAQEVDDPAKAVRDITDGGADVSADALGIATTCQNAVNSLRKGGTHVQIGLTTSEEAGMVSLPTDEFVAKEIDFKGSLGLQPSRYSEMLDMVESSKLDPTALVEDTVDIHQVPDELAAMSDYNTVGIPVCNEFSN

SEQ ID NO: 26816 - protein, 750 aa, Shewanella oneidensis MR-1
MTSAALINSGGSLPYSVSAGKAFPLGATVDDGGVNFALFSAHATGVELCLFDAQGKVEIQRIALTEQTQQIWHLYVHGLCAGQLYGYRVYGPYEPQLGHRFNPHKLLLDPYARQLVGRYHHHIANFGYELDNPNEDLSFSTLDNAAYMPKCKVVDIRPLLAAAESQAIRPLSPHRNPLPIEQCIIYEMHLKGFTALHPEIDVPLRGTFAGLASKAAIDYLVKLGVNCVELLPIQAFFSEPFLLEKQLSNYWGYNSIGFFAPEPSYLSSEDIIEFRTMVDALHGAGIEVILDVVYNHSAEGSRLGPTFSFRGIDNLSYYRLHPNDKRFYINDTGCGNTLNLNHPRMLQLVLDSLRYWVKVMGVDGFRFDLAASLGREAYGFDPGSGFFDALLQDPVLCRVKLIAEPWDIGPGGYQLGNFPVAFSEWNDRYRDTMRRFWRGDHGMLPEFARRFHGSGDFFEHSGRPPAASINFLTSHDGFTLKDLVSYCERHNWANGEENRDGHHANFSYHYGVEGASNDVSVLVLRARQQRNLLTTLFLSQGVPMLLSGDETGRTQGGNNNAYCQDNPMNWFDWSSEGMDKHLLSFTQQLIALRKRFPLLCAKRFIHEQLVARSLESPSESPLGAAKFLTQPSARLDWFSRQGKPMTKSLWSESMCRSLCVVLSGDLTAGIDVAGDNSFQALLLMVNADEHPLAFTPPVFEHLGPWQCLLHTQTEPQYLTPTEPLDAQSSPTRYLLQDRSLMLFHADFIRN

SEQ ID NO: 26817 - protein, 429 aa, Methylobacterium extorquens
MTAITNIAAREILDSRGNPTVEVDVLLEDGSFGRAAVPSGASTGAHEAVELRDGDKSRYNGKGVLKAVDAVQSEILDAIGGMDAEDQVAVDEAMIALDGTPNKARLGANAILGVSLAVAKAAAETAGLPLYRYVGGVQGRVLPVPMMNIVNGGAHADNPIDFQEFMVMPVGATSLSDAVRMGAEIFHTLKSALKKAGHNTNVGDEGGFAPNLPSAEAALDFVMESINAAGFKPGSDVVLALDCAATEFFKDGAYRYEGEGQTRSIEQQVDYLAKLTEAYPILSIEDGMSEDDWEGWKLLTDRIGSRVQLVGDDLFVTNVERLARGIETGTANSILVKVNQIGSLTETLAAVDMAQRAGYTAVMSHRSGETEDSTIADLAVATNCGQIKTGSLARSDRLAKYNQLIRIEEGLGAQALYAGRSAIRQLAGR

SEQ ID NO: 26818 - protein, 332 aa, Ehrlichia canis str. Jake
MKSLTVREALCAAIREEMERDHTVLIMGEEVGEYQGAYKVTQELLAQFGPERVIDTPITEHGFAGIGVGAAFGGLKPIVEFMTFNFAMQAIDQIINSAAKTNYMSGGQLNCPIVFRGPNGAAARVGAQHSQCYASWYAHVPGLKVISPYFAADCKGLLKAAIRDPNPVIFLENEIAYGHKHEIEDEVLTSDYTTEIGKAAIVKEGMDITITAFSIQVKNALAAAELLEKEGINAEVIDLRTLRPLDTETILCSIKKTNRIITVEEGWPYSGIGSEIAALIMEQAFDDLDAPVIRVTGKDVPLPYAANLEKLSLPQVTDILEAARILCLRNYK

SEQ ID NO: 26819 - protein, 625 aa, Ralstonia metallidurans CH34
MARTAPAASFESLESDLDQKFAYPASSKTYITGSRPDIRVPLRTILQTATRTEKGEMANPPIPVYDTSGPYSDPDVHIDLKAGLPPVRAKWIEERNDTEVLTGLSSEYGLARANDPATAHLRFAQLTNPRRAKAGANVSQMHYARKGIITPEMEYVALRESLNLQALYDKPEYKALLRQHPGNALGAALPLRPEDMTPEFVRREVAAGRAIIPANINHTELEPMAIGRNFRVKINGNLGNSAVTSSLAEEVEKMVWSIRWGADTIMDLSTGKHIHETREWILRNSPVPIGTVPIYQALDKTGGIAEDLTWEMFRDTLIEQAEQGVDYFTIHAGVLLRYVPMTADRVTGIVSRGGSIMAKWCLAHHKENFLYTHFDEICEIMKAYDVSFSLGDGLRPGCIADSNDDAQFGELRTLGELTAKAWEHDVQVMIEGPGHVPLQRIQANMDEELKHCYEAPFYTLGPLVTDIAPGYDHITSGIGAANIGWMGTAMLCYVTPKEHLGLPDKEDVREGIITYKIAAHAADLAKGWPGAQLRDNALSKARFEFRWEDQFNLGLDPERARSFHDATLPAEGAKIAHFCSMCGPKFCSMKITQEVRDYAASLPEAERGMQEKSIEFVKTGSKIYS

SEQ ID NO: 26820 - protein, 907 aa, Debaryomyces hansenii CBS767
MSPDIAEQEYIELSNINVDGTTTSDNAFNIGNNWNLTTDQIQFILLRLGIITDDTYKPGSSLDINLSQTSRFMINKIDNLSVIEAITILREALAEHKDDFNFLHEDYQLLQRLVRLIPGDFEISGKQEIEKTNPEEIEEKPTHFKNKTYLNIIDWNLQVRLEAALIAFHSPYPEIRAITDPVDEQEMPAETIRAYVIGFFWTLIGSIINNFFVHRLPSISLGLHTIQLLLLPSGRLWEKMMPYDKMITIFGYLFNLNPGPWSYKEMMLSTIIYLCSAGTPYLVYNIFVMKLDKFYGLKWVSWVYQLLLALSTQCLGFGFAGIMRKVCIYPVKSIWPTILPTIALNRALMHQDDGNNPSIHGWKISRYSFFYVMFGLSFIYNWIPSYFFTALSSFNWPTWINPYLVHLNNVTGFKSGLGLNPLPTLDWNILDAAGCLTFPFYTYANQYLGSVLGFFVILIVYYTNNKWTGYLPINSNALFNNEGKIYNVHSILNDKNMFDEKKYKEYGPPYFSAANLVLYGAYFCLYPFAIFFHVVTEWESMKASFVNVWHSIVDSLSSKGNIFGRYSKDPHCVMMSKYREVPDWWFLVILVVSTVFAILCVSLYPTETPIWGIFFTIFINFIFLIPMTAIASVTGFSFGLNVLVELIVGYTIPNSGIALITLKSYGYDIDSQASNYITDQKLAHYSKLPPRAIFKGQLISTIISVSTALIIANWQLDNIQDICDSHQKERFSCPGANTFFFSSVQYGEIGPAKVFSGLYPVLKWCFLLGVLLVIPCYWFKKNGPSRLTRYFHPTIIIGGFLMYAPYNLLYYTGGFYLSFIFMYYIKKNYILWWEKYNYILTSALSAGVAFSALIIFFTVQNDYTALDWWGNNVNDQGIEGGLAPKYTWLDVKQAEDGYIGLRKGHFP

SEQ ID NO: 26821 - protein, 434 aa, Haloarcula marismortui ATCC 43049
MASWGAACIETEPLLAADTVVSPMSHDSPPVRRLADWDHERLEAVAAEHGTPLYVVDLDRVAENYERFAAAFPDAHVMYAAKAHTGQAVLSKLLETGADIECAAWGELQRAIDAGADPNTLQYTAVNPPDRDLDRAVELAAEHPGLTITGGARDTFDRLEERGYNGRVAIRINPGIGTGHHEKVATGKDAKFGIPYDEVPEVAADVRERFDLVGLHAHAGSGVLHDDLDDHCRAIGKVADMGREVIADGAELDFVDFGGGFGVPYREDVEPLDMEIVGEKVREAVGDLDAQVKLEPGRYVVADAECILTEVNTVKETPAATVVGVDASLATLIRPAMFGSYHPIRNVTAPEREAEPVSVGGPCCTSADVFCTDRPLARPERTDLLAIGNAGAYGYELANQFHSQPRPAEVAFEGGETRVVRERETLADVTRMER

SEQ ID NO: 26822 - protein, 468 aa, marine gamma proteobacterium HTCC2080
MSERTLTLIKDNDIRWVDLRFTDTMGKEQHVSIPATEVGEDFFEEGKMFDGSSISGWKGINESDMILMPDDSSSILDPFTDDATVILRCDIIEPTTMQGYERDPRSVAKRAEAYLTSTGIGDTAFFGPEPEFFVFDDVKWHADMSGAGYSINSEEAAWSSSAHYDDGNTGHRPRVKGGYFPVPPVDSLHDIRAAMCSAMEQMGLDVEVHHHEVGTAGQCEIGIRFNTLVKKADEVQILKYCVHNVAHAYGKTATFMPKPLVGDNGSGMHVHQSVAKDGDNTFAGDGYSGLSETALYYIGGIIKHARALNAFANASTNSYKRLVPGFEAPVMLAYSARNRSASIRIPYEPSPRGKRVEVRFPDPTANPYLAFAAMLMAGLDGIQNKIHPGEAADKDLYDLPAEEAKAIPTVASSLEMALDALDQDRDFLTRGEVFTDDMIDAYIDLKREEIQRLDMTTHPVEFDMYYSV

SEQ ID NO: 26823 - protein, 508 aa, Haloarcula marismortui ATCC 43049
MSSDSKQQSATERKSAIKKRHEQAANEVLPDRRELYIGGEWVQSSGGETFETIDPTTGETLAEVQAGTAEDIDSAVAAAWNAYDETYSELSTGERQAMLDGIADAIAERSEEFAKLESLDNGKPITEARIDIDLVIDHFRYFAGLARSGEGRTIETDDSRHVQTLREPYGVVGQIIPWNFPLLMAAWKLAPALSAGNTVVLKPAEETPLSILKLMEITEDVIPDGVVNVVTGFGPEAGEPLSKHPDIRKLAFTGSTEIGSKVMQSAAESITDVTLELGGKSPLVVFPDADLEQAVQTTITSIFFNTGECCCAGSRLFVHEDIKDEFLDELAAAAEDLTVDDPLLESTDLGPKVTAEQVERTLGYIEEAEREGAAFVTGGSQPDDEALSDGCFVAPTLIDEIDHDSKAVQEEIFGPVQEVFSWSEYDEMIELANDVDYGLAAGVLTEDLSKAHQCAKDIEAGNIWVNTYNDFPAGQPFGGYKQSGIGREIGQETIDHYTQTKTVNISLD

SEQ ID NO: 26824 - protein, 209 aa, Glycine max
MEMEASPSPSPSPKQVVARKLWNIVRIVFLMLRKGISKSKLAADFNLNLSFKRGKLAATKAIANTILHRSQNDDAVYPRDYEFSCSNSPALFHVIKRSTNKHRHHHHRCTTTTKFPHHDDVSTVQKVLEILNNNKVEASPLPGFGKSPIGRKLIRITDSPFPLKDEEGGDDNQVDVAAEEFIKRFYKDLNLQQKMAAIDSPYHYNLWDR

SEQ ID NO: 26825 - protein, 366 aa, Cupriavidus necator
MTAMMKAAVFVEPGRIELADKPIPDIGPNDALVRITTTTICGTDVHILKGEYPVAKGLTVGHEPVGIIEKLGSAVTGYREGQRVIAGAICPNFNSYAAQDGVASQDGSYLMASGQCGCHGYKATAGWRFGNMIDGTQAEYVLVPDAQANLTPIPDGLTDEQVLMCPDIMSTGFKGAENANIRIGHTVAVFAQGPIGLCATAGARLCGATTIIAIDGNDHRLEIARKMGADVVLNFRNCDVVDEVMKLTGGRGVDASIEALGTQATFEQSLRVLKPGGTLSSLGVYSSDLTIPLSAFAAGLGDHKINTALCPGGKERMRRLINVIESGRVDLGALVTHQYRLDDIVAAYDLFANQRDGVLKIAIKPH

SEQ ID NO: 26826 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCQSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 26827 - protein, 198 aa, Nostoc sp. PCC 7120
MSFSPQLVNLGNYLAGEFDNREQALGEPIWFVHLRLWQRPVDLFSDDSITLFAEQANIVNLDRPYRQRILRLMPAPDSETGLYVQYYMPKNPSALIGAGRHPDLLKTLTPQQLELLPGCVLSVSQQTVAPNSYQFTASPLPNTCCTFSYLENTVQVSLGFAVTETELHTYDKGIDQETGKATWGAIVGPYRYTKREQY

SEQ ID NO: 26828 - protein, 351 aa, Clostridium beijerinckii
MKGFAMLGINKLGWIEKERPVAGSYDAIVRPLAVSPCTSDIHTVFEGALGDRKNMILGHEAVGEVVEVGSEVKDFKPGDRVIVPCTTPDWRSLEVQAGFQQHSNGMLAGWKFSNFKDGVFGEYFHVNDADMNLAILPKDMPLENAVMITDMMTSGFHGAELADIQMGSSVVVIGIGAVGLMGIAGAKLRGAGRIIGVGSRPICVEAAKFYGATDILNYKNGHIVDQVMKLTNGEGVDRVIMAGGGSETLSQAVSMVKPGGIISNINYHGSGDALLIPRVEWGCGMAHKTIKGGLCPGGRLRAEMLRDMVVYNRVDLSKLVTHVYHGFDHIEEALLLMKDKPKDLIKAVVIL

SEQ ID NO: 26829 - protein, 420 aa, Shewanella oneidensis MR-1
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDDMRILGFEEKPQLPKHCPGNPEKCLASMGNYVFNTEFLFEQLKKDAQNAESDRDFGKDIIPSIIEKHKVFAYPFKSAFPNEQAYWRDVGTLDSFWLANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 26830 - protein, 431 aa, Prochlorococcus marinus str. MIT 9301
MKRVLAIILGGGKGSRLYPLTKMRAKPAVPLAGKYRLIDIPISNCINSGIKKMYVLTQFNSASLNRHIGRTYNLNGPFGQGFVEVLAAQQTPDSPKWFEGTADAVRKYQWLFQEWDVDEYLILSGDQLYRMDYSLFVQHHRDNGADLTVAALPVDEAQAEGFGLMRTDDLGNIKEFSEKPTGEKLKAMAVDTSKFGLSKESAAEKPYLASMGIYVFSRNTLFDLLNKFPNYTDFGKDIIPEALNRGDTLKSYVFDDYWEDIGTIGAFFESNLALTEQPKPPFSFYDEKFPIYTRPRFLPPSKLVDAQITDSIVCEGTILKSCSILHCVLGVRSRIESDSVLEDTLVMGADFFESPEERFELRKGGGTPLGVGEGTTVKRAILDKNTRIGDNVVIINKDRVEEADKPELGFYIRNGIVVVVKNATIANGTVI

SEQ ID NO: 26831 - protein, 409 aa, Bartonella quintana str. Toulouse
MAVSYDFRPISVCRARESNNVVVKKRSKRSLIGLSQNEMAEALKAIGVPEQQTRMRVRQLWHWLYVRGVSNFDEILNISKPIREMLKNHFSIARPEIVGEQISKDGTRKWLLRFPAREDGRPVEIETVYIPEEGRGTLCLSSQVGCTLTCSFCYTGTQVLVRNLTAEEILAQLLVARDCLGDFPNRTTPDGAIVPVEGRKITNIVMMGMGEPLYNFEVVKKALLIASDGDGLSLSKRRITLSTSGVVPEIVRAGEEIGVMLAVSLHAVHDTLRDMLVPINKKYPLALLIDACRNYPGLSNAKRITFEYVMLKGINDSLDDAKRLIQLLKGIPAKINLIPFNPWPGSNYQCSDWEQIERFADVVNQAGYASPIRIPRGRDILAACGQLKSASERLRKSGRLQIEYAVGNK

SEQ ID NO: 26832 - protein, 295 aa, Photobacterium profundum SS9
MDMFSGSMVALITPLGEAGEVDYASLANLVEYHIAAGTDAIVAVGTSGESATLTVDEHVKVVLKTLEYAKGRIQVLAGTGANATHEAIIFSKLFSGTGVAGCLTVTPYYNKPTQEGLYQHYKAIAEATDLPQLLYNVPGRTAVDLLPETVARLAKFENIVGIKDATGDLSRVKKTRELCGEDFIQLSGDDATGLDFVAQGGHGVISVTANIAAADMATMFKLALSGQFEAAQKINARLMPLHRDLFVESNPIPVKWAAHQLGLIKHGYLRLPLTELSESAHPVVLQALKDANVLL

SEQ ID NO: 26833 - protein, 394 aa, Bacteroides thetaiotaomicron VPI-5482
MDSNNLTPLRKGVVGVQFLFVAFGATVLVPLLVGLDPSTALFTAGIGTLIFHAVTRGKVPIFLGSSFAFIAPIIKATELYGLAGTLSGMVGVALVYFVMSALVKWQGVRVIERLFPPVVIGPVIILIGLSLAGTGVNMAKENWVLALLSLVTAVVVSMKAKGLLKLIPIFCGIIVGYLAAWLFYDLDLSGVRDAAWIGLPQFVFPKFSWEPILFMIPVAIAPVIEHIGDVYVVNTVTGKDFVKDPGLHRTLLGDGLACCFAGLVGGPPVTTYSEVTGAMSLTKITNPQVIRIAAISAILFSVVGKISALLKSIPSAVLGGIMLLLFGTIACAGIGNLVNNCIDLSRTRNIIIVSLTLTVGIGGAVLTWGDFSLSGIGLAALVGVLLNLILPKDD

SEQ ID NO: 26834 - protein, 306 aa, Haloarcula marismortui ATCC 43049
MTAIDFHGVFPAMCTPFHQDGSIDFETLRDDAQRLESAGVDGLVPVGSTGESATLSHDEHIEVVEAVIDAVDDVPVIAGSGSNNTKEALELSRRSAEAGADALLLISPYYNKPEQQGFIDHYTTLADAVDLPQIVYNVPSRTGQNIEPDTAAELASHPNIRAYKAASGDMNQISEIIERTRDEDFAVLSGDDGMTLPMLSVGGTGCISVSANIEPERTCAMVGAALSGDFERAQAIHHELGPLFRAMFVETNPIPVKEAMRIRGYGPAHLRSPLTRLSDEHLDHLRDVLATLETEDLEDEYAEAER

SEQ ID NO: 26835 - protein, 232 aa, Triticum aestivum
  misc_feature (46)..(46): Xaa can be any naturally occurring amino acid
  unsure (1)..(232): unsure at all Xaa locations
AYLGDTIEQVCTKKQAGTGPEFPGYRRPTRPGNPAGAADPFRRKFXDKEEYLERARQRERDEKDEARRGKDRGPPVQRQPLKHRDYEVDLESRLGKTQVVTPVAPLSQQAGYYCSVCECVVKDSANYLDHINGKKHQRALGMSMRVERASLEQVQKRFEALKKRKDPASFSEQDLDERIWKQQQEEEEKKRQRREKKKEKKKEQAGQNEPEDIDPDVAAMMGFGGFGTSSKK

SEQ ID NO: 26836 - protein, 173 aa, Brassica napus
  misc_feature (140)..(140): Xaa can be any naturally occurring amino acid
  unsure (1)..(173): unsure at all Xaa locations
WERPQNYLLSCGIKTIEELRHSLLHTRVELEQTIRVAQEELNAKDSHIMQLKDLLNKTIKEKDEAQKRYKKLLLHKNIILQHQTVDEQDPHISGLLSSDGEESIVSSFEPPMQLELDFPDMTLPEKGKLLNAVLKAGPLXLQTLLLAGQLPQWRYPPPAARGISKFPRVIIPR

SEQ ID NO: 26837 - protein, 396 aa, Thermobifida fusca YX
MERIVIVGGGLAASRTCEQLRSRGYEGELVMLCAEPHPPYDRPPLSKAALLEEEHDSTFPTDYAQLSVDVRLGVAATGLVPDARTVQTTDGELSYDALVIATGASPIRLPGPGRQFTVRTVEDAAQLRAELKPGQRVVLVGASWISAEVATAALRRGCSVTCIEAGPAPLSAALGADVGQRFLPWWSEVDLRLDTGVAEVTETGVQLANGEQVDADVVVTGIGVRPAVDWLSGSGIALDTGVVVDEHLRTSLPGIYALGDVAVRWSPRWNTRIRVEHWDDAREAARTLAGVLLHDPSSQDPLPVHDPVPYFWSDQFGHKIQYVGHHSPEDTLVIRGDGTPQWAAAWVDAEGRLTAHLSIDAPRLMIDARMAIAAGARPDEAALRDPQAKLAPPRGR

SEQ ID NO: 26838 - protein, 352 aa, Arabidopsis thaliana
MAIRSLPSSSGCSNSSSSSSYSLASTSLSNRLETIFRKASELCTLCDIEACVIYYGPDGELKTWPPEREKVEDIALRYSQLNEALRRKKSVTLYDFLNKKKNKTNLEKKAKIKDNDLKRLNVNVLKYPIADHYSPDQISQLIQSLEPHVSKVRERIRFVESQKHKETKPDHQSLASSSLNNQTQSLNPSQFSLFMYNHGDNILSQIPVSASNFNQDYFSALLEQSELKSQIMKQEVCGYEQNMCMSNNGDATLSQIPLSASNFNQEFSALLQEESGLMQQELCNYDQNMFMNNNNFQHSFVSNTQDHSAPAVQESVNNNYGLMPHVPCGYDQNLFTSDITNNNLLIDNSMFL

SEQ ID NO: 26839 - protein, 54 aa, Zea mays
RIAIIDKNARIGENVKIINVDNIQEASRETDGYFIKSGIVTVIKDALIPSGTVI

SEQ ID NO: 26840 - protein, 385 aa, Caulobacter crescentus CB15
MVHPVFDNLPTTIFERMSGLARQYGAINLGQGFPDDQGPLPVREAAARALIEGSNQYPPMRGLPELRAAVAGHYGRTQDLTLDPDTEIVVTSGATEALAAAFTSLISPGDEVVLFQPLYDAYLPLVRRAGGVPRLVKLSPPHWRFERAMLEAAFSNRTRMVVLNSPLNPAGVVAPDEDLALLAEVCVRHDVVAVCDEVWEAVVFDGRRHRPLMSFPGMRERTVKIGSAGKLFGMTGWKVGFLCAAPPLARALAAAHQFLTFTTPPNLQAGVAWGLDNHRAWFDDMPANLQRSRDRLTAGLRDAGYVVLESQGTYFLNVDLAASGIALDDVTFCERCVTEHGVAAIPVSAFFAEDPVTTVVRLCFAKADATLDEAVRRLAAAKAAL

SEQ ID NO: 26841 - protein, 412 aa, Zea mays
  misc_feature (69)..(69): Xaa can be any naturally occurring amino acid
  unsure (1)..(412): unsure at all Xaa locations
MNALAATTRNFRRASKLLGLDSKLEQSLLIPFREIKVECTIPKDDGSLATFVGFRVQHDNARGPMKGGXIRYHNEVDPDEVNALAQLMTWKTAVAAVPYGGAKGGIGCSPGELSRSELERLTRVFTQKIHDLIGTHTDVPAPDMGTNAQTMAWMLDEYSKFHGHSPAVVTGKPIDLGGSLGRDAATGRGVMYATEALLAEYGKCISGSTFVIQGFGNVGSWAARLIHEKGGKIIAIGDVTGSIRNTAGIDIPALVKHRNEGHAMKDFDGAEVLDSTELLVHDCDVLVPCALGGVLNKDNAPDVKAKFVIEAANHPTDPEADEILAKKGVVVLPDIYANSGGVVVSYFEWVQNIQGFMWDEEKVNDELEKYMSSAFQHMKAMCKSLDCDLRMGAFTLGVNRVARATLLRGWEA

SEQ ID NO: 26842 - protein, 203 aa, Schizosaccharomyces pombe 972h-
MSAFKKSGSKSETSKKLVVVGDGGCGKTCLLIVFSSGTFPERYVPTVFENYITDITYGPNSKVIELALWDTAGQEEYDRLRPLSYPNSNVILLCFSIDCPASLNNVTEKWYPEVQHFCPRTPIVLVGLKADLRKDRNATEVLRTQGLTPVTYQQAQSVALSMNAPYVECSAKENTGVNEVFQLAVGLTIKKSFSFSKKSCVIL

SEQ ID NO: 26843 - protein, 270 aa, Oryza sativa (japonica cultivar-group)
GEEEEGRQVQEVVAHVYDVASSGSSEGGGGGTAILHVNRFFKDAIGLGGIFHTAIQVYGDEEWSFGYCENGTGVFSCPPCKNPMYTYRESIVLGKTTCSIFTVNQILRELSWKWPGGSYELLSRNCNHFCNTFCEKLDVPKLPAWVNRFANAGDAALEVAENTAEKLKQAKKDIAGACKAATTYLTGASSSSPSNADDSGGSTNSSLFEGTWLRSIIGISMKPSRSLMCSDSSDSSDDEKSEDERESDCQQPSGDQIEEKKDATQEQAGK

SEQ ID NO: 26844 - protein, 417 aa, Photobacterium profundum SS9
MMQVLQGAQMLFVAFGALVLVPLLTGLDPNVALFGAGIGTLLFQVVTKRSVPIFLASSFAFIAPIMYGVQTWGIASTMGGLMTAGVVYVLMGVLIKVRGVGFIHKILPPVVVGPVIMVIGLGLAPAAVNMAVGKSGDGGIQLINGDTAIWISAASLITTIAFSVFAKGFFKLMPIMAGVVVGYCVSLGFGVVDFTPVVQASWLAMPNFTFPEFNINAILFMIPVAIAPAVEHVGDILAISNVTGKDYLKKPGLHRTIAGDGIATIAASMFGAPPNTTYSEVTGAVMLTKAFNPIIMTWAAITAIVLAFVGKLGAILQTIPVPVMGGIMILLFGSIATVGLNTLIKNQVDLHKARNLVIVAVTLVFGIGGMAFGIGEFSLQGISLCGIVAIVLNLILPDDLGESHVVDNAQMEDTQNN

SEQ ID NO: 26845 - protein, 610 aa, Caulobacter crescentus CB15
MSMRNIAIIAHVDHGKTTLVDQLLAQSGVFRANEATTERAMDSNDQERERGITILAKCTSVLWNGEAGETRINIIDTPGHADFGGEVERILGMVDGCVLLVDAEEGVMPQTKFVLTKALKMGLRPILCINKVDRAHADPDRVHNAAFDLFAAIGATDEQLDFPHIYASGRAGWATLDLNQPSDNLAPLFDLIVRHVPEPKQIAKKDEPFQILSVLIESDPFLGRLLTGRIESGKAVPGMAIKALDRDGKEIERGRITKVLAFRGLKRQPIDDGAEAGDIVAIAGLSKATVADTLCALDVNEALPAQPIDPPTISMTVSVNDSPLAGREGDKVQSRVIRDRLLKEAESNVAIRVTETSERDAYEVAGRGELQLGVLIENMRREGFEVSISRPRVVYQTGENGERLEPMEDVMIDVDDEFTGIVIEKLSARKAELKDMGPSGAGKTRITLLSPSRSLIGYQGEFLTDTRGSGVLNRVFSHYEPHKGPIDQQRKGVLVSNSDGETAAYALWNLEERGVMFVGAGEKTYQGMIIGENSRSDDLDVNPMKAKQLTNVRASGKDESIRLTPPRRMTLEQAIAYIEDDELVEVTPKNIRLRKQVLNPSFRKKRTKED

SEQ ID NO: 26846 - protein, 528 aa, Bartonella quintana str. Toulouse
MVQISTYFQLMRAVWVLAREGVLSALPGDDLRGFPTLCHRIAGILARRKTKKKRRSENISHAINKLGPSYIKLGQFLATRPDIVGRDIAKDLVQLQDRVQTFSCSAAIDQIESSLGRSINDLFVNFYPPIAAASIAQVHPAEYYDEAGHKKKCAVKVIRPDIRTRFAKDLRSFYLVAYLQERYMPASRRLRPVCVVDTLAQTTRIEMDLRLEAAAISEMAENIQHDTGFRVPQIDWERTGRNVLTMEWIDGIRISEIAALKEAGFDLKVLAVTLIQSFLHHTLRDGFFHADMHPGNLFVDQKGCIVAVDLGITGRLGKKEKHFLAEILYGFITRDYHRVARAHFEAGYVPPHHNIESFAQANRAIGEPIHGQSAQSISMAKLLTLLFEVTELFDMQTRPELLLLQKTMVVVEGVARTLDPNFNMWKASEPVVKEWISKNLGPAGMAKDFSEGAQAFLSLARKTPQLIQNFQRMEENLNQMIERGFHLSPATLKQFAVEQSHSNRYSRYSLFIIALCCGCLIFYLFALF

SEQ ID NO: 26847 - protein, 763 aa, Ehrlichia canis str. Jake
MLDLENSSFDGKKKEALEFHCKDSKPGKVSLLPTKPLLTQRDLSLAYSPGVAVPCLEIAKNPDLIYEYTARGNYVAVISNGTAVLGLGNIGPLASKPVMEGKAVLFKRFADIDAVDIEVDTSDVDEFINAVKYLGLSWGGINLEDIKAPECFIIEKKLSEIMDIPVFHDDQHGTAIIVSAGLINALDITGKNFKNVKIVINGAGAAGIACLEMIKLIGVPADNITLCDQNGVIYKGRQLGMNEWKEKHAIETKDRSLKDALVMADVFLGLSVKDVLSKDMLLSMNKDPVIFALANPDPEINPDIAREVRPDAIIATGRSDYNNQINNVMGFPYIFRGALDVRAKSVNNEMKVAAANAIAMLAREYVSDEVSDAYGGRKMNYGKDYIIPTPFDPRLITIVSPAVARAAIESGVARKKIEDWDEYTKQLASRLSSTSNILNMMYSAVKRDPKRVIFSEGEEEKVIKAAVQWRNQGYGLPILVGRIDKVQEAFERLGIKNIQGIEIANAAVSKRNDEYTDYLYKKLQREGYLYRSCVRDVKTDRNVFAACMLACGDGDVLITGLTRSYSASISDVQKVIGSQGVVFGLSVIVMKERTIFVADTAIHESPTPEQIAQIAIQASIQARKMGHEPRVGFVSSSNFGSHCQEDARKMRKAVEILDSCNVDFEYDGEMSVDTALSSELLTLYPFCRLTGAANILVMPTLHSANISSKLLQQAVGVSVIGPVLIGMEKPVQIVQMSSSVSEILNLAVLAPSVNSNVQSCDSI

SEQ ID NO: 26848 - protein, 481 aa, Glycine max
  misc_feature (120)..(120): Xaa can be any naturally occurring amino acid
  unsure (1)..(481): unsure at all Xaa locations
MAAASRRLRDLQSEAGNKICVDCSQKNPQWASVSYGVFMCLECSGKHRGLGVHISFVRSVTMDSWSDIQIKKMEAGGNDKLNAFLAQYSIPKETDIVTKYNTNAASVYRDRIQAIAEGRXWRDPPVLKENLSAAGKGKPPLTQTRRNNNEGGWDDWGNEASPRSKSKSTGDFRNLNGGGGAPARSRSTEDIYTRTQLEASAAKKEDFFARKIAENESRPEGLPPSQGGKYVGFGSSPQPPQRRNEAQNDYFSVVSQGIGKLSLVAASAANVVQAGTKEFTSKVKEGGYDHKVNETVNVVTQKTSEIGQRTWGIMKGVMAMASQKIEEYTKDDPNWKNDNWQRNENDRNGYYQDFNQENKGWNSSIGREQSSSGQFKTQSSSSWDDWDHNDSRKEVPAKGSSHSSGGLFSTHNSSSWDDWEHRDSRKEEPAKGSAPHNNEDWAGWDNAKDDGFDNYYEGASNKKGVGHNGKSDGTWTEGGFL

SEQ ID NO: 26849 - protein, 311 aa, Candidatus Tremblaya princeps
MVSSALQFLSQHSELSMDSARFLEALRFRPTHATTNPSLILSACQNNEYNSLVNETIRLHRNEGYRNIADHIRLRFCTELLDRIPGMVSVEIDACCAFNVDASIAHARRIVQLCRPTDARDRILVKIPATWQGVQAAAALRAEGVQCNMTLVFSMLQALVCARNGAYLISPFVGRLSDRMPAMQGSSATQDQGVALALRIYSRLRQEGHATRVMAASFRGEQQVIMASACGMVTVGEHIMRRLAAMRASAMPKPCQQFSEAMQHCPTPRDLHAFERALAQNRTAWLELKHGIEAFACNETQLELLIARRLP

SEQ ID NO: 26850 - protein, 250 aa, Brassica napus
  misc_feature (197)..(197): Xaa can be any naturally occurring amino acid
  misc_feature (210)..(210): Xaa can be any naturally occurring amino acid
  misc_feature (216)..(216): Xaa can be any naturally occurring amino acid
  misc_feature (242)..(242): Xaa can be any naturally occurring amino acid
  unsure (1)..(250): unsure at all Xaa locations
MAMLEIMSIIGTIMVLMLLLLIILFVCKPWRFLPRSPFSTFKVGDLHRPLVSHHDESLIQGQTSEVSREFDLEEACFQNEELLRSSLTEEHIYKRRLPSSSAHLNQGESFDPQIISEPPDNALVGETLKHPAEKLSFQEDILDLEKDILSELPPRVVVKDQRSWLSLEVISGPSVGLQYAVHSTNTSKLPVKLGRVXPSDMILKDSEVSXGKHAQXITWNSTKLEWELADMGSPKMEPLLTXPVSHPDLG

SEQ ID NO: 26851 - protein, 580 aa, Oryza sativa (indica cultivar-group)
MSPAPSSSLATAGHGKTKSGRSSSSAVRPALLAIAVSVMVVLLMAVLFGARWTPSGGHGGGADTSWVSAGARVVLNAVSSQQGADPVVKVAQPHDRLLGGLLSPDFNDTSCLSRYRASLYRRRSLHVLSSHLVSALRRYESLHRLCGPGTSAYERAVARLRSPSSSNTTSDAPSECRYLVWTPHAGLGNRMLSITSAFLYALLTGRVLLFHRSGDDMKDLFCEPFPGATWVLPEKDFPIRGMERFGIRTRESLGNALGRGEGGRDPPPPWMYVHLRHDYTRPGASDRLFFCDDGQDALRRVGWVVLLSDNYFVPGLFLIPRYERELSRMFPRRDAVFHHLGRFLFHPSNTVWGMVMRYHGSYLAKAEERVGVQVRTFSWAPISTDELYGQIVSCAQGENILPRVRESSSGSDNATAIPGSGRQQQQRPARRKAVLVVSLHGEYYERIRDMYYEHGAAGGDAVSVFQPTHLGGQRSEERMHNQKALAEMMLLSFSDVALTSAASTFGYVSHGLAGLRPWVLMVPVRKKAPNPPCRLAATVEPCFHTPPHYDCQARTKGDNGKTVRHVRHCEDLKDGVQLVD

SEQ ID NO: 26852 - protein, 337 aa, Spinacia oleracea
KLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDAAHRDLRRARAACLNIVPTSTGAAKAVALVLPNLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQA

SEQ ID NO: 26853 - protein, 277 aa, Thermobifida fusca YX
MCRGGGAHTDDDTTPLRKDATMRRFEGRIAAIVGGGSGMGRAISHRLASEGATVYVADLSEESAKKVAEEITAQGGKAVPVQVDATNNDSLRALFDRIRSDHGVLHVLHAQVGMPGPGGIETSDEEWQKNIDVNIKSAYYTCTLGYDLLKSANGKGSITMTSSTSALVGSPFSPIYSLTKGSLVPFARALALKGAPDGIRVNVICPGTVQTPMLAQFFGREPGADVSELTKDFIKNIPLGRGAQPEEIASVIAFLASDDASYVTGVTIPVDGGLTAK

SEQ ID NO: 26854 - protein, 480 aa, Pseudomonas fluorescens Pf-5
MSDNNKRDDDMQSQDSGLRRGLTARHIRFMALGSAIGTGLFYGSASAIQMAGPAVLLAYLIGGAAVFMVMRALGEMAVHNPVSGSFGHYASQYLGPLPGFILGWTYAFEMLIVCLADVTAFGIYMGFWFPEVARWIWVLGIVLFIGGLNLCNVKVFGEMEFWLSLLKVGAIVAMILGGLGIMLFGISSAAQDQATGAANLWAHGGFMPNGISGVIASFAVVMFAFGGIEIIGVTAGEAQDPKRVIPKAINAVPLRILLFYVLTLFVLMSIFPWPQIGTQGSPFVQIFDSLGISSAATILNIVVISAAVSAINSDIFGAGRMMYGLARQGQAPKGFAQVSKHGVPWMTVVVMAVTLLIGVVLNYLIPENIFLLIASLATFATVWVWLMILLTHVAMRRSMTAEQVAQLQFKVPFWPWAPAAAIAFMLFIFGVLGYFPKTQGALIVGVVWIALLVVAYMLWVKPMAGQAQAIMSDAPLPTDH

SEQ ID NO: 26855 - protein, 357 aa, Prochlorococcus marinus str. MIT 9301
MKKYKIVLLSGDGIGPEISEVSKKVLKKLSKNHNFDIEIIEKLFGGIAYEKYGTPAPDETLDQCKKSDAVLLACVGDIKYDSLARELRPESGLLKLRSALNLFANIRPVKIRKSLLDASSLKKEIVEHVDLIVVRELIGGIYFGKPRGHITNTKIPKAFNTMVYDSNEIERITEIAIKIANQRNKKICSVDKSNVLEVSQLWRDTVLNITSKDKNISLSNMYVDNAAMQLVRDPGQFDVILTSNLFGDILSDLAAMLTGSIGMLPSASLNNNGPGVFEPVHGSAPDIAGKNIANPIAMLLSASMMLKIGLNEEEAAENLETAIDKVLSKGFRTADLADGSTEVLSCSEIGDKIINEI

SEQ ID NO: 26856 - protein, 405 aa, Oryza sativa (indica cultivar-group)
MQRNGVMECSVCHSKVVAPSPRSVSRAYDKHRSKISSKYRALNFLLVSGDCILVGLQPILVFMSKVDGKFQFSPISVNFLTEVTKVIFAIVMLIIQSRKQKVGEKPLLSLSTFVQAARNNALLAVPALLYAINNYLKFIMQLYFSPATVKMLSNLKVLVIAILLKFIMRRKFSIIQWEALALLLIGISVNQLSSIPDGTKSFGLAVTTIAYIYTLIFVTVPSLASVYNEYALKSQFDTSIYLQNLFLYGYGAIFNFLGILGTVIFQGPESFDILQGHSRATMFLICNNAAQGILSSFFFKYADTILKKYSSTVATIFTGLASAAFLGHTLTVNFLLGISIVFISMHQFFSPLAKVKDDKPAGALEPEDAQNHRSSDSSFVNMTAGAADDASHLTSTDERKPLLPI

SEQ ID NO: 26857 - protein, 328 aa, Triticum aestivum
RHWFYCINNKERSCLETGEVLIRVAASGICGTDLHICKGETPQATKNVVVGHEFCGYVEEIHPETMAVVKVGDLVAIDPNMPCNQCTFCRNKKYHLCLNLFCIGVTVDGGMSQYVAVPARAAITVPAHVPPEVACLSEPLSCVVHAVDKGHVKSGDSVLVIGAGPIGLMTTALVNASGGKVTVIEPNEFRRKEALEIFGAAAAYGPGELGPVNGALGEGYDVVFECVGRPNTADDAVKFAKAGGTVVWVGVAKVEDRVSISPYDVYRRELTITSTFTNPYGIDRAVKILAEGRVNWRALVSHSFKLSEFDKAWEVFTAGTGLKVVVKP

SEQ ID NO: 26858 - protein, 380 aa, Fragaria x ananassa
MSSTEGKVICCRAAVAWEAGKPLVIEEVEVAPPQANVVRVKILYTSLCHTDVYFWEAKGQNPLFPRIYGHEAGGIVESVGEGVTDLKAGDHVLPVFTGECKECDHCKSEESNMCDLLRINTDRGVMLNDGKSRFSIKGKPIYHFVGTSTFSVYTVTHVGCLAKINPQSPLDKVCILSCGISTGLGATLNVRKPKKGSTVAVFGLGAVGLAAAEGARMAGASRIIGVDLNSNRFEEAKKFGITEFVNPKDHKKPVQEVIAELTNGGVDRSIECTGNIQAMIPAFECVHDGWGVAVLVGVPHKDAVFTTHPMNFLNERTLKGTFFGNYKPRTDIPSVVEKYMNKELEVDKFITHQLPFSQINKAFDYMLKGEGIRCIITMEE

SEQ ID NO: 26859 - protein, 425 aa, Sulfolobus solfataricus P2
MSKENIFDALKSGKIDYVRVEFVDILGNTKGRSLRRAEFENVINDNKGVDYPESLALMDYKDRPIKSRYEDIIAIPDLNTFVAIPYLERTARVLSFLAQPDGLPYPYCSRSILNKAIEKLKEAGYTLQVSFEPTFYLLNSALNPADYSKAFSLEGLLEQQNFLKLLIKYLEEIDIKVETINKHYGPGQYEVKLSQKPVLEAADSLISSREVIRDTAKMNNVIATFMPKPFKDYPSSSMDITLSLQTVDGKDIMYDPNDSKGIGLSKIAYNFISGILEHLPSILSIAAPTVNSYKRFKEVVTPNMPGIGSERHYIVRLPSYYKDTHQVEFRLADPLANPYILLASMIYAGLDGIERNLMANVNEYYGTLPQTLKESLSRLENDTYMKYNLGQDLISIYINIKNIEIEEYESQITEWERDYYLKAGW

SEQ ID NO: 26860 - protein, 306 aa, Oryza sativa (japonica cultivar-group)
MDSEHWISSLAAAKRFYAAQLGHVDDMAGIGMEEVEMEMEDDGEGMELELEMQLEEATWPDVACPYCYEDHDIASLCAHLEEDHPYEPHTSAYFCKQATGVDFAMAQNNLEKLMMPCPICFEKITRDMLNHITMQHGYLFKSGRRMRRFDIPESQALSLLSRDLRDAQLQALLGGGHRQRRSNTTATNISADPLLSSFGLGFSTLDSEERSKAPVPIPDDTSIHKDTPAQPWESRNIGLYKHKSCYMLYNAKANAEAPFISNQLSKNVSRFFMKTDKIPRKRFTITLGVQNYYLTTMKVYVQVECP

SEQ ID NO: 26861 - protein, 445 aa, Porphyromonas gingivalis W83
MKTQEIMTMLEAKHPGESEFLQAVKEVLLSVEEVYNQHPEFEKNGIIERIVEPDRVFTFRVPWVDDQGKVQVNIGYRVQFNNAIGPYKGGIRFHPSVNLSILKFLGFEQMFKNALTTLPMGGGKGGADFSPKGKSEAEIMRFCQSFMTELWRNIGPDTDIPAGDIGVGGREVGYMFGMYKKLAREHTGTLTGKGFEFGGSRLRPESTGFGAVYFVQNMCKQNGVDYKGKTLAISGFGNVAWGVAQKATELGIKVVTISGPDGYVYDPDGINTPEKFRCMLDLRDSGNDVVSDYVKRFPNAQFFPGKKPWEQKVDFAMPCATQNEMNLEDAKTLHKNGVTLVAETSNMGCTAEASEYYVANKMLFAPGKAVNAGGVSCSGLEMTQNAMHLVWTNEEVDKWLHQIMQDIHEQCVTYGKDGNYIDYVKGANIAGFMKVAKAMVAQGVC

SEQ ID NO: 26862 - protein, 339 aa, Debaryomyces hansenii CBS767
MGQLLSHPIEDKTMEHKSYDTITYCIGLMQGYRMSMEDAHNVKVNEDESLAVFGVFDGHGGKTCAEVVSDKLPTMVFRELSSLLKNGNGDLASYMKVLKDSFFRIDRDLTNEDSSNCGTTAIIASIIANEYIIVSNAGDSRCIMSLEGGAPKTLSFDHKPSTMGERVRIENSGGYVVNGRVNEILALSRAFGDFKFKLPYMELLNNQNKYIAANKKYFKHELIHLPPELFLVSVEPDVVVYDLKSLKQPEFVVLACDGIWDCYTNTKLIKIIRDKLSLDWKIHHITEFILNDCVGMANNVTGIGFDNMTIIIVAVHNNNNIDEWYTMMKERVLKEKGLL

SEQ ID NO: 26863 - protein, 347 aa, Leuconostoc mesenteroides subsp. mesenteroides ATCC 8293
MSEQRKAKAEDFDWDNLGFEYHDLPYRFRAYYKDGKWSEGGLETDSNIPVNEAATGLHYGQTIFEGLKVYRRKDGGANIFRPDRNAKRLQNSAARLMMAPVPEELFVRALKEVTKANQDFIPPYGTGATLYLRPFEFGGGPVVGVHPADNYVFEVYATPVGAYYKGGLTPTAYVTNHYDRAAHGGTGAAKAGGNYGASMLAGDEAHAAGYSDVVYLDPRLHENIEELGSANFFGITKDGRFLTPKSPSILPSVTKYSLLQVAEELGLKAEETTISINDLDQFAEAGAMGTAAVISPVGSITHNGNKHVFYSETEVGPWTQKLYDRLTAIQYGDQEGPEGWAVDVPLD

SEQ ID NO: 26864 - protein, 352 aa, Thermoanaerobacter brockii
MKGFAMLSIGKVGWIEKEKPAPGPFDAIVRPLAVAPCTSDIHTVFEGAIGERHNMILGHEAVGEVVEVGSEVKDFKPGDRVVVPAITPDWRTSEVQRGYHQHSGGMLAGWKFSNVKDGVFGEFFHVNDADMNLAHLPKEIPLEAAVMIPDMMTTGFHGAELADIELGATVAVLGIGPVGLMAVAGAKLRGAGRIIAVGSRPVCVDAAKYYGATDIVNYKDGPIESQIMNLTEGKGVDAAIIAGGNADIMATAVKIVKPGGTIANVNYFGEGEVLPVPRLEWGCGMAHKTIKGGLCPGGRLRMERLIDLVFYKRVDPSKLVTHVFRGFDNIEKAFMLMKDKPKDLIKPVVILA

SEQ ID NO: 26865 - protein, 110 aa, Pseudomonas fluorescens Pf-5
MSDTLTRLAQVLEERKDAAADSSYVASLYHKGLNKILEKVGEESVETIIAAKDAAISGDCSDVIYETADLWFHTLVMLAQLGQHPQAVLDELDRRFGLSGHAEKASRPSA

SEQ ID NO: 26866 - protein, 204 aa, Triticum aestivum
  misc_feature (197)..(197): Xaa can be any naturally occurring amino acid
  unsure (1)..(204): unsure at all Xaa locations
MPGGGEMPETKQIPKNKACLICIDGWGISPEEDHKGDAIYNAETPVMDKLEKEHPFTSIAAHGLAVGLPDGLMGNSEVGHLNIGAGRVVYQDIVRIDLTMKKKEFGQVENIKNAFERAKSTNGRLHFMGLVSDGGVHGHINHLVSLLEAARDAGVPKSFIHFFGDGRDTAPKSAAGYMKQLLESLDKLQYGKIADVXGRYYAMD

SEQ ID NO: 26867 - protein, 130 aa, Pseudomonas fluorescens Pf-5
MKDWLDQIKWDADGLVPAIAQDHKTGRVLMMAWMNREALSLTAAENRAIYWSRSRGKLWRKGEESGHVQKLHEMRLDCDADVIILMVEQIGDIACHTGRHSCFYRVYEDGEWKTVEPVLKDPHAIYSAGH

SEQ ID NO: 26868 - protein, 534 aa, Pseudomonas fluorescens Pf-5
MKLLAVRRLLRIQRVVIRYRLDDLLFDLPLPWFLLALRFALPWRWFPRKPLDLSRGARLRLALQDLGPIFIKFGQILSTRRDLLPEDIADELMLLQDRVPPFDSQKSVALIEAQLGKKISDVFSRFDIEPLASASVAQVHAAKLKTGEEVVVKVIRPGLKPIIAQDLAWLFILARAAEKLSADARLLHPVDVVSDYEKTIYDELDLLREAANASQLKRNFEGSPLLYVPQVYWDWCRPKVLVMERIYGIQVTDLATLADQRTDMKMLAERGVEIFFTQVFRDSFFHADMHPGNIFVSTVQPWSPQYIAIDCGIVGSLTPEDQDYLARNLFAFFKRDYRRVAQLHIDSGWVPAETKLNEFEAAIRTVCEPIFEKPLKDISFGQVLMRLFQTARRFNMEVQPQLVLLQKTLLNIEGLGRQLYPDLDLWNTAQPFLERWMRERVSPKAVLGNIHSQIEQLPHLANMTRDLLERMSQPHAADPPAPWHKRKDDWFLRLLGTAHLGGGAVLAAGGPLHELGHWPAGIMIAVGLYLIVRR

SEQ ID NO: 26869 - protein, 188 aa, Sulfolobus solfataricus P2
MKVGLVYYGGQYNHLILKNVKYLGADIEVIPPHKPVEELKKFDCVIFSGGPYSVSEEIQKMGNSPLYIKELKVPMLGICLGHQLIAYVLGGVVRRALNPEYGLTRINIFDEDTILKGFSQQLNVWESHNDEVVEPPSGFRVLASSANARVQAMANSSNSIFGVQFHPEVKHTERGIEIFKNFLGVCRK

SEQ ID NO: 26870 - protein, 92 aa, Oryza sativa (japonica cultivar-group)
MCPLRVILIFLSATIAGFFLIRGLNADPDLLHDDADADASESPRERAPVPLHSKVGSALKTGFWTMVDMASGKYLWRTLVSPPTKCESEKVQ

SEQ ID NO: 26871 - protein, 303 aa, Oryza sativa (japonica cultivar-group)
MAGIVEKEGETGHLTSPTAPTLTTPTNQAFVNIITVLMMVSLMEEEAMAMETMATTTTKRMSVAEVSLVEAVLFDIDGTMCVSDPFHHRAFSELLQALGYNSGVPITPEFGMAHMAGRSNHQIGSFLFPDWPQHRLDAFFADKEALFARYAAEGLREVAGLTDLCRWAAARGLKRAAVTNAPRANADLMISILGLSDFFQVIVAAADDCDLPKPSPEPYLRALSLLGASPRHTLVFEDSVVGVQAGVAAGMPVIAVAEEAREAKVVAAGASLVIRDYKDHKLWAALDKLQAAAAAQSNGQLGA

SEQ ID NO: 26872 - protein, 523 aa, Oryza sativa
  misc_feature (455)..(455): Xaa can be any naturally occurring amino acid
  unsure (1)..(523): unsure at all Xaa locations
MGCCGSSLRVGSHAPEKPPRRARPPPPPPQPHHPRRPSFTLNAHQAAASSSAASAAPAPAFAEFSLAELREATGGFAAANIVSESGEKAPNLAYRGRLQGAGGGGRAIAVKKFGKLAWPDPKQFAEEARGVGKLRHRRMANLIGYCCDGDERLLVAEFMPNDTLAKHLFHWENKAIEWAMRLRVAYNIAEALEYCSNEERPLYHDLNAYRVLFDENGDPRLSCFGLMKNSRDGKSYSTNLAYTPPEYLRNGRVTLESVVFSFGTILIDLLSGKRIPPTLALDMIRSRSIQAIMETNLEGKYSIEEATTLVDLASKCLQYEPRDRPDIKKLVSILQPLQTKSEVPSYVMLGVPKPEEVPKAPPAPQHPLSPMGEACSRMDLTAIHQILVSTHYRDDEGTNELSFQEWTQQMRDMLDARKRGDFAFRDKNFKQAIDCYTQFVDVGTMVSPTVYARRXACGHLMCDQPDAALRDAMQAQCVYPDWPTAFYMQAVALSKLNMQSDSLDMLNEASQLEEKRQKSIKGP

SEQ ID NO: 26873 - protein, 100 aa, Triticum aestivum
  misc_feature (66)..(66): Xaa can be any naturally occurring amino acid
  misc_feature (85)..(85): Xaa can be any naturally occurring amino acid
  misc_feature (90)..(90): Xaa can be any naturally occurring amino acid
  misc_feature (93)..(93): Xaa can be any naturally occurring amino acid
  unsure (1)..(100): unsure at all Xaa locations
MDPTDQSPEEVYSVWALPPEPVRDRFRRIMEGLRAAYGGPAFEPHVTVVGDFRGRRSEAVKVLRAXAASVQPYTARVTGVAVEVXLQCVXSFXPTPSGGN

SEQ ID NO: 26874 - protein, 183 aa, Glycine max
  misc_feature (2)..(4): Xaa can be any naturally occurring amino acid
  misc_feature (15)..(19): Xaa can be any naturally occurring amino acid
  misc_feature (23)..(25): Xaa can be any naturally occurring amino acid
  misc_feature (27)..(27): Xaa can be any naturally occurring amino acid
  misc_feature (46)..(46): Xaa can be any naturally occurring amino acid
  unsure (1)..(183): unsure at all Xaa locations
VXXXVLSCTLKHKIXXXXXLQTXXXKXQTTVKAVLVASLYREYGDXLKRMYRKNPTLSGEVIKVYQPSHEEHQKYNDNKHNMKAWIDMYLLSLSDELVTTSLSTFGYVAQGLGNLKPWLLYKLVNNETHFPPCERDFSSEPCYHFPPKHYCNGEPLKDIVSSFPYLRPCKDFRVGLKMVKDSI

SEQ ID NO: 26875 - protein, 491 aa, Ehrlichia canis str. Jake
MLHLQILLHSTIIIRFVSINKSMTKHEFLIIGSGPGGYIAAIRAAQLGYDVAIVEKENSLGGVCLNWGCIPTKSLLQSASVYHNIKKADIFGITVKDVKFDFNKIIERSRNVVEKLANGISGLMKKNNIKVYHGTAKLLGNATVEITDHSNKRISITSTHIVLATGSQAKNIPGIDFDNNIVWNAKNAMTPNKFPESILIIGSGAIGIEFASFYNTFGTQVTMVELKDNILPLEDHEVSKCMHNILSNKGIKIHTSSSITKLEKCNNYAKVQISDTIDLQVDNVILAVGIIPNSSNIGLENTKIKTDNAGFIITDKHCCTDEPGIYAIGDVAGFPCLAHKASHEAILCIENIAATENKIPQHKIHTINKNNIPSCIFSIPQIASIGLTEHQAKHQGYNFKVGKFNANCSGKAVAIDEVEGFVKVIIDKSTGELLGAHMIGAEVTEMINGYIIGKQVEITDQDITSAIFPHPTLSEMLHEAVLSSNNESLNS

SEQ ID NO: 26876 - protein, 390 aa, Synechococcus sp. WH 8102
MATLLDQLSAMTVVVADTGDLEAIRKFTPRDATTNPSLILAAAQIPAYQSLIDEALRSSRKLIGDAAPVEDVVHEALDEISVIFGKEILKIVPRRVSTEVDARLSYDTDATIEKGRKLIRLYNDAGISNDRVLIKIASTWEGIKAAEVLEKEGIHCNLTLLFGFGQAVACAEAGVTLVSPFVGRILDWYKADTGRDSYPGPEDPGVISVTRIFNYYKTYGYKTEVMGASFRNLDEITELAGCDLLTISPKLLDQLRESDASLSQKLDATNPSGGEEQIHVDRERFDAMMAADRMATDKLGEGIKGFSKAIETLEHQLAHRLAELEGGEAFRHAVQEIFMLNDMNGDGCITRDEWLGSDAVFDALDLDHDGRLTPEEVRKGFGAALTLTTA

SEQ ID NO: 26877 - protein, 484 aa, Haloarcula marismortui ATCC 43049
MSKSQTRSPEAELGLLDATMIGMGAMIGAGIFVLTGLAAEIAGPAAILVFALNGVVTAFTGLSYAELAASIPKSGGGYAFVREIFDDFASFIMGWMLWFAYMIAGALYALGFAPNFLELLHVYDVVPSPDEIGAVAVPVIDVGLPPAFLLAFIAVLGLVALNAVSTAASGSVETIFTIIKVSILVVFVAFGLTSPMFSGAEFQPLFPEGSGAAAVLPAMGLTFIAFEGYDLITTVTEEVQNPRENIPKAIFISLAVTVVVYLAVVTVAIGTLGAEGLADAGEAGIATAATSFMPTGLPIIQNGGALIVFGAVFSTLTALNAVVIASSRVAFSMGREGQLLPSIGQIHHRYGTPFVAILTSAIVMLGSVALPTQSAGNMSSLFFLLSFIIVNVAVIRLRRERPNMNRPYEMPFYPAPPIIGIALNLILTGVLIEFLLRTDPLALGLSVAWILLGAVVYFALKRIRQQSDREQATAVSEIKPEAED

SEQ ID NO: 26878 - protein, 122 aa, Triticum aestivum
  misc_feature (77)..(77): Xaa can be any naturally occurring amino acid
  misc_feature (80)..(81): Xaa can be any naturally occurring amino acid
  unsure (1)..(122): unsure at all Xaa locations
LKSTAGLPVSRRSNGASLGSVSNGGRIRCMQVWPIEGIKKFETLSYLPPLSTEALLKQVDYLIRSKWVPCLRFSKLXHLXXEHNASPGYYDGRYWAMWNCLCSGCTDATQVINEGGGVKKDT

SEQ ID NO: 26879 - protein, 195 aa, Brassica napus
MSSSSPSGSGGDLSERRGIPAAKFIQDVETYLSQSSLDSNSALAFHQERLQQYKVVEMKLLAQQRDLQAKIPDIEKCLEVVGTLEARKGTGEALLADFEVSEGIYSRACIEDTDSVCLWLGANVMLEYSCEEATALLKNNLENAKASLEVLVADLQFLRDQVTVTQVTIARIYNYDVQQRRVKQVAPTAITAADS

SEQ ID NO: 26880 - protein, 367 aa, Propionibacterium acnes KPA171202
MSRRNVSASLPTFPWDTIAEARRKAQSHPDGIVDLSMGTPVDPAPGVAIAALTAAGDAHGYPQVWGTPALRAGILDHMKQVWGAPASLEETSVLPVIGTKELVASLPGQLGLGPDSTIVIPACAYPTYRVGAQLAGAKIVAVNEPDEVDVAPDLIWINSPANPSGRVLDLDEMKAWVDLARSTGAVLASDECYGEFVWEGESVSVLDERVNSGDVTGLLACLSMSKRSNMAGYRAGFAVGDAELTSELLTVRKHSGLMIPAPVVAAMQAALADRSHVLEQVKRYRLRRNVLKPALEKAGFRIDHSEGSLYLWATHDEDCRVTLDRLADLGILCSPGDFYVAGGSDHVRIGLTATDERINAAAQRIQP

SEQ ID NO: 26881 - protein, 380 aa, Bartonella quintana str. Toulouse
MKVDYYEILGVTRECDDKKLKSAFRKLAMQYHPDRNAGDKEAERRFKEIGEAYEVLKDPQKRAAYDRFGHAAFENNNQGGGNPFGGFAAGGFSDIFEDFFGEIMGGGHRKRSDGRERGADLSYNMEVTLEEAFSGKTAQINIPSSIVCDSCEGSGAKKGSKPQICGTCHGAGRVRAAQGFFSIERTCHACNGRGEVITDPCPKCQGTRRVEKNRSLSVNIPAGIEDGTRIRLSGEGDAGIRGGPNGDLYIFLSVKPHEFFQREGADLHCRIPLSMVTAALGGEFEVSDLDGIKARVKIPEGTQNGRQFRLKGKGMPMLRRQQVRGDLYIHITIETPQKLTQEQRELLQKFEKLSNHENSPQSHGFFSRMKEFFENISGQN

SEQ ID NO: 26882 - protein, 443 aa, Ralstonia metallidurans CH34
MDAAKTVIPDLESLWMPFTANRQYKSAPRLLVSASGMYYTTHDGRQILDGCAGLWCVAAGHARKEIVEAIAQQAATLDYAPPFQMGHPLEFEAATKVASLMPQGLDRIFFTNSGSESVDTALKIALAYHRARGEGQRTRIIGRERGYHGVGFGGMGVGGIGPNRKMWSANVMPGTDHLPATLNIAEAAYSKGQPQWGAHLADELERLVALHDASNIAAVIVEPMAGSAGVLIPPVGYLEKLREITSKHGILLIFDEVITAFGRLGAATGAERLKVTPDLITMAKAINNAAVPMGAVAVRREVHDAVINATPQGGIELPHGYTYSGHPLAMAACIATLDIYKRDKLFERAAEMSPKFESAVHGLRGAPYVKDIRNLGLVAGVELESRPGAPGARAYEAFLKCLELGLLVRYTGDILAFSPPLIISEAEIDQMFDTVRQALHSIK

SEQ ID NO: 26883 - protein, 575 aa, Oryza sativa (japonica cultivar-group)
MHRMASLLLPPQFLCSLPCSTNSIRSHLHYKPHFLGNIMTKPKAKMRLLNRNVSSMAKKSSQDVAEGSSDDESDGETSKTKKRAPRRGRKKATIQASEGETQEGQVSTEEDESPEGTKKIKRRGRKKAATTASSSEEKDKAKEPKKRGRRKVKTVEELSDNEGEDLGEDLVPSNDRQEKISANDLESKIAALLLEDTDDNDINNLIPLVCCFGPAKYSFIPSGRPANRLIDHEIHEGMKDMFWSPDQFVRAPGGSSSNVALALAASGGRVEFMGKLGDDDYGQSTLYHLNVNGVQTRAIKMDPSAFTAMSLMKVTEDCFVQTDINPAVLKEAKMFYYNSSALLEPTTRSSLSKAIEVSKKFGGVTFFDLNLPLPLWSSSKETKSLVKEAWEAADIIEITKQELEFLCGIKPSEKFGTKDNDKSKFTHYSPEVVTKLWHENLKVLFVTNGTSKIHYYTKEHDGWVRGTEDAPITPFTGDMSQSGDAIVAALMKMLAINPHLVTDKDYLHTAMKHAITCGVIDQWLLARERGFLPRERADPTSEQFGVRFVTEKEYRTLPDSIHTEDSSESELLYVE

SEQ ID NO: 26884 - protein, 469 aa, Ralstonia metallidurans CH34
MSLFRTKNIDAMLEVSEHDGLRKVLGAVDLVLMGIGAIIGTGIFVLTGTGALTAGPALTVSFVIAAMACGFAALCYAEFASAIPVSGSIYTYSYATLGEIVAWMIGWDLLLEYGLATSAVSVGWSGYFQSLIAGFGIHLPTVLTAAPGAVPGEHTLFNLPACLIMLAITWIVSYGVKESARLNNVMVAIKIGVVLLFIAVGVWHVKPANWQPFAPFGMTGVFNAAALVFFAFIGFDAVTSAAEEVRNPRRDLPIGIIGSLAVCTILYVTVAAIMTGIVPFMKFEGVDHPVSLALQYAGQNWVAGFVDLGAILGMTTVILVMTYGQTRIIFAMSRDGLLPEALSTVHPVHATPYTATWTVGIVFAAIAAFVPLNVLAELINIGTLAAFTLISIAILVLRRTRPDLRRGFRCPGVPVVPLLAVGFCLFLMAHLQALTWIAFLCWIGLGLIIYFAYSRRNAVLHNHGGDAEG

SEQ ID NO: 26885 - protein, 480 aa, Saccharomyces cerevisiae
MSAILSTTSKSFLSRGSTRQCQNMQKALFALLNARHYSSASEQTLKERFAEIIPAKAQEIKKFKKEHGKTVIGEVLLEEQAYGGMRGIKGLVWEGSVLDPEEGIRFRGRTIPEIQRELPKAEGSTEPLPEALFWLLLTGEIPTDAQVKALSADLAARSEIPEHVIQLLDSLPKDLHPMAQFSIAVTALESESKFAKAYAQGVSKKEYWSYTFEDSLDLLGKLPVIASKIYRNVFKDGKITSTDPNADYGKNLAQLLGYENKDFIDLMRLYLTIHSDHEGGNVSAHTTHLVGSALSSPYLSLAAGLNGLAGPLHGRANQEVLEWLFKLREEVKGDYSKETIEKYLWDTLNAGRVVPGYGHAVLRKTDPRYTAQREFALKHFPDYELFKLVSTIYEVAPGVLTKHGKTKNPWPNVDSHSGVLLQYYGLTEASFYTVLFGVARAIGVLPQLIIDRAVGAPIERPKSFSTEKYKELVKKIESKN

SEQ ID NO: 26886 - protein, 170 aa, Symbiobacterium thermophilum IAM 14863
MDFKSKIRTVDDFPKPGISFKDITTLLKDGEAFHAAIETMAAHFEPLGINMVTGPEARGYIFASALAFRLRAGFVPIRKPGKLPWKTRSISYQLEYGEDRLEVHEDAFQPGQKVLVVDDLLATGGTIRATIDLVESLGAKVVGVAVLIELSDLGGRKRLEGHDVISLVQF

SEQ ID NO: 26887 - protein, 408 aa, Propionibacterium acnes KPA171202
MAKTRPKVLSIVLAGGEGKRLMPLTMDRAKPAVPFGGTYRLIDFVLSNLANSGLTQIAVLTQYKSHSLDRHISITWRMSTMLGSYVTPVPAQQRLGPRWYQGSADAIYQSLNLINDQSPDYVVVFGADNIYRMDVDAMLQYHIDSGLGCTVAGIRVPRKDASAFGIIDADQNHKITEFLEKPADPPGLPDASDESFASMGNYIFSREALVQALHDDAHSADSRHDMGGDVIPRFVNAADAQVYDFRDNEVPGNTEKDADYWRDVGTIDAYHDAHMDLVSVEPEFNLYNPDWPIWTMQEQAPGAKFVMRGSCDDTLVSAGCIISGTDIYRTVLGPRARIERWARVDESIVMNNVAIGSNATVHRAILDKNVIVPDGAQVGVDHDHDRARGFTVSPGGVTVVGKGITVPY

SEQ ID NO: 26888 - protein, 255 aa, Zea mays
  misc_feature (172)..(172): Xaa can be any naturally occurring amino acid
  misc_feature (181)..(181): Xaa can be any naturally occurring amino acid
  misc_feature (187)..(187): Xaa can be any naturally occurring amino acid
  misc_feature (194)..(194): Xaa can be any naturally occurring amino acid
  misc_feature (197)..(197): Xaa can be any naturally occurring amino acid
  misc_feature (210)..(211): Xaa can be any naturally occurring amino acid
  misc_feature (235)..(236): Xaa can be any naturally occurring amino acid
  unsure (1)..(255): unsure at all Xaa locations
MARKFFVGGNFKMNGSKSSIKEIVENLNNADLDKNAEVVVSPPALYLPLVRETLREEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTXGKVATTEQXAQEVHXRIRDLLXQHXATRLPDETRILLXXGRVNEKNCGELSRQADIDGSLVGXXSQPAFVDIITLPAVTINSK

SEQ ID NO: 26889 - protein, 293 aa, Propionibacterium acnes KPA171202
MSAPVFGRLLTAMVTPMTFDGAVDLRRTGELAHKLVEEQNNDGIVVNGTTGESPTTTDSEKAEIVKAVVEAVGSDAAVVAGVGTNDTAHTIELAHQAAEAGADGLLVVTPYYSKPSQAGIIEHFTAVADATDLPIMLYDIPGRTGTPIETKTLIELADHARIVAVKDAKGLVVESATVMASTTLAYYSGDDAITPALLSVGGVGLVGTSTHFTGRRMHEVIDAYVDGRIDEALSTYREILPVLTGVFAAQGATMVKAGLAHQGFTVGRVRPPQTMPTPEQAETFFGVLDRTQL

SEQ ID NO: 26890 - protein, 557 aa, Gibberella zeae PH-1
MGSQLGFVELIKKQFVPGKLLYHFLFWTFHWGIFAYGWWKQAVDPRLAGLNTLKFSVWISRGAGLVLSVDCMLILLPVCRTVMRWVRPKIRFLPLDENLWMHRQLAYSMLLFTCLHTGAHYVNFYNVEITQIRPVTALQIHYAQPGGITGHIMLLCMLLMFTSAHARIRQQSFETFWYTHHLFIPFFLGLYTHTVGCFVRDTPEAFSPFAGDEFWEHCIGYLGWRWELWTGGAYLLERLWREVRARRSTKITRVVRHPYDVVEIQFNKPSFKYKAGQWLFLQVPSLSKYQWHPFTITSCPFDPYVSVHVRQVGDFTRELGDALGAGAAQAKLYDDVDPMGMYEVALQNGDQMPALRIDGPYGAPAEDVFENEIAVLIGTGIGVTPWAAILKNIWHLRNSPNPPRRLRRVEFIWVCKDTGSFEWFQTLLSSLEEQSNEAARMPGSTGVEFLKIHTYLTQKLDIDTAQNIVLNSVGSQMDPLTELQSRTNFGRPDFPRLFTTMRNGILDRTYLNGLESHIRTTVGVYFCGPSAAARDIKLACKAATVPDVDFRFWKEHF

SEQ ID NO: 26891 - protein, 422 aa, Pseudomonas fluorescens Pf-5
MSDLKTAALEYHANPRPGKLSVELTKATATARDLALAYSPGVAEPVREIARDPELAYKYTGKGNLVAVISDGTAILGLGNLGPLASKPVMEGKGVLFKRFAGIDVFDIEVDSESPQAFIDTVKRISITFGGINLEDIKAPECFEIERALIEQCDIPVFHDDQHGTAIVTAAGMINALEIAGKTLADAKIVCLGAGAAAISCMKLLVSMGAQIENIFMVDRTGVIHSGRDDLNQYKAVFAHATDKRTLADALQGADVFVGLSGPNLLSAEGLKSMAPNPIVFACSNPDPEIAPELAHATRDDVIMATGRSDYPNQVNNVLGFPFIFRGALDVRAKRINEEMKIAAANALRDLAKLPVPQEVCDAYGGIKLEFGREYIIPKPMDARLITVISDAVAKAAIETGVATLPYPKNYPLKSVDDVFNG

SEQ ID NO: 26892 - protein, 117 aa, Zea mays
MARLFLACMLVLLLGIATAARTTADDPPAGDCDQDLQDLMSSCQQYVHFPADPKIPPSPACCSVVQRVNIPCLCSKVTPTVEALICMDKVVYVASYCKRPLQPGSTCGSYHVPGALA

SEQ ID NO: 26893 - protein, 477 aa, Oryza sativa (japonica cultivar-group)
MVKGGREALLGGYEMGRTLGEGNFGKVKYARHLATGGHFAVKILDRGRVVSLRAGDQIRREIATLKLLRHPHVVRLHEVAASKTKIYMVLEFVNGGELFERIVSPCFNDLLRYFLAAKIFMPATMAVKGKLSEKEGRRLFQQLIDGVSYCHDRGVYHRDLKPENVLVDQKGNIKISDFGLSALPQHLGNDGLLHTTCGSPNYIAPEVLQNKGYDGSLSDIWSCGVILYVMLIGYLPFDDRNIVVLYQKIFKGDTQIPKWLSHSAQNLLRRILEPNPMKRIDMAGIKSHEWFQKDYIPVLPYDDDDEDVQFGARLPAKEQINDEPGDKNSHQINAFQLIGMASSLDLSGFFEDEEVSQRRIRFTSTHPPKDAFDKIESSATELGFQVQRGHSKLKLMRNCKGSKNPESFMVSAEVFELGPSVNVVELRKSNGDPALYRQLCERISSDMGARNTEQIFATASLEDDLQNSNAGTPLFAL

SEQ ID NO: 26894 - protein, 134 aa, Medicago sativa
VHFRNVDEKSWAPLAEQVSLVLNDYPKLKLTQGRKVLEIRPTIKWDKGRALEFLLESLGFANSKNVFPIYIGDDRTDEDAFKVLRNRSQGCGILVSKISKETNASYTLQDPSEVGQFLRHLVDWKRTSSRSHKL

SEQ ID NO: 26895 - protein, 543 aa, Porphyromonas gingivalis W83
MNNSHFAFAKPVNEPVYGYAPGSPERKKLKEELQRQLSTPIEIPIIIGGKEIRTGDTGTVVMPHNHAVRLATYHRVGEKEVLQAIEAAEKARQDWSRLPWTERASVMLRIGELISTKYRYQLAASVMLGQSKNPMQAEIDAPCELIDFLRFGAYYAGQIYADQPISEKGILNRVEYRSLEGFVLAVTPFNFTSIASNLNLAPAMMGNTTIWKPSTTALHSNYLLMKIFQEAGLPDGVVNFLPGQGSLIGRVATANEHLAGFHFTGSTATFNTLWKSIAGNIDRYRGYPRIVGETGGKNFVMVHPSAEACEVATALVRGAFEYQGQKCSAASRAYIPRSLWPSVKEVMGDMLDSIKMGDVMEFDNFVNAVIDEASFDNIMNYLAAAKRDSDAKIIFGGEGDKSVGYFIRPTVIETTNPHYATMTDELFGPVLTVYVYEDKDFADTLRLCDSTGRYGLTGSIFSRDRYAIEQALDALRFSAGNFYINDKPTGAVVGQQPFGGARASGTNDKAGGPLNLMRWCNPRTVKETFVPPTDYPYPFLAKD

SEQ ID NO: 26896 - protein, 141 aa, Oryza sativa
MTDPLAPYPTPPVPFTPPNGAQSQLVSSGCRNLLISGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGTDQKPSS

SEQ ID NO: 26897 - protein, 337 aa, Xylella fastidiosa Ann-1
MKFTRKLATAAILALASTSSQAAGSPGVEHRTQAFLEDLAKGGGAPIETLSPANARQVLVNAQKGAKLPPADVSEKTITIDGKQIVLNIVRPAGVKGILPGFMFVHGGGWVLGDFQTHERLVRDLVSDSGAVAIFVNYTPSPEARYPVAINEIYAATQWVAEHGAQINVDGQRLAIVGNSVGGNMATVVAQMAKEKGTPALRAQVLFWPVTNANFENTSYNEFANGHFLTKNMMKWFWDAYTTDSKQRQDIYASPLLATAEQLKGLPPTLIQIAEKDVLRDEGEAYARKLDAAGVNVVITRYNGMIHDFGLLNVLADLPATRAALHQASEELKIHLR

SEQ ID NO: 26898 - protein, 799 aa, Xylella fastidiosa Ann-1
MALNGASYLNENILWLHELRLTDLARVGGKNSSLGEMIGNLTALGVSVPGGYATTAAAFKAFIAYNNLSKRIYDKLATLDVEDVKALTAAGKQIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFREVVFVTASFGLGEMVVQGAVNPDEFYVYKKTLKAGKPAILRRTLGSKLVRMVYSDAPGERVKIEDTPTELRHCFAISDADVQELARQALIIEQHYDRPMDIEWAKDGISGKLFIVQARPETVKSRSHTTQIERFALQQRGEILTEGRAIGQKIGSGTARVVHSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNAAVKKLLSMAIKAARSKGKYIGICGQGPSDHPDLAEWLMQEGIESLSLNPDTVVDTWLRLAKLKTVH

SEQ ID NO: 26899 - protein, 227 aa, Arabidopsis thaliana
MGSRQGPPKHQNKFAWVPKAGVKINETEVGGRFRPLSEITGVCYRCREQIAWKRKYGKYKTLTEATKCQKCTKRNVRQAYHKLCPGCAKEQKVCAKCCQSVDQILGRDIYEVEAEQKLFDETIRNARERDRRTLLRAMNKDNKPNKSDEEASRSDSSKVGDVFPSTSLEEYANKSGRVSGIIGHGSVPDHAHDDASGPESDEDDNVGDDEHDLREDSDENEQSQLQK

SEQ ID NO: 26900 - protein, 1569 aa, Arabidopsis thaliana
MDDLEQAIVISFETGAVDSALKSQAVTYCQQIKETPSICSICIEKLWFSKLVQVQFWCLQTLQDVLRVKYGSMSLDEQSYVRKSVFSMACLEVIDNENAGRVVEGPPFVKNKLAQVLATLIYYEYPLIWSSVFLDFMLHLCKGAVVIDMFCRVLNALDDELISLDYPRTPEEISVAARVKDAMRQQCVPQIARAWYDIVSMYKNSDPDLSATVLDCMRRFVSWIDIGLVANDAFVPLLFELILSDGLSEQVRGAAAGCVLAMVSKRMDPQSKLPLLQTLQISRVFGLVSGDVDSDLVSKVSALLTGYAVEVLECHKRLNSEDTKAVSMDLLNEVLPSVFYVMQKCEVDSTFSIVQFLLGYVSTLKGLPALKEKQLLHITQILEVIRIQICYDPMYRNNLNSLDKTGLEEEDRMSEFRKDLFVLLRTVGRVAPEVTQHFIRNSLANAVESSSESNVEEVEAALSLLYSFGESMTEEAMKTGSGCLSELIPMLLTTQFPGHSHRLVALVYLENITRYMKFIQENSQYIPNVLGAFLDDRGLHHQNFYVSRRAGYLFMRVVKLLKSKLVPFIDKILQNLQDTLSQLTTMNFASRELTGTEDGSHIFEAIGIIIGLEDVPAEKQSDYLSLLLTPLCQQIEAGLVQAKVASSEDFPVKIANIQFAIVAINALSKGFNERLVTASRPGIGLMFKQTLDVLLRVLIEFPKVEPLRSKVTSFIHRMVDTLGSAVFPYLPKALEQLLADSEPKEMVGFMVLLNQLICKFNSALHDILEEVYPVVAVRIFNVIPRDGLPSRPGAVTEEMRELIELQRMLYTFLHVIATHDLSSVFLTPKSRAYLDPMMQLVLNTSCNHKDITVRKVPGFQNFVIEAFATNCCLYSVLDKSFNFSDANTHALFGEIITAQKVMYEKFGNTFLMHLMSKSFPSAHIPQDLAEQYCQKLQGNDIRSLKSYYQSLIENLRLQQNGSHASPDVNSICQCLLERWQQAQEKFEELCFSFGIELDDVVLHRISMKQTTEKAIIRKEKHIDEEADDDEEIIYKIEIPANRPDLLCLEGLAQSLRVFIEKQEIPTYTLADISKDKILQMNVKPETSKIRPFVVCAVLRGVTFDEARYNSFIDLQDKLHQNICRRRSLVAIGTHDLDTLQGPFTYEALPPTDINFVPLKQTKSFRADELIEFYKSDMKLKKFLHIIENSPVFPVLYDSKRTVLSLPPIINGAHSAITLQTKNVFIECTATDLTKAKIVLNTMVTTFSEFCARKFEIEPVEVTYDDGKSYIYPDLAVYDMEVPLSFITDSIGVSLKVEQVTSLLTRMQLQAEQAKSSDNQCAIKVHVPPSRSDVLHPCDVMEDVAIAYGFNNIPTRKPASIKPLTLNELTDLLRIEIAMCVYTEVVTWLLCSHKENFAMLNREDVNSAVIVGNPRSADFEAMRRALMPGLLKTVGHNNKYPKPIKIFEISDVVMLDESKDVGASNRRHLAALYCGATSGFELIHGLVDRIMEVMAIPFLTIHENNVPINEKDGYYVKLSQEPEFLPGRQASIIVRGKHIGNFGIVHPEVLNNFDIPDPCSYLELDIEAIL

SEQ ID NO: 26901 - protein, 103 aa, Yarrowia lipolytica CLIB122
MSGRGKGGKGLGKGGAKRHRKILRDNIQGITKPAIRRLARRGGVKRISAQIYEETRNVLKSFLESVIRDAVTYTEHAKRKTVTSLDVVYALKRQGRTLYGFGG

SEQ ID NO: 26902 - protein, 350 aa, Methanosarcina acetivorans C2A
MSVFTINWRNSILKTATCWLQLVERPDGRFTCGRDFLRQYLRNLIKTKRMTFMDFEKLRHGTELIKRGFARMQKGGVIMDVTTPEQARIAEEAGAVAVMALQAVPADIRKAGGVARMADPEIVQQIIETVTIPVMAKARIGHFVEAEILEALGVDMVDESEVLTPADPFYHIDKTQFTVPFVCGARNLGEALRRINEGAAMIRTKGEAGTGDVSQAVKHMKQIQGEIRALAGKTKEELIMVAREIEAPIELVVETAKMQRLPVVNFAAGGVATPADAALMMRLGADGVFVGSGIFKAENPEKMAKAVVEAVNNYDNPVKLAEISKGVGAGMKGISADMIPAQEALQERGW

SEQ ID NO: 26903 - protein, 1437 aa, Ashbya gossypii ATCC 10895
MLALKENLLSVGSAPDNWGDWTLAAALVRGAADGTVFYTARAKASRPLVAVAAEQQGVHAIRLLAANDPFCAVTAEAGDSVPATVFTDLATVITGAPHLATVKTPIVVHIETLAEEYAAIPGFKDLGSVILVSSSPSQLLRAASTATKLAQASQRPVLHFYTSDLNGFGEVDVGTADGTFDSTIEDAPERILDSLQSRLVSRGTPSTLILNLSAYGEQFAQYLPDDVALYDITVYKPFEFSQVLRELPVSVKNIAVVQGSTGGSKSNGFEPILLDVFSDFNLLVDRGIKNIVVSGIGRLQYFAHTLEKIVSNSRSLSPSTDLYISDVKHAVHSGIAEEFIKKAISLENAYLSVLQQVFEPNLQLLNQFNDSAINSLRPEYGFGKFLQQNRARRQLMKMVERSLDCSLYEYEGPSVVEGLAAWISYNKRALDSSLLKEANIFGRDVHELLQKNSNSEVAKSILASAPTLDSFSFSSSWLIGSDAWSYDLGNSGVHHAITSRENINILLIDSEPYGSLSKNSARKKDVGLYAMNFGTAYVASVAVYSSYTQLLTAVVEASRFPGPSIVLAYLPYNSEQDSPLTILKETKRAVESGYWPLYRYNPTASNEEDTFKLDSSVLRRQLQEFLDRENKLTLLAKRYPDLSSNIVQSQSDIITAKQQRKSKEAYDQLLQGLSGPPLSVYYASDGGNAASLAKILAKKATTRGLKSFALSMDDIVLEDLPREQNVVFITSTGGQGEFPQDGKAFWEELKSATDLDLASVKFSVFGLGDSQYWPRKEDERYYNKPGKDLYNKLLLFSGQTLIPLGLGDDQDPDGYRTGYEKWESELWAALGVSDIITGEEPKLITNEDIKLASNFLRGTIAEALVDDSTGSIPSTDQQLTKFHGIYMQDDRDIRDVRKAQGLEPYYIFMIRARLPGGIARPEQYLALDKIAASFGNNTIKLTTRATFQLHGVVKRNLKSSIRAMNSTLLDTLAACGDVNRNVMVSALPANARVHEQVANVAAEISEELLPNTTAYHEIWLEGPDRNDASPEWQAIWEGMKSGPKKKVLVGGNALQDIEPIYGPTYLPRKFKVNIAVPPYNDVDVWACDVGLIAIIDETTSNLVGFNVYVGGGMGTTHNNKKTYPRLGSSFGFAPKEDITSVVEKILLVQRDHGDRTNRKHARLKYTIDDMGIDIYRQKVEELWGDKFAPERSYKIESNIDYFGWVKDETGMNHFTAFIENGRIEDSSKLSHKTGLRKVAEYMKQSGSGHFRLTGNQHIVISAIPDQHLDAIKGILKAYKLDNYSFSGLRLASSACVAFPTCGLAMAESERYLPQLISRLEESLEEYGLRHDSVVMRMSGCPNGCSRPWVAEVACVGKAPGTYNLLLGGGYYGQRLNKLYRSSLKEAEILSILRPLFKRWSLEREESEHFGDFLIRVGVIKPTLEGRKFHDDLPDGAI

SEQ ID NO: 26904 - protein, 475 aa, Frankia sp. EAN1pec
MAAVLEFALPDLGEGLTSAEIVRWMVGIGDVIVVDQPVAEVETAKAVVEVPCPHAGVVTALAGPPGTAVPVGTPLITVTVDEPAEQPADGPDGPDGAPGSAGGGSGRVLIGYGPRAEPAPTSRAGRASRASRIDRSLVGATAPEPLPSTPPAPTPPAPTPTAREARQAVKVISPLVRRLARDNAVDLRELTGTGPDGLIRRRDVEAAITAATRTGPATPADLAAPAAPAAPAPLADLAGPDGADVVPLSPLARRAAEAFGRSRREVPDATTWVDADATELLAARDALNAGGAEPRIGVLALLARVCVAALRRFPDLNSTVVTDADGRATGVRQHRAVHLGFAAQTPRGLVVPVVRDAQGHTTASLAAEVTRLTAAARAGRLTPAELTGGTFTLNNYGVFGVDGATPIVNHPEVAMIGIGRILPRPWAVDGELAVRRITQLSFTFDHRVCDGATAGAFLRFVADAVENPTTLLRYL

SEQ ID NO: 26905 - protein, 685 aa, Zea mays
MAPPFACAMHGRALLAAAAAALLASAVTLTLLPSAAAQPWVGPWPTCDDTTGNYSAGSAYAKNIKQLILSLQANASNTPALFATGSAGAGADAVYGLILCRGDLSPTDCFDCGTNAGQDVYRVCNGTRDAALVYNQCYVRLAPTDFLATTNNTGMRDLINGNSVPAGVNVTAYDGAITRLLNATARYAVDSSAPSLSPRKYFATGQMAGVDPRFPTGIWSMAQCAGDISPVQCRSCLDDLLAQWWQKFDSKEIGARLDGSRCNLRFETGNFYTGSPMVKLQMNGEEAAPAPVPSTDVLPGTTGGKKNSVGKLLGIILPIVFVAAIAAIALCIWIVRKKRTYQGTNLPQTDTTYMAEDIESIKSILLSLPSLQAATNNFDESNKLGEGGFGTVYKGNLSGQEVAVKRLPKGLDQGLEELKNELGLMAKLHHRNLVRLEGFCLEEGERLLVYEYMPNKSLDNILFDHEKKRQLDWRKRFNIIEGVARGLQYLHEDSQNKIVHRDLKASNILLDSNMNPKIGDFGLARLFLQDQTRGITNHIVGTFGYMSPEYVMRGQYSIKSDVFSFGILVIEIVTGQKNNGHYFDEQNEDVVSIVWKHWSEGTLAEIIDDSLGRNYSETEVLKCVNIGLWCLQQNPMDRPTMSDVMVMLNDDDTSSLPAAAKPTFFLDASSGYSYTSGTISHPSAR

SEQ ID NO: 26906 - protein, 311 aa, Synechocystis sp. PCC 6803
MAEVSLISQTNCPAVLDPPPQVFNDTMEGWNSINGDRMQRLIEGLQKFREGYFSSHRDLFEQLSHGQHPRILFICCSDSRVDPNLITQSEVGDLFVIRNAGNIIPPYGAANGGEGAAMEYALVALEINQIIVCGHSHCGAMKGLLKLNSLQEKLPLVYDWLKHTEATRRLVLDNYSHLEGEDLIEVAVAENILTQLKNLQTYPAIHSRLHRGDLSLHGWIYRIEEGEVLAYDGVLHDFVAPQSRINALEPEDEYALHPNSPLISYDAFKVPGKERPGREKATESPAPQLSPLPGFGHLPREQAERIYRGSR

SEQ ID NO: 26907 - protein, 200 aa, Zea mays
  misc_feature (73)..(73): Xaa can be any naturally occurring amino acid
  unsure (1)..(200): unsure at all Xaa locations
TTTRRRGHRSRERGRRRGLRARRRRRGNGGSPDSGDSARWLLDTKPPYPEAAVAPYVGDIDRYLRSLEVRTSXDSLVRYFQDIQKDICPKMRAAVVDWLVVLAEEFELHAETLHLAVSYVDRFLTMNVVARDKLQLLAVTALLVAAKYEEIESAEMKVNIYINSMDNTYTKQQVVKMEADLLKSLNFQIGGPTVTTFLRT

SEQ ID NO: 26908 - protein, 302 aa, marine gamma proteobacterium HTCC2143
MRWQKVESSLATFISDHGLPDQFQLLAKRWYWPLARHLVDNQSSIHLLGINGAQGTGKSTLASLLKLFLEVGAGLNVVALSLDDFYRTRKERHTLANRVHPMLEVRGVPGTHDIQFAVATVTRLLHDKPETVVSLPVFDKSIDDRVTDLIWPAVTTPVDLVIFEGWCVGSKPEDDIALRLPVNALEAELDAKQVWRNYVNEQLASDYQTLFALMNGLVMLKAPSMGAVQEWRWLQEKKLIDLKGAGRSGVMSQKQVKQFIQYYERLTRHNLSEMPSRADLVYHLGSDHGINNATGKWSERTF

SEQ ID NO: 26909 - protein, 326 aa, marine gamma proteobacterium HTCC2143
MTTIPLINIAALRSENTAERWAVVQSIATAFRDIGFMAVQGHNIPEQVISAMREQTRLLFKRPMDEKLALTVHPTNYRGYIPLGFFTPNGGGGAANKHADQYEAYKLHYEIAADDPICGQCDLYGPNRWPENSFALKAAVANYWRHCDRVTDELLLAIAAFFESDPAYFKQALTKPLTNMTLLHYPPCNRGVDHFGIHPHKDTDLLTVLAADLIGGLYLRPRQAKQWMEAKVPSDALIVNVGDMLEIWSGGYFMSTPHKVVNESDQHRYSFPYFSVPRFDITISPPGDSMNFDRAAMRAGEVSKKIWRSNWPNVDSVEEEIDPYTY

SEQ ID NO: 26910 - protein, 497 aa, Ozonium sp. BT2
MDSFIFLRSIGTKFGQLESSPAILSLTLAPILAIILLLLFRYNHRSSVKLPPGKLGLPLIGETIQLLRTLRSETPQKFFDDRLKKFGPVYMTSLIGHPTVVLCGPAGNKLVLSNEDKLVEMEGPKSFMKLIGEDSIVAKRGEDHRILRTALARFLGAQALQNYLGRMSSEIGHHFNEKWKGKDEVKVLPLVRGLIFSIASTLFFDVNDGHQQKQLHHLLETILVGSSSVPLDFPGTRYRKGLQARLKLDEILSSLIKRRRRDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVLCSPYTTHLREEYFPEPEEFRPSRFEDEGGHVTPYTYVPFGGGLRTCPGWEFSKIEILLFVHHFVKNFSSYIPVDPNEKVLSDPLPPLPANGFSIKLFPRS

SEQ ID NO: 26911 - protein, 765 aa, Bartonella quintana str. Toulouse
MKKSEQDQKMPQMVYNVNEREALDFHSRGRPGKLEIVATKSMATQYDLALAYSPGVAVPVKAIAQNPALAYDYTAKGNLVAVISNGTAILGLGNLGALASKPVMEGKAVLFKRFADIDSIDLEIDTNDTESFINLVRHLEPSFGGINLEDIKAPECFMIESRLREVMNIPVFHDDQHGTAIIVAAGVLNALYLTGRNMENTRLVCNGAGSAGIACIELIKAMGFRPENIILCDTKGVVYEGRKEGMNQWKSAHAVPTDKRTLAEAMEGADMFFGVSAKGAITPEMVKSMAPKPIIFAMANPDPEITPEEVMQVRNDAIVATGRSDYPNQINNVLCFPYIFRGALDVRATVINEDMKIAAARALANLAHEEVPDSVAEAYRGKRLKFGPNYIIPVPFDPRLFTVVSIAVAKAAMESGVAQKHIDDLEAYERDLNARRDPISSMMRGVYNHVRQAPKQIVFAEGEEEQVMRAAVSYVHQKLGQAILVGREEQVKETAAISGIDLEREGISIMNAKLSCRLDAYAHYLYKKMQRQGWLLRDCYRRINNDRNYFAACMVALGDADAMVTGVTRNYETALIDIRRVIDEKPKERLIGISMAICRGRTVFIADTAVYENPNAEELADIAEQTASFVRKLGSQPRVAFVAFSTFGYMKGQITRHIQDAVNILHERKVGFEFDGEISADVALNVKLMQQYPFMGLTEPANILVMPGYHASSIASKMLQELGEATIIGPILIGLEKSVQIVPFSGSDTDVVNIATLAAYHAKKL

SEQ ID NO: 26912 - protein, 330 aa, Frankia sp. EAN1pec
MSAATMVQALNAALRDSLRADPDVHVLGEDVGALGGVFRVTDGLAAEFGTQRCLDTPLAEAGILGTAVGMAMYGLRPVVEMQFDAFAYPAFEQLASHVAKMRNRTGGAVSLPVTIRVPYGGGIGGVEHHSDSSEAYYAHTPGLHVVTPATVTDSYGLLRAAIASDDPVVFLEPKRLYWSTEDGLSPAEVARAEVGPIGRAAVRRPGTSATLLTYGPALPVCLRAAEAAVAEGWDLAVVDLRSLVPFDDETVCAAVRATGRAVVVHEAAGFGGVGAEIAARVTERCFHHLAAPVLRVTGFDIPYPPPMLEHHYLPSVDRVLDAVARLQWEQ

SEQ ID NO: 26913 - protein, 710 aa, Neurospora crassa
MPAAVHGTPYLPDGAHQGGGGLSGADQKIKTLSPAVAAHLQRIYSAHADTVTKAWRQEDVSVWLRCCQGDDEAELARDFPLHQDWDYESFFQYTTSSAANSIAPPRSQDLSYPLSSYFISSSHNTYLTGNQLSSDSSVDAYRNVLLRGCRCIEVDVWDGSDSESEDDDGDAESVTSSSSSSSDDAYGSGEEGIASKLKRKAKRKLPSFLGGRKKSKDKKVPEPTTATPPPPPPAAATTTEAAPVGLSAETNPLERCKSGGSASLFQTLSRKSTKEPRVLHGYTLTKDITFRDVCEAIKDYGFATTDLPLIVSLEVHCSAEQQEMMVDIMRQIWGDLLLPEPEEDAKYLPTPEELRGKILVKVKYAPPNNEGGSTGSTTPEELDNTAAAASGRLSEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 26914 - protein, 339 aa, Porphyromonas gingivalis W83
MENIDWSSLSFGYRKTDYNVRCYYRNGKWGELEVSSEETITMHMAATCLHYGQEAFEGMKAFRGKDGKIRLFRMDENAKRMNRSCQGVVMAELPQEIFEAAVIKAVKMNERFVPPYESGASLYIRPLVIGLGAQVGVKPAPEYLFIVFVTPVGPYFKEGFKPTKMAIFRDYDRAAPLGTGTIKVGGNYAAGMIPTVKAHEMGYSAAIFLDAKEKKYIDEAGPANFFAIKNNTYITPESSSILPSITNKSLMQVAQDLGLKVERRPVAEEELATFEEAGACGTAAVISPISEIDDLENNKQYVISKDGKPGPWCEKLYHELRAIQYGDKPDIHGWVTILD

SEQ ID NO: 26915 - protein, 531 aa, Synechocystis sp. PCC 6803
MNNQQLWQRYQDWLYYHGGLDFYLDVSRMGFSDALVEDLQPKFAKAFQDMVALEKGAIANPDEQRMVGHYWLRNPALAPNDGIRAEITEPLRQIKAFVADVHQGNIKPPTAPKFTDLLAIGIGGSALGPQFVAQALAPNFPPLAIHFIDNSDPDGIDRVLNCLKAQDKLKSTLVVTTSKSGGTPEPRNGLAETKAVFEAQGLHFADYAVAVTMPGSKLSQQAQTEQWLQAFPMQDWVGGRTSELSAVGLLPAALQGIDIQAMLDGAKTMDEATRVRELRQNPAALLALAWYYAGDGQGKKDMVILPYKDRLLLFSRYLQQLVMESLGKERDLDGNVVHQGIAVYGNKGSTDQHAYVQQLRDGVPNFFATFIEVLHDRQGPSLELEPGVTSGDYLSGFLQGTRQALFENQRDSITVTIPEVDATSVGALIALYERAVSFYGSLVNVNAYHQPGVEAGKKAAASILELQKAILSTLQNESGPIALEALATKVQAPEQVETVYKIVRHLAANDRGVTLQGDRQFPQRLQIQWRS

SEQ ID NO: 26916 - protein, 364 aa, Escherichia coli CFT073
MMSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELTHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 26917 - protein, 710 aa, Neurospora crassa
MPAAVHGTPYLPDGAHQGGGGLSGADQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQLSSDSSVDAYRNVLLRGCRCIEVDVWDGSDSESEDDDGDAESVTSSSSSSSDDAYGSGEEGIASKLKRKAKRKLPSFLGGRKKSKDKKVPEPTTTTPPPPPPAAATTTEAAPVGLSAETNPLERCKSGGSASLFQTLSRKSTKEPRVLHGYTLTKDITFRDVCEAIKDYGFATTDLPLIVSLEVHCSAEQQEMMVDIMRQIWGDLLLPEPEEDAKYLPTPEELRGKILVKVKYAPPNNEGGLTGSTTPEELDNTAAAASGRLSEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 26918 - protein, 537 aa, Brassica rapa subsp. pekinensis
SFKDKTYEGNNNNLPEENSTTITHVSSVHSPTTEQDFPKEDNNNNNNKSPVLVLPVKEPFMRRNMDNQAYYVLGHKTPNIRDLYTLSRKLGQGQFGTTYLCTEVATGVDYACKSISKRKLISKEDVEDVRREIQIMHHLAGHKNIVTIKGAYEDPLYVHIVMEVCAGGELFDRIIQRGHYTERKAAELTKIVVGVVEACHSLGVMHRDLKPENFLLVNKDDDFSLKAIDFGLSVFFKPGQIFKDVVGSPYYVAPEVLLKHYGPEADVWTAGVILYILLSGVPPFWAETQQGIFDAVLKGDIDFESDPWPVISDSAKDLIRKMLCSNPSERLSAHEVMRHPWICENGVAPDRALDPAVLSRLKQFSAMNKLKKMALKVIAESLSEEEIAGLRAMFEAMDTDNSGAITFDELKAGLRRYGSTLKDTEIQDLMEAADVDNSGTIDYSEFIAATIHLNKLDREEHLVSAFQYFDKDGSGYITIDELQQSCVEHGMTDVFLEDVIKEVDQDNDGRIDYGEFVAMMQKGNAGIGRRTMRNSLN

SEQ ID NO: 26919 - protein, 533 aa, Dehalococcoides ethenogenes 195
MEIAKEKSGAKPEFIDNEDESLRESIVIFDFGSQYSLLIARRIREMHVYCELVSHDTPWEKIAHLNPRGFILSGGPSSVYEAGAPLAPAYIFESKLPVLGICYGMQAITHQLGGVVEHSEKREYGHALLHSSVANSDLLSDMPEPSPVWMSHGDRIEKMPAGFTALAYTENCPVAVMGNEADIYGLQFHPEVVHSPNGKIILKNFVFNICKCHANWTMGNYIQESIHNIREQVGDGQVICALSGGVDSAVVASLIHKAIGDQLTCIYVNNGLLRREEADRTLHVFKNHMGMKIIYVDAVDRFLDSLSGVTDPEQKRKVIGSEFIKVFEDEACKLGKIDFLAQGTLYPDVIESVSSVSKASAKIKSHHNVGGLPAHMKLKLIEPLRYLFKDEVRLLGKELGLPDEMIWRQPFPGPGLAIRIIGEVTREKLEILRAADWIVMSEIKKAKMYHQVWQSFAILTDVKSVGVMGDFRTYGYLVAIRAVTSEDAMTADWAKLPYDLLSVISNRIVNEVKEVNRVVYDISSKPPSTIEWE

SEQ ID NO: 26920 - protein, 710 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKRKLPSFLGGRKKSKDKKVPEPTTTTPPPPPPAAATTIEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPRQRAKKPSKVIWSLSKMGIYTRGVSFKSLMQPEANMPTHIFSLSESGVMDVHKESRSALFEHNKHYLMRAYPSGMRILSSNSDPAVFWRKGIQIVALNWQNWDEGMMLNEGMFAGTGGYVLKPVGYRCAKLTDSNPSPSPSPLASDTQADAVQHYTMDLTINVPAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 26921 - protein, 956 aa, Gibberella zeae PH-1
MSQSTTIKPSANKDEYCFIRQVYLRGHLAPAFPPPTKQCTRCRKSFQSVRTMCLPCLRAISFEKECDAKDRKRDTFLDNCKTCEKTTLHLGPDWCTVCYAVPDHTFPVYCEECVVQNDVPNRVMDDKGGFVEMLKVNSLWCIQCLEALKCEFFVPNDDTPELSRWSDTQIGRPSLVVTPKTESDIQGAVRIAKDNNLTVLAAGGGHGTFVSVDSSMLYLDLKNFKTIDLNKDEGRVRVGGGVVVGEVVKALADAGYYTPVPSSDAVGFVGCVLGGGSGILSGIHGWMIDNAVSFRVITAKGDIVEVSSESEGEELALFNAFCGAGHGLGVVTEVTVSAFPIAKLNMEDEKIWTRTLVFPASAIDVAVETFLDLRQPLPEGYVTMVFTRSPPGTPAAGAPIIVLGYNFFGPAGKAEKEAALLFKEEVVGRAVVNRTDLVPFASINAKHEAYNYHGGHKAIASCRLYKTDPEAINSTFEKWMAATQEYPDAQRSPLILSASNTDKSVTAAGDNFIDARDRHLVALAILIAEKEETSRAFVGVLDGIVAGLRKIDEGAGPRSFANNWKFETDVNEMFSEDIFERLRVVKRTWKGKTLIDVIRIGYTRQPDCDSGNGPDKLIKLITFLISVQPVYWSGVLRNRFSQISQRSMGTVSRTQQTLHLSDGRQLGFAEYGSPTGKPVFYFHGFPSSRLEAQPIDDIAQRCGVRLIALDRPGFGLSSPNPDYRIIDWPQDVVELAKAKDITEFSVFGLSGGGPFALACAFALPKRTLTSVGLFASAPPWEAGVQHVDYSRRILRFCAINCPKLLMGALDALNHVVRWLVLSKPAMTRIGKWLDAQDAKEKPGIEITKSHTERVEDLVNMLLDEPFRQGAVGAVHDAKLLTSQDWGFKLEDVDYDRVQIWHGVKDTNAPIAMIRYMAEHIPNSELNEFEEDTHYTMYKHIEPALRSLVKTEEKNEK

SEQ ID NO: 26922 - protein, 261 aa, Streptomyces peucetius
MSEAADRVALVTGGTSGIGLAVVRKLAQDGTRVFLCARDESAITGTVKELQASGLEVDGAPCDVRSTADVDRLVQTARNRFGPIDIVVNNAGRGGGGVTAEITDDLWLDVVDTNLSGAFRVTRAVLTGGAMQEHGWGRIISIASTGGKQGVALGAPYSASKSGLIGFTKAVALELAKTGITVNAVCPGYVETPMAQGVRQRYAAFWGITEDDVLEKFQAKIPLGRYSMPEEVAGMVHYLASDSADSITAQAINVCGGLGSY

SEQ ID NO: 26923 - protein, 404 aa, Oryza sativa
ASSPPPPPPPPSHPYPPAASLAAIPPSPSLSDHHTASLPSPLPLPSPIASPTEPTPPPPLPGNPPAPASSLRSSPPREPSSSSLSPPSSPSPGVRPLPSLASPPPPTQQPQETEEQEQQQESEEKQQQQQEEEGVEAEVEEAWLRQDEEEEVEEKEEEEEEADDEVQMYMEILSRDPGDVDALKCALFAKMRRAEWGGALGFARRLREAEPGEVEWRLMEALLHELKGDLAEAERLFNEVLAEKPLLVRALHIAELVLAFSNVEGFVGLALCMHKRSEGPTVFEMLEKALQLAISGERVPEERNIKLLIAQMHVVKGQLDVASEKLQNLINEDPRDFRPHLCQGIVYALLDKKEEADELFDTYRSLVPDEFPDKSFISDVIQAARVESKDRLQKDFGSEFLSKK

SEQ ID NO: 26924 - protein, 409 aa, Brassica napus
MLEGPKFDMLAVGNHHNYDAFTQDFYQKLGEEGTNMSMDSMQTSNAGGSVSMSVDNSSVGSSDALIGHPGLKPMRHPYSLSVGQSVFRPGRVTHALNDDALAQALMDSSYPTQGLANYEEWTIDLRKLHMGPAFAQGAFGKLYRGTYNGEDVAIKLLERPENSPEKAQALEQQFQQEVSMLSFLKHPNIVRFIGACIKPMVWCIVTEYAKGGSVRQFLTKRQNRAVPLKLAVKQALDVARGMAYVHERNFIHRDLKSDNLLISADRSIKIADFGVARIEVQTEGMTPETGTYRWMAPEMIQHRPYTQKVDVYSFGIVLWELITGLLPFQNMTAVQAAFAVVNRGVRPTVPADCLPVLGEIMTRCWDANPEVRPCFAEVVNLLEAAETEIMTTARKARFRCCMTQPMTID

SEQ ID NO: 26925 - protein, 468 aa, Propionibacterium acnes KPA171202
MSAVYRSHDQPCYQLETHNGHTGKVSRQTEFVLRSMEERNIRFVRLWFTDVLGSLKSVAIAPAEVEGAFVEGVGFDGSAIEGYARVYEADMVAHPDPATFQVLPWRSGTSTARMFCDITNPDGTSSAADPRHVLKRTMGRAAEMGFTFYVHPEIEFYLLNDEHHPGESPVALDNGGYFDHTTLGAGTDFRRDAINVLEQMGISVEFSHHEAAPGQHEIDLRYADALTMADNIMTFRVVIREIASLKGIKATFMPKPFTDHAGSGMHSHVSLFEGDTNAFYDAADEARMSPVAKYFVAGLLHHAPEIIAVTNQWVNSYRRLSGGGEAPNYICWGRNNRSALVRIPMYKPDKASSARVELRSIDSAANPYLAYSLVLAAGLDGIEKELPLPEEASDDVWQLSARERHALGIKQLPQSLGAAIRCMEESELVAETLGEHVYDYFLRNKRAEFEEYNRQVSQFELDRYLPHL

SEQ ID NO: 26926 - protein, 473 aa, Propionibacterium acnes KPA171202
MFEGPDDLLAYVKKEGIEMIDVRFCDLIGIMQHFTVPAREFDKDQYENGLAFDGSSIRGFQKINESDMALLPDPTTAWIDPFRERKTLIVNFNVHDPITKEAYSRDPRNIARKAEAYLASTGIGDTAFFAPEAEFYVFDDIRFDTRQNTSYYSIDSEAGAWNTGRTEDGGNRGYKVKYKGGYFPVAPTDHFGDLRDEIVTIMERLGMKVERAHHEVGTAGQAEINWRFDTLSRSADDVMKFKYIVKNVAWQHGKTATFMPKPIFGDNGSGMHVHSSIWKGGEPLFFDESGYAQLSDMARYYIGGILKHAPSLLAFTNPSANSYHRLVPGFEAPVNLVYSQRNRSACMRIPITGPNPKAKRVEFRCPDPSANPYMAFAALLLAGLDGIQNKIEPPAPVDKDIYELPPEEHAAMDHVPGNLGAVLDNLEADHEFLLAGDVFTPDLIETWVELKRGDLAALQQRPHPYEFDLYYDI

SEQ ID NO: 26927 - protein, 585 aa, Ralstonia metallidurans CH34
MPFALHGIPVSRGVAIGRAHILAPAALDVSHYLVDEDRLEAEVERLRSARAAVRAELITLKRDLPRDAPEEMGAFLDVHAMILDDEALSREPETLILQRRYNAEWALTTRLEELMRQFDEIEDEYLRERKADIEQVVERILKVLAGAPVLAPAPVPTLAPDGEATPGVIVVAHDIGPADMLQFKHTVFHGFVTDLGGRTSHTAIVARSLDIPAAVGVKNASELIRQDDWIIIDGDAGLVIVDPSAIILEEYRHRQSERALEKKRLQRLRHMPAVTLDGLEIELLANIEMAEDAGAALSAGAVGVGLFRSEFLFMNRRDELPDEDEQFHAYRNAVEAMHGLPVTIRTIDIGADKPLDGRGDDFETALNPALGLRAIRWSLSEPGMFLTQLRALLRASAFGPVRILIPMLAHAGEIDQTLDLIEQAKRQLDERGLPYDPGIKVGAMIEIPAAVLLLPLFLKRMDFLSIGTNDLIQYTLAIDRADNAVAHLYDPLHPAVLQLIARTIREANHAGVPVAVCGEMAGDPAMTRLLLGMGLREFSMHPAQLLRVKQEVIHADCERLSKAVDQILNCYEPDELTAALKQLTA

SEQ ID NO: 26928 - protein, 618 aa, Saccharomyces cerevisiae
MADLPQKVSNLSINNKENGGGGGKSSYVPPHLRSRGKPSFERRSPKQKDKVTGGDFFRRAGRQTGNNGGFFGFSKERNGGTSANYNRRGSSNYKSSGNRWVNGKHIPGPKNAKLQKAELFGVHDDPDYHSSGIKFDNYDNIPVDASGKDVPEPILDFSSPPLDELLMENIKLASFTKPTPVQKYSIPIVTKGRDLMACAQTGSGKTGGFLFPLFTELFRSGPSPVPEKAQSFYSRKGYPSALVLAPTRELATQIFEEARKFTYRSWVRPCVVYGGAPIGNQMREVDRGCDLLVATPGRLNDLLERGKVSLANIKYLVLDEADRMLDMGFEPQIRHIVEECDMPSVENRQTLMFSATFPVDIQHLARDFLDNYIFLSVGRVGSTSENITQRILYVDDMDKKSALLDLLSAEHKGLTLIFVETKRMADQLTDFLIMQNFKATAIHGDRTQAERERALSAFKANVADILVATAVAARGLDIPNVTHVINYDLPSDIDDYVHRIGRTGRAGNTGVATSFFNSNNQNIVKGLMEILNEANQEVPTFLSDLSRQNSRGGRTRGGGGFFNSRNNGSRDYRKHGGNGSFGSTRPRNTGTSNWGSIGGGFRNDNEKNGYGNSNASWW

SEQ ID NO: 26929 - protein, 431 aa, Chlorobium tepidum TLS
MPVLTRSAELFEKAKKFIPGGVNSPVRAFKSVGGTPIYMAKGQGAYMTDVDGNTYLDYVGSWGPFILGSMHPRVTAAIEYTLRNIGTSFGTPIELEIEIAELLCKIVPSLEMVRMVNSGTEATMSAVRLARGYTGKDKIIKFEGCYHGHGDSFLIKAGSGVLTLGDPDSPGVTKGTANDTLNATYNDIESVKAIVNENKGQVAAIIIEPVAGNTGVIPAKKEFLVALRELCDAEGIVLIFDEVMCGFRVALGGAQELYGVTPDLTTMGKIIGGGLPVGAFGGKRHIMENIAPLGSVYQAGTLSGNPLALTAGLETLKILMEENPYPELERKAAFLEAGFKANMEKLGLNYTQNRVGSMACLFFTETPVVDYKSAITADTAKYGKYFHSMLDQGIYLAPSQFEAMFTSFAHTDEDLEKTVKANYNALVAATK

SEQ ID NO: 26930 - protein, 361 aa, Arabidopsis thaliana
MLFYMPTLYKKAGCLGIREFMKQASSSSSSRNSTSLTNRLKTIFKKAEELSILCAIEVCVIYYGPDGELRTWPKERETVKDMALRYKEARKRKKSRNLHEFLEKEKDKDKGKTNLKKNWYPNFDHYSPQQLSQLIQSLERTLSTLQERLRIVEAQKLQNTNLVHQSLTPSYLNQTQHLNPSKFSLFMYNHGDATLSQLPLSAPHSNQLINYQNHLMQHGFGQNMCSDNITNNNFEHPGVSNTQDYSPLLSVQASAVNNYGLNNHLMQQQDQLHGFDQNMCMVSEIINNNNGLQHPNLSNTVPHEFSSDFNQNPYGNAVGNISFSQDMFSSYDASSLLQTSSLPPLHNIPSSYCFPGNSRLL

SEQ ID NO: 26931 - protein, 121 aa, Burkholderia pseudomallei K96243
MNHDPNCLFCKIAAGEIPSTKVHEDDEFVAFRDIRPAADTHVLVIPRKHLPTLSAVTADDAPLLGRMMVLVARLAERLGCAYTGGETGFRTVINTGPGGGQEVYHLHAHILAGPRPWRRMG

SEQ ID NO: 26932 - protein, 727 aa, Oryza sativa
MGIGIGIGIGIGIGTGTGAALPFGEASPWSLLGGAVAALLLVWAAQMLEWAWLAPRRMERALRAQGLRGTQYRFLHGDLTEDLRLVTAARSKPVPMDRPHDFIPRVAPLLHRALEEHGRVSFTWFGPMPRVTITDPDLVREVLSNKFGHFEKTKLATRLSKLLVGGLVILHGEKWVKHRRIMNPAFHAEKLKVELNILELEINLVTLTFLRMLPAFSASCSELIGRWENAVAASVGKAELDIWPDFQNLSGDVISRAAFGVRHHEGRQIFLLQAEQAERLVQSFRSNYIPGLSLLPTENNRRMKAIDREIKSILRGIIEKRQKATKNGEASKDDLLGLLLQSNMDYYSDEDGKSSKGMTVEEIIDECKLFYFAGMETTAVLLTWTMVALSMHPEWQDRAREEILQVFGRNKPDINGVSRLKVVTMVLHEVLRLYPPVVMMNRRTYKEIELGGVRYPAGVMLSLPVLFIHRDAAAWGHDAGEFDPGRFAEGVARACKDPGAGAFFPFSWGPRICIGQNFALLEAKVALGMILQRFAFELSPAYAHAPYTVLTLHPQHGVPNTFADKHWKLHVPGIRHSEISISDMKAEHYLLTTAAAVPCIVEVYEYPYSISRLHNRGLPHLDRCVFCDQCNETINNLLVACPESWQWWWFALRAIRLPNFLPFNEASFHLWLCDNRMKVDKAHRRGFDTIAALVAWTIWKERNNRVFNQHHKPWVEVAKGMAADAEL

SEQ ID NO: 26933 - protein, 710 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKRKLPSFLGGRKKSKDKKVPEPTTTTPPPPPPAAATTIEAAPVGLSAETNPLERCKSGGSASLFQTLSRKSTKEPRVLHGYTLTKDITFRDVCEAIKDYGFATTDLPLIVSLEVHCSAEQRERMVDIMRQIWGDLLLPEPEEDAKYLPTPEELRGKILVKVKYAPPNNEGGSTGSTTPEELDNTAAAASGGLSEEAGQPRQRAKKPSKVIWSLSKMGIYTRGVSFKSLMQPEANMPTHIFSLSESGAMDVHKESRSALFEHNKHYLMRAYPSGMRILSSNLDPAVFWRKGIQIVALNWQDWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISRKLRL

SEQ ID NO: 26934 - protein, 122 aa, Burkholderia pseudomallei K96243
MTQSTTEDTLLRLAAVIDSRKGGDPEQSYVSRLFHKGDDAILKKIGEEATEVVLAAKDVRQGGAPSALVGEVADLWFHCLVALSHFDLSPADVIAELERREGMSGIEEKALRKRREREENGG

SEQ ID NO: 26935 - protein, 138 aa, Burkholderia pseudomallei K96243
MMNAEAKPGDWLGKVRWDANGLVPVIAQDAATNDVLMFAWMNRDALAKTIELKRAVYYSRSRQRLWFKGEESGHVQHVHEVRLDCDEDVVLLKVEQVEGIACHTGRRSCFFQKFEGTVDDGEWVAVDPVLKDPEHIYK

SEQ ID NO: 26936 - protein, 436 aa, Ralstonia metallidurans CH34
MGLLDDRKSGLLPGGHAAFERIDLTVPGFLQGCLSLARALAVLAYHDDGDGLILCKTARPVGQVVEWRALRLRHVALGELGSVADIHHHRIALVDQLRGGGRIDAFSARAALDRRPGQQAARDHGDGDQGQVIVIGEEIHVGIPLGWVGGIIKYAVSCPRRYLSVASRPPPALRRIVRTAGHLLPGSSMYKLVLIRHGESTWNLENRFTGWVDVDLTDTGAAQAKQAGTLLKEAGFAFDVAYTSVLKRAIRTLWHVQDEMDLMWIPVRNEWRLNERHYGALAGLNKAETAKKYGDEQVLVWRRSYDTPPPALEPTDERASFGDPRYANVPRAEIPLTECLKDTVARVMPLWNESIAPDIKSGKRVVIAAHGNSIRALVKYLDQISDDDIVGLNIPNGTPLVYELDADLRPLRHYYLGDQEAIAASLAAVASQGKAR

SEQ ID NO: 26937 - protein, 710 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKRKLPSFLGGRKKSKDKKVPEPTTTTPPPPPPAAATTIEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPRQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 26938 - protein, 711 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKSKLPSFLGGRKKSKDKKVPEPTTTTPPPPLPAVAATTTEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPKQQAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 26939 - protein, 309 aa, Prochlorococcus marinus str. NATL2A
MVSSLIEASAPLKKPVAADKAMAASKKLQGHVPRRIQNKRARKRWGTVIFMLTIHALTIFTLQAQFWSWLAFSGFIFLYWVTACLGVTTGYHRLLSHRSFQVPKWLERFFATCGALSCQHGPIDWVGLHRHHHTFSDTEADHHDSNKGFWWSHMGWMFEDVPAMKAVPRLSGDLIKDPYYRFLNKNFLLLQLPLGATLYLIGQSAGVGGWAMVLWGIPLRLVFVYHITWLVNSATHCWGTIAYESGDNSKNNKWVAALTFGEGWHNNHHAFPNSAKHGLQRKQIDLTWQHIRFLKAIGLAKKIRLPVAS

SEQ ID NO: 26940 - protein, 458 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGI

SEQ ID NO: 26941 - protein, 217 aa, Polaromonas sp. JS666
MARGIKAIIFDCDGTLVDSETPGLDVLYEEAVKLGVDLSREEVHAEFRGKRMALCIEAIGRRLAQRPASFEADFTAHVRQAMALRFNEGLNPILGALALVSRLQQPFCVATNGPREKAELTLGLTGLLPYFENRIFSAYDVGFWKPSPELFLHAARAFSVEPRHCAVVEDSLPGIEAGLAAGMQVYSLCQPETVPPELAGRIEQISSLAMLDRVLHG

SEQ ID NO: 26942 - protein, 711 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKSKLPSFLGGRKKSKDKKVPEPTTTTPPPPLPAVAATTTEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPKQQAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 26943 - protein, 296 aa, Ashbya gossypii ATCC 10895
MSVDADEKEVILVHPSNEKTAVKILNYGATIYSWTIDGEEQLWLSDAAKLDGSKPVRGGIPLVFPVFGKNTDDEHFSKLPQHGLARNSTWEFLGQTKENPPAVQFGLGPELANEELTALWPFDYTLVLTVELGEEHLKTEIEVVNTSTSQTLRFNWLFHTYLKIDDVEDTMVSNLKNFKTYDQLLKTSYVDRQPVVAFHEEVDRIYQQVADDRVIQIVDKGRPIHSVSRGNLPDVVVWNPWIEKSANMQDFQPKEGYQKMICIEPGHVHDFVTLQPGEKWSGYQLLSKDTLKYQAV

SEQ ID NO: 26944 - protein, 439 aa, Magnetococcus sp. MC-1
MSDFASLNLVKPLLNALTQAGYTTPTPIQAQAIPHLLAGRDLLGIAQTGTGKTAAFALPILNKLSQIKGRPAPNAPRALILTPTRELASQIGNSIAVYGKHVPTTHTVVFGGVGKQPQIRALSRGVDILVATPGRLLDLMGERHVRLDQIQVFVLDEADRMLDMGFIHDIRRIIKVIPAKRHTLLFSATMPKDIAELAEGLLTNPAKVEVTPESTTVERITQKVLFVDKQNKRSLLKNVLEHESIEQVLVFTRTKHGANRVAEYLDKHRIASAAIHGNKSQSAREKALDGFRKGKLKVLVATDIAARGIDVAGISHVINFDLPNESESYVHRIGRTARAGRDGNAISFCDAEERGYLLDIEKTIRQTVPVDIDHEFHCEVVANAAPIKPSRKRSSGHGAGGGNPHGGGHRRGNPSTASKPRQHSGRRTPSSKGRSGSVA

SEQ ID NO: 26945 - protein, 711 aa, Neurospora crassa
MPAAVRGTPYLPDGAHQGGGGLSGAEQKIKTLSPAVAAHLQRTYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKSKLPSFLGGRKKSKDKKVPEPTTTTPPSPLPAVAATTTEAAPVGLLAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 26946 - protein, 381 aa, Medicago truncatula
MRYIRTGSFKRLFSFTKRGLGEPVLSPKGEENEKSLKILPYEEETCQKPTWKCFSYEELFDATNGFNSENMVGKGGYAEVYKGTLKNGEEIAVKRLTRASKDERKEKEFLTEIGTIGHVRHSNVLSLLGCCIDNGLYFVFELSTTGSVSSILHDEQLAPLDWKTRHKIVVGTARGLHYLHKGCKRRIIHRDIKASNILLTKDFEPQISDFGLAKWLPSQWTHHSIAPIEGTFGHLAPEYYLHGVVDEKTDVFAFGVFLLEVISGRKPVDVSHQSLHSWAKPILNKGDIEELVDARLEGEYDVTQLKRLAFAASLCIRASSTWRPSMTEVLEIMEEGEMDKEKWKMPEEEEEQEEEFWGFEDLEYEYDSSFSMSLIDSIESN

SEQ ID NO: 26947 - protein, 410 aa, Triticum aestivum
  misc_feature (271)..(271): Xaa can be any naturally occurring amino acid
  unsure (1)..(410): unsure at all Xaa locations
MPATDYQGSSSSSHSPFASFGRSLLSRSRDSPASPAMLPSGGEAEVEAFQRHVAVSLAELRDGEDFLSVAWIRRLLEAFLLCQEEFRAVVAEARRRGGGGALAERLVGEYHERAVKALDVCNAARDGVDQVRRWGRLAGIAASVLLAPEEIHEGQLRRARKALSDLSILLVDDAAAAGGGGRRRRPSWPHTGNRSFGRGSRASPSRASSASSSSSSSSHFRSLSWSVSRTWSASRQLQAIGAGLAAPRAHEAGLAAPVYAMGCLLHLASWXALVAAVPCPDRAAALQAHHLPAAPPRGAFAWAPPLLTLQDRLTEEGKRKDRRNSCGLLKEIHALEKCAQRLAEAIDAAPIPLAGEREAAVREAAAELAAVCSAMKDGLEPLERPPREVFHRIVRSRMEGLDSPMPNAAD

SEQ ID NO: 26948 - protein, 365 aa, Medicago truncatula
MDPNNNHFNTQNFSNYPYNYENPNNYPNPNQFYNQRPQNIHQNVPNFGFSPNFNQSSSFPNFHPYYGSMMRYPSQTPPFNGYMPMGNENFPSVDATQYPEFSTQITPGGMAVADEVTPEDSTPKSKRSKEPAWNTQQNLVLISAWIKYGTSSVVGRNQRGETYWGKIAEYCNEYCSFDSPRDLVACRNRFNYMSKIINKWIGAYESAKRMQGSGWSEDDVLTKAQELFAGGKNIQFTLNEEWHALRDQPRYGSQMGGNVGSGSSGSKRSHEDSVGSSARPMDREAAKKKGKKKSTNAAGLEEVEKEWVQFKEIKDKEIEHLKDYTKVQQEKNRLTKMKMYLKLSSEEHLDDRKKELLENLVRELF

SEQ ID NO: 26949 - protein, 400 aa, Leuconostoc mesenteroides subsp. mesenteroides ATCC 8293
MIKSKLEQVGIFNDNLDKVKPSPIHSFDEKVSDIPNILKLTIGEPDFSVPQHIKEAALAAISADDSHYSVSAGKKTLRQAASDFLNDRYGLDFDPAEEIITTVGATEGLYTLLAAILNPDDKVLIPTPAYPVYAEMTRINGGHPVFIDVSEDEFVLTPDHLREIIATEDHIKAIIITNPSNPTGVTYTAEQLKALADVVRETDILIISDEIYSELSYDAPHVSMASILPEQTIVVNGVSKSHAMTGYRIGILAGPAALMKKINMVHGFVIMTPSNPAMAAATEAFKSAESKDDTLWMKEQYKKRRDYLVEKMTKLGFEMATPSGAFYMFAKIPVDLNQNDVEFAYDLVDRQQLAVVPGSGFGPGGAGYVRISYAASLDMLETAMNRLESYCEEKRTVKIL

SEQ ID NO: 26950 - protein, 531 aa, Zea mays
MEAVGVTPAPVAAPEKKKLLDLKDPFPAAANGGAKASPAGKWAMKKKLVGGDAGYVLEDVPHLTDYMPQLPTYPNPLQDNPAYSVVKQYFVNPDDTVTQKIVVHKTSARGTHFRRAGPRQRVYFQSDEVNAAIVTCGGLCPGLNTVIRELVCGLYDMYGVSSVVGIEGGYKGFYSKNTVALTPKSVNDIHKRGGTVLGTSRGGHDTAKIVDCLQDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFVERRLKDNGHMVIVVAEGAGQDLIARSMNFVDTQDASGNKLLLDVGLWLSQKIKDHFKKKPSFPITLKYIDPTYMIRAVRSNASDNVYCTLLAHSALHGAMAGYTGFTVAPVNGRHAYIPFYRITEKQNKVVITDRMWARVLCSTNQPCFLSHEDVENMKHDDDEHHHMHNTQLLEGGSSPVSKCNGSAAAV

SEQ ID NO: 26951 - protein, 376 aa, Triticum aestivum
NSYLYSSYSYNELADITSNFSSECIIGQGGTSQVYKGCLTNGKELAVKILKYSDEVLKEFTSEIEIVSSVVHKNVIAPAGFSFKNNDLLLVYEYLQRGSLEEILHGEKECKSMFGWTERFNVAVGVAHALDYLHGNGNSRPVIHRDVKSSNILVSEDFEPKLSDFGLALWAADATPQITCNDVAGTFGYLAPEYFMHGKVNDKIDVFAFGVVLLELVSGRKPLCTGCPKGQESLVMWANSIIQGGKLTQLADPSLPTEGHTDEIERMTLAASLCIRPTPQHRPHIAVVLKLLDGDNDILKWARSHVGLSYESDGDEDDVVTLAPPPENSTNIQSYINLAFDVDDDSASVSSNDFITANTSLEEYLQGRWSRSSSFD

SEQ ID NO: 26952 - protein, 330 aa, marine gamma proteobacterium HTCC2143
MPSSKEIHLKSRPRGLPTADNFEFVEVDVSEPGENEVLVQNIYMSVDPYMRGRMREDFALGEVLAGGAVGKVVASKHNDFQAGDYVSNFSGWREYFLSNGEDLTKVDASLAPLSCYLGVLGMPGLTAYGGLLVTGELKDGETVFVSAASGAVGSVVGQIAKVKGCTVIGSAGSDEKVAELINEFGFDHAFNYKTADPLTELRKAAPDGIDVYFENVGGIQLEAALTHMKINGRIPICGMISTYNDAGTASPGPRNLTETIYKFITMKGFVVSGFGAQQPQFVEDMAGWIKSGEVKYHETIFDGIDSAPTAFMGLFDGTNNGKMLVQLADQ

SEQ ID NO: 26953 - protein, 88 aa, Triticum aestivum
  misc_feature (16)..(17): Xaa can be any naturally occurring amino acid
  misc_feature (29)..(29): Xaa can be any naturally occurring amino acid
  misc_feature (41)..(41): Xaa can be any naturally occurring amino acid
  unsure (1)..(88): unsure at all Xaa locations
DDEYHLIGTFTDGDLXXTLKASGPAIFSXTVGEMCNRNPRXITADAMAVEAMEKMESPPSPVQFLPVVDDKNVVSGIITLHGLVSAGL

SEQ ID NO: 26954 - protein, 340 aa, Staphylococcus epidermidis RP62A
MKAAVVTKDHRVSIEEKRLRELKPGEALVKTEYCGVCHTDLHVKNADFGDVTGVTLGHEGIGRVIEVADNVDSLKVGDRVSIAWMYAACGNCEYCTTGRETLCRDVLNAGYTVDGAMAEEVIVDANYAVKVPENLDPAAASSITCAGVTTYKAVKVSGIEPGQWLGVFGVGGLGNLALQYAKNVMGAKVVAFDINDDKLNFAKELGADAIINSTNVDPIEEVNRLTNNKGLDATVITAVAKTPFNQAVDVVKAGARVVAVGLPVDKMDLDIPRLVLDGIEVVGSLVGTRQDLREAFQFAAENKVIPKVQLRQLSEINDIFDEMEKGTITGRMVIDMKSSH

SEQ ID NO: 26955 - protein, 378 aa, Solanum lycopersicum
MAIDCMITNGKSPMLDEKKQFIFDASHMKRESNIPTQFIWPDHEKPCALVQQLHVPLIDLRGFLSGDPDAAQQASELVGEACRGHGFFLVVNHGVDANLISNAHRYMDTFFELPLLEKQKAQRKIGEHCGYASSFTGRFSSKLPWKETLSFRYSAKKESSHIVEEYFQSTLGESFNHLGNVYQEYCNSMNTLSLGIMELLGMSLGVEKSHFKEFFEENDSIMRLNYYPPCQKPELALGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLHDQHNTTTQA

SEQ ID NO: 26956 - protein, 195 aa, Burkholderia pseudomallei K96243
MRVAQVVRNTSETQISVKIDLDGTGRQKLATGVPFLDHMLDQIARHGLVDLDIEAHGDTHIDDHHTVEDVGITLGQAVAKAVGDRKGIRRYGHSYVPLDEALSRVVIDFSGRPGLEFHVPFTRARIGTFDVDLSIEFFRGFVNHAGVTLHIDNLRGVNAHHQLETVFKAFGRALRMAVELDERAAGQIPSTKGSL

SEQ ID NO: 26957 - protein, 711 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKSRLPSFLGGRKKSKDKKVPEPTTTTPPPPLPAVAATTTEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPKQQAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 26958 - protein, 712 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKRKLPSFLGGRKKSKDKKVPEPTTTTPPPPPPPAAAATTTEAAPVGLSAETNSLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNPAAAASGGLPEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSPSASDTQADAVQHYTMDLTINVLAAQSLPLPPRDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 26959 - protein, 645 aa, Pseudomonas syringae pv. syringae B728a
MGQTRFATGRQLDLICLGRLGVDLYAQQVGALLEDVSSFAKYLGGSSANIAFGTARLGLRSAMLSRVGDDHMGRFLVESLAREGCDVSAIKRDPERLTAMVLLGLKDRETFPLVFYRENCADMALRAEDIDEQQIASSKALLITGTHFSTDQVFKASSQALDYAKKHDVKRVLDIDYRPVLWGLAGKADGETRFVADQKVSQHVQRILPRFDLIVGTEEEFQIAGGATDLLAALRRVRELTAATLVVKLGPQGCTVIHGAIPARLEEGAIYPGVQVEVLNVLGAGDAFMSGFLSGWLKEASDERCCQLANACGGLVVSRHACAPAMPTPAELDYLFNSPQPITRPDQDVALQRLHQVSVPRKQWRQLFIFAFDHRGQLVELAQQAGRDLGSISQLKQLFVQAVERVEADLRKRGIEADVGLLADQRFGQDSLNAATGRGWWVARPVEVQGSRPLAFEHGRSIGSNLLAWPQEQIIKCLVQYHPDDEPMLRLEQEAQIKALYDASKVSGHELLLEIIPPKDHPSPHPDVMLRSLKRLYNLGIYPAWWKIEAQSAQVWQQLDELIQQRDPYCRGVVLLGLNAPVEDLAAGFAEARHSRVCQGFAVGRTIFREPSRAWMAGEIDDATLISRVQSTFNWLIESWRESRA

SEQ ID NO: 26960 - protein, 308 aa, Ashbya gossypii ATCC 10895
MPLVLLTGFPSSGKTTYARQLEALLQAKCASSPELAKYTVVYHSDETLGIQHDDYKTSQGEKSARSKIMSVVKRDLSRNAIVIVDSLNYIKGFRYQLHCEVKHAMTTYCLVHCLTAYEKLVQWNTQQDTPWDAALLEALIQRYEEPNPATRWDSPLFAVLSGEDKLEAIADDVYKALFPQLYRDCADRETEKLLQGLTPNSATILKPAAHVNLVQVLDSETQAVVKTIMQHLQSNVVSGNIRVIVSETKDINDPSCCYVELQSDRVGMAQLQRIRRQFVQMNKLRNIEKERIIPLFTEFLNKNLRSDL

SEQ ID NO: 26961 - protein, 706 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQLSSESSVDAYRNVLLRGCRCIEVDVWDGSDSESEDDDGDAESVTSSSSSSSDDAYGSGEEGTASKLKRKAKSKLPSFLGGRKKSKDKKVPEPTTTTPPAAATTTEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLTEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSLSASDTQADAVQHYTMDLTINVLAAQSLPLPPRDNNVDSFRPYLKVELHVEEPGERHGTDELPQDGKEKGGEYKAKTKSVKGGCDPNWEGKFGAQTELKFENIPGVVPELSFVRFLVLDDEIGRDSLAAWACVRLDRLREGYRFVHLLDAKGMESDGAVLVKISKKLRL

SEQ ID NO: 26962 - protein, 267 aa, Oryza sativa (japonica cultivar-group)
MGMARARARRLLPLLTFVTLGMILGSLLQLAFFRRIDDHSNVTHLENDQEAAFLRLGLVKPEVISWSPRIIVFHNFLSSEECDYLRSIARPRLQISTVVDVATGKGVKSNVRTSSGMFVSSEERKLPVIQSIEKRISVYSQIPEENGELIQVLRYEPSQYYRPHHDYFSDTFNIKRGGQRVATMLMYLTDGVEGGETHFPQAGDGECSCGGKMVKGLCVKPNKGDAVLFWSMGLDGETDSNSIHGGCPVLEGEKWSATKWMRQKEFV

SEQ ID NO: 26963 - protein, 275 aa, Polaromonas sp. JS666
MGATSLYAVIGNPIQQSKSPLIHGMFAQATGQDIEYTAIEGPSGGFAGAVDAFRAAGGLGLNITAPFKLDAFAYATERSARAQLAGAVNALKFDGDRVLAENFDGVGLVRDVTHNLGCPLKGKRVLLLGAGGAARGALLPLLEQAPAELVIANRSVDKALELAKIGAARGKVRGCAYTDLVGQTFDVVFNATSASLRAELPPVPAGVFSNCALAYELAYGKGLTPFLRLAQNAGVKQLADGVGMLAEQAAEAFAWWRGVRPDTLAVIGKLTVPLV

SEQ ID NO: 26964 - protein, 711 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKSKLPSFLGGRKKSKDKKVPEPTTTTPPPPLPGVAATTTEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPKQQAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 26965 - protein, 509 aa, Dehalococcoides ethenogenes 195
MPELLTDDLNALLEVLPPHVRQPFANPADRENLIEIVMDLGRTPEARFPDREIILSERDVTQEDIDYVSSRIGDFGDDNRAGIERTLHRISAIRNRKGKIVGLTLRVGRAVFGTIKIIQDLIQSGQSVLMLGRPGVGKTTMLREVARVLAGDLKKRVVIVDTSNEIAGDGDIPHPAIGHARRMQVRTPDMQHAVMIEAVENHMPQVIVIDEIGTELEALAARTIAERGVQLVGTAHGNVLDNLMLNPTLSDLIGGIQSVTLGDEEARRRGTQKTILERRAPPTFQVIVEIQERNKVAVHPDVGAAVDSILRGVSPSSEIRYLDENGEVVISKQQPSEEKVKVAAESLPLPKGKELPVMYLFGVNRSRMEEIAREMHLDIKLAERPEQAQLMVTSRNYYRRKPQRVRDAENMNIPIYVLKSHTPGQFHQLLATLSGRDVAFTADKPPEIDLAIHEAEEAIAQVKSSHIPVELSPQGAYIRRFQHIIAEKEHLSSHSLGKEPHRRVRISRG

SEQ ID NO: 26966 - protein, 1024 aa, Ralstonia solanacearum
MPRDTPQTVPGHSPFWPLFFFTHNNKREARHDLARLSLTLMPILPRLFHRTSRTSSADTQRDARTPPNASPLHGEPGRTPRSRGELGRNLRLRSNAQTSGTPGTPARPQIRASASRTAPSTPQHPQGTEGTRTVPNSPLHNDARVFRERADHTGLSAWRTEMLTRFIEHSRKHGLANDFEQVRVYDRLSRAVDHLKSDLRMSGDSVQLKSLPVPELPDVTFEIAHLKNLETVDCDLHALPATLENLFLLETLSLKGAKNFKALPDAVWRLPALQELKLSETGLKSLPPVGGGSALQRLTIEDSPLEQLPAGFADLDQLASLSLSNTKLEKLSSGIGQLPALKSLSLQDNPKLERLPKSLGQVEELTLIGGRIHALPSASGMSSLQKLTVDNSSLAKLPADFGALGNLAHVSLSNTKLRDLPASIGNLFTLKTLSLQDNPKLGSLPASFGQLSGLQELTLNGNRIHELPSMGGASSLQTLTVDDTALAGLPADFGALRNLAHLSLSNTQLRELPANTGNLHALKTLSLQGNQQLATLPSSLGYLSGLEELTLKNSSVSELPPMGPGSALKTLTVENSPLTSIPADIGIQCERLTQLSLSNTQLRALPSSIGKLSNLKGLTLKNNARLELLSESGVRKLESVRKIDLSGCVRLTGLPSSIGKLPKLRTLDLSGCTGLSMASLPRSLVLPRDGLNVIFPEHLKTDVGNARIQQNPRARLLEGHLERQNEAMNHAMFGDDESVGSMTSVPDNEAGVVSMAFHAKHAYKRLERLRQEAGSSMAAPMRNNDAESMRRALAYAFRSMSDLPTFKKLDNAARSLSYEVQEQLADLVAAPVGQKLVKAIAEGAYGAGRDARAIEQMLPELATRIANHPEIQQLREQAKRYPSSLPPEKLAAKLTPLIQPLWDGTRAVAPMPGQLRQALQDLLVTAEGRQLASEIDRAAHSHRAGDEGKALRGLLPVLAAKIGSDPRVVRVREFVSRHTFGSPQQRAESLAQTLTPVVQELWAQTQAEVAKQGQTPAASPSRQR

SEQ ID NO: 26967 - protein, 431 aa, Dehalococcoides ethenogenes 195
MTQLKQARKNIITPGMKAIAKIEGLPPEFICQGVADGNIVIPANKLRKNLKLCGIGKGLSTKVNANIGTSTDFGTVESEVEKLKMAEMAGADTIMDLSTGPKINSVRQSILKNTCLPLGTVPVYQAAVEAKDRYGAMVKMTADDLFSAIESQAKEGVDFVTVHCGVTRQVIDTFKGQGRLTDIVSRGGTFTAGWMVFHQAENPLYEHFDHLLDICREYDVTLSLGDGLRPGCIADATDRAQVAELLVLGELVKRAREAEVQVMVEGPGHVPLNQIEANIRLQKSVCEDAPFYVLGPLVTDIAPGYDHITGAIGGAVAAAAGADFLCYVTPAEHLSLPDVTDVRNGVIASRIAAHAADIVKGVNGAAERDRQMAIARKKLDWDSQLNLSLDPEHAKLTRDRFKTKGKACSMCGDFCAMELAEKHLGVSVSRC

SEQ ID NO: 26968 - protein, 411 aa, Frankia sp. EAN1pec
MATISAAKNTERSQPFVPCDGYADTGPPAGAERALRGCHPPGRRAHPGEISRARSGNGAETVPQPNSTRGRTRMGRPAVGAGPWHRHGRCAAAGAPRPRPARPARSRKVLMAIVLGPNQYGKAEVRLVHVDRSTPAHRITDLTVSTALRGDFTAAHTRGDNSHVLTTDTQKNVVYAFAREGGVGEIEQFASRLGRHFTTTADWITGARIEIEQHEWERITVDGREHDHSFVRSGRGTRTTVVTVEADAVHAVSGLAGLVVLRSTGSEFHGFPRDRYTTLAETSDRILATEVTARWRYLDADGMSGADFARLAAGIPRALVETFAAEHSLALQQTLHQMGEAVLTAFPEVAEIRMSMPNKHHFLVDLEPFGLDNPNTVYLAADRPYGRIEGTVRRDDVPEAPAAWYGTPGFC

SEQ ID NO: 26969 - protein, 451 aa, Pseudomonas putida KT2440
MSQAVEPSPQCPVQQLTRNGLRKDDPLDQLLLPVRKPVYILLQDHERAQRLAQQLEFFGLVVQALPSAAAFLASISEYPPSAIIMDVDFTGAGLGLLLAAQVQQGLARSIPLLFFSHHEADTPTRLAAVRAGGQDFLTGSLEASSLLEKVELLTNTAPHDPLRVLIIDDSRTQAMYTERVLAGAGMLTRSLTDPIRTMAELADFQPDLIILDLYMPACTGPELAKVIRHSDRYVSVPIIYLSAEDDLDKQLDAMSEGGDDFLTKPFRSRHLITTVRNRAARARHLKARMVRDSLTGLYNHTHILQLLEDCSFRARREQQPLSFAMLDIDHFKKINDRHGHPMGDRVIKSLALFLKQRLRKTDFIGRYGGEEFAIVMPNTALDAAHKVLDEIRRRFAEILYPAQPRDLQCTFSAGVVQLDEGLDALTMASAADEALYRAKHAGRNCVVRVEP

SEQ ID NO: 26970 - protein, 606 aa, Ashbya gossypii ATCC 10895
MAAIQLEKTLVPLPSTRRNFGTHLSYDRHTNRIAYGSGKSAIVKSLDSDIVVQFTGHGSANVTVVRFSPVAGSQYVVSGDDAGRIMVWSYFEDEEKGQVETKLRSEFQVLAGAVADISWDFEGRRLCVVGAGRDRYGAFISWDTGNSLGEVTGHALNVNACHIRQARPMRAATVSDDGSMVFYKGPPFQFSCSDHTHHANGKFVRDVRFSPAKGAYLVSVGSDRKIVLYDGDSGEFIKYIGEDSEECGGFFSLAWVDDGDKSNRIVTASADGVVRLWDVEANRLLKRWELGTEVAQQQVGVVVTRDSNIISVSLDGTLNVFSIESDKPIKTIEGHKKGITALKTNPLVTASYDGRVLEWSAEGTAAVAAMHSNSVTSINNVGGRTCTVSWDGTLKVDNEEKHKFPDDPKASVAFEGMVALITNNKRLVLVKSESGLVVQETALSRSPCVVTMAKSHVAVGYEDSNIIDVFLVSDFATRFELALTIRGTPSALSFSPTEQYLAVGDVMGKILLFNVEQRTVVTSRWSFHTGKITSMDWRPDEDDENYIATAALDTHLFIYSVKKPMRVIKMLNAHKDGINMLGWEDPDHLITGGQDACIKRWRVSFS

SEQ ID NO: 26971 - protein, 649 aa, Wolinella succinogenes DSM 1740
MNPKSFITTPIYYVNDIPHIGHAYTTMIGDSLAHYYRLIGHETFFLTGTDEHGQKIEQSAQKKGKTPQAYADEISGAFKSLWDRFEISYDHFIRTTDAKHKQGVQKAFLKMFEKGDIYKGEYEGHYCVSCETFFTKRQLVDDLYCPECGKETSLVKEESYFFALSRYQEKLLAWYKENPDCILPKPKKNEVMRFVESGLDDLSITRTSFDWGVKLPQEMNAPKHVMYVWLDALLNYVTALGYGDDEKRMDFWPARVHLVGKDILRFHAIYWPAFLMSLDLPLPKHVAAHGWWTRNGAKMSKSVGNVINPQEVADAYGVEPFRYFMLREVPFGQDGDFSQKALIDRLNSDLSNDLGNLLNRLGGMSGKYFDYQITSKEVTTFHAKELQEAELILDSLHGYIQEMQPHRYLEELWKIFTIANTAIAMHEPWKLMKEGKESQAMALVALIANLLAKATLMLSPIMPKSAAKIAQALNLEISTASYERLIIQKALLEEFTFTPTPPLFPKIEEPLMKSDTMITQATSSAPLAKEEKVATPQGLAENCISIEEFFKVELKIGTILSAEAVEKSDRLLKLSVDVGESEPRQIVAGIRAFYTPESLIGTQACVVCNLKPAKLMGLMSQGMLLAAKDEEGLCLLRPEKRRKSGSKVS

SEQ ID NO: 26972 - protein, 280 aa, Wolinella succinogenes DSM 1740
MLEAIFEKIKECAPYIQGVIGESAGEYFETKNATGDQQLKADLKADMIIEQEFAKIPSIKGLCSEEKEGCLILNPEGRYMIAYDPLDGSSLVEVNMSVGTIFGIYEGEFGAKNLIASAYIVYGPGIELVIAHEKVELYTFQFGRFEHRKTLALQEKGKINAPGATQACWHPKHKEFIDSLFAEGYRLRYSGGMVPDLHNILIKGGGLFSYPGASDNPKGKLRMLFEALPFAFIFEKAGGAAIDGKKRLLELEHSHLHDTTPCFFGSIHEIERVRSVYQEL

SEQ ID NO: 26973 - protein, 378 aa, Arabidopsis thaliana
MSDLPLDLVEKILSRVPATSLKRLRSTCRRWNALLKDRRFTEKHFHKAPKESRVLMLKEYRVFPISVNLKVTPPSVDFKGALGYSHSNSEQVVITEVFHCDGLLLCTTNDDRLVVWNPCLGETKWIQLKVDYRRYVSIFALGYIQNNESCRSYKILWTWYSYDYNSSPPQRGLGFEIYEFSSDSSWRVLDDVNHDSVVNHNSIIRSGVSLKGNTYMLAYDIEENSKFLLMFDFTTERLKRLCLPHFQDVGEMDLSVREEQLSVLNWSRITSKMEIWITNNFDTEATLLWKRVHLDSQCNCVRIFSSLYFDEEKKVVLYCNVKDGETSKKVVYIIGEDDGHYIEIPFVKSIKIERLQLIHTTRWYSLIFNYVPSLFQIQ

SEQ ID NO: 26974 - protein, 372 aa, Arabidopsis thaliana
MMMSDLSLDLVEEILSRVPATSLKRLRSTCKLWNALFKNPGFTKKQFLKAPKESLVLMLKEYSVCPMIANLSVSAPSIEFKGALNLKNYPPYSEEVDIHEACHCDGLLLCTTMDYRIVVWNPCLGETRWIRWPKNIYSRFALGYEKNKYGRIYKILRCWDRHNSPTGRVDEFEIYEFSSDSWRVLDLVALDCHIASHIGVSFKGNTYWLASDKKDKYGLLLCFDFTTERFTRLCLPPSQDVSKMALSVVGGKQLSLLSQSDSTSKIMEMWVTNIIEDVLMWSKSFTVDIPIRGDYCPYLTSYLVDEEKKVAVCYNENFEKSNKKVYIIGEDNGYYTEIPLVESSYQVWGYPIIFNYVPSLVQIEEGGCIIKE

SEQ ID NO: 26975 - protein, 482 aa, Mycobacterium smegmatis str. MC2 155
MRIEDLISSVPTGLWIGGEEREAASTFNVLDPSDDQVITAVADATAEDAIAALDAACAVQDEWAATPARTRGEILRSVFEKITERADDIAALMTLEMGKVLPESKGEVAYGAEFFRWFSEEAVRIDGRYTHAPAGTGRILVTKQAVGPCYAITPWNFPLAMGTRKMGPAFAAGCTMIVKPAQETPLTMLLLAKLMDEAGLPKGVLSVLPTSNPRGVTGALIDDGRLRKLTFTGSTGVGKALVKQSADKLLRTSMELGGNAPFIVFDDADVDAAVDGAILAKMRNGGEACTAANRFHVANSVREEFTEKLVKRMSEFTLGKGLDPSSTLGPLINSKQVATVTELVSDAVSRGATVAVGGVAPGGPGNFYPATVLADVPADARILKEEVFGPVAPITGFDTEEEGIAAANDTEYGLAAYIYTQSLDRALRVAETIQSGMVGINRGVISDPAAPFGGIKESGFGREGGIEGIEEYLDTKYIALTK

SEQ ID NO: 26976 - protein, 542 aa, Oryza sativa (indica cultivar-group)
MVLVGFLITLPVLVFVFGGRWGSFQTTSAPNVGGRHVVPGGVTTTQKNEAPKNVSVPATATKSLPQPQDKLLGGLLSAAFEESSCQSRYKSSLYRKKSPFPLSPYLVQKLRKYEAYHKKCGPGTKRYRKAIEQLKAGRNADNAECKYVVWFPCNGLGNRMLTIASTFLYALISNRVLLMHVAAEQEGLFCEPFPGSSWVLPGDFPHNNPQGLHIGAPESYVNMLKNNVVRNDDPGSVSASSLPPYVYLHVEQFRLKLSDNIFCDEDQLILNKFNWMILKSDSYFAPALFMTPMYEKELEKMFPQKESVFHHLGRYLFHPTNKVWGIVSRYYEAYLARVDEKIGFQIRIFPEKPIKFENMYDQLTRCIREQRLLPELGTAEPANTTAEAGKVKAVLIASLYSGYYEKIRGMYYENPTKTGEIVAVYQPSHEEQQQYTSNEHNQKALAEIYLLSYCDKIAMSAWSTFGYVAYSFAGVKPWILLRPDWDKERSEVACVRSTSVEPCLHSPPILSCRAKKEVDAATVKPYVRHCEDVGFGLKLFDS

SEQ ID NO: 26977 - protein, 368 aa, Arxula adeninivorans
MAAQVEEQVLNLRAQADHNPSFVLKKPLELGFEERPVPVITDPRDVKIQVKKTGICGSDVHFWQHGRIGDYVVEKPMVLGHESSGVVVEVGSEVTSLKVGDRVAMEPGVPDRRSKEYKMGRYHLCPHVRFAACPPTDGTLCKYYTLPEDFCVKLPENVDFEEGALVEPLSVAVHTARLLGIYPGSKVVVFGAGPIGQLCIGVCKAFGASIIGAVDLFEQKLETAKEFGASHTYVPQKGDSHDETAHKILELLPNKQAPDVVIDASGAEQSINAGIELLERGGTFGQVAMGRTDYIQFAVSRMAMKEIRFQGVFRYTYGDYELATQLIGDGKIPVKKLVTHRRPFEKAEEAYELVKSGVAVKCIIDGPE

SEQ ID NO: 26978 - protein, 426 aa, Calothrix viguieri
MYTAKGLASANVDVTLIDKRNFHLFQPLLYQVATGTLSPSDISAPLRSILSKSKNTKVLLGEVKDVDTKTQEVILNDRVVRYDTLVVATGANHSYFGNDEWKEVAPGLKTIEDALEIRSRIFNAFEAAEKETDPQKRRALLTFVIVGGGPTGVELSGAIAELANKTLQEDFRNIDTSETKILLLQGADRVLPGMAPSLSQAAKASLEKLGAIVQTQTRVINIENSIVTYKQGDELHEIASKTILWAAGIQASPMGKILRLRTGAECDKAGRVIVEPDLSIKGHKNIFVIGDLANFSHQNEQPLPGVAPVATQEGEYVAKLIQKRLQGKTMPAFKYNDYGSLAMIGQNAAVVDLGAIKLKGFFAWIFWLLIHIYFLIEFDSKFLVMFQWAWNYITRKRGSRLITGQESLTLAKVITKQPTIEKTVKI

SEQ ID NO: 26979 - protein, 125 aa, Zea mays
  misc_feature (106)..(106): Xaa can be any naturally occurring amino acid
  unsure (1)..(125): unsure at all Xaa locations
MSLYHQVTCCCGRDGCEPARMMAAKARAAHEVVKAKTRADVTFLAADGNYCKGVVTLANGLRKVGSAYPLMASLLADVPETNRRILVSQGLILREIEPDYPPENAXTSVPYVYYVINYSKLRIWQ

SEQ ID NO: 26980 - protein, 412 aa, Zea mays
  misc_feature (79)..(79): Xaa can be any naturally occurring amino acid
  misc_feature (126)..(126): Xaa can be any naturally occurring amino acid
  misc_feature (158)..(158): Xaa can be any naturally occurring amino acid
  misc_feature (211)..(211): Xaa can be any naturally occurring amino acid
  misc_feature (231)..(231): Xaa can be any naturally occurring amino acid
  misc_feature (344)..(344): Xaa can be any naturally occurring amino acid
  unsure (1)..(412): unsure at all Xaa locations
MASPAAVKKVLVPIAAGSEPAEAFVPIAVLRRAGADVTVAAAGAGTGLRVHAMYGVTVVADASVADCADASYDLVVLPXLNDAQGGVPGADNLGGCAALEGIVRRHALGGGLCAAICAAPPLALSXWGLLDGVKVTTWPAFASSFVLRARVYRCTFPXEVAGVDANVVVDGRVVTGRGPAAAMEFALALVEQLYGKGKVDEIAKPMMVRYXTLDPGYASEELNPVQWRCSXTPRVLIPVANGSEEMEVLVTVDVLRRAKADVVVASAEEVVVVARHGTRIVADALLRDAAGQQFDLIVVPGGMPGVKTTLADKVELMALLKEHAAAGRAYGAIGAATAQVAGAXALIRGSLKATTCASRADRPSECGSMVVVDGNLATSGSTGTAMEFALAVVEKLLGPAAAREVAEALLFV

SEQ ID NO: 26981 - protein, 354 aa, Triticum aestivum
MGEEEKKPKEEEKPKEEEPKKEEKPKEGEEDKPKDDKPKEGEGEGEKPKEEEAAPPPPPPPPEEVVMRVYMHCEGCARKVKKILKRFDGVEDVIADSKAHKVVVKGKKAAADPMKVVERVQKKTGRKVELLSPLPPPPEEKKEEEKKEEPEPPKPEEKKEPTVISVVLKVHMHCEACAQAIKKRIEKMKGVQSADPDLKASEVTVKGVFEEVKLAEYVHKRTGRHAAIIKSEPVAPAEKAGEGDAKDEKKAAEGGEEKKDDKEEKKDDKDGAADEKKEEKDKEDGGAGGEEKEKEKDPGAIAAANLYMHYPQFAFPGGYYPPRPGYAAYPPPPAYPPYPPQIFSDENPNACSVM

SEQ ID NO: 26982 - protein, 373 aa, Physcomitrella patens
MRKTLKKCCCFASLMELCVRASVEGRRAHHLVTLSSLFNKGTQPTIKANKPSVSYGQALQAKKEEDFVIVKTNCQRIPGDGSSTYDAFAVLDGHNGSAAGAFTKENLLNNVVNAVPSGLSRDEWLAALPRAMVAGFVKTDKDWRSKGIFSGTTVTLVIVDGYIVTCACVGDSRCVLDAQGIVTALTIDHRFDTNEEECERVVASGGQVARLHPYGCDIGPLRSWPGGICLSRTIGDVDAGEHIVPVPHVKQIKLSPGGGRLIIASDGVWDALTSEKAAKVCRGEKHPEVAAKNIVKEVIKVQGLRDDTTCLVVDIVPPGRASRSFAPAVRKQMMVMRFLRRTRSKKGSGSGAPMEELFEESSATLSERLRPVT

SEQ ID NO: 26983 - protein, 86 aa, Glycine max
  misc_feature (61)..(61): Xaa can be any naturally occurring amino acid
  unsure (1)..(86): unsure at all Xaa locations
GKYERVGTTQKRARAGKVAPFTGLKYMAVVPTRKTNQELTFIDRNGGGVLCLQVWPRAGKXMRVTLFYVPDIDDAHVGDEVQYLLM

SEQ ID NO: 26984 - protein, 245 aa, Chlorobium tepidum TLS
MFTGKTAVVTGAARGIGQSIALDLAAKGADLVIGDIKAEWLTETEEALKQLGAKVSCKELDVTSTDACQKVFDEVAKENGRIDILVNNAGITRDGLLMRMSEEDWDAVLTVNLKGVFNCTKAVTRTMMKQRSGSIINIASIIGLMGNAGQANYAASKGGVIAFTKSIARELASRNVRANAIAPGFISSKMTDALSEEVRQKMLEAIPLGVFGTPQHVADAVAFLASDQSAYITGQVLSVNGGMYM

SEQ ID NO: 26985 - protein, 1317 aa, Pseudomonas fluorescens Pf-5
MATTTLGVKLDDPTRERLKAAAASIDRTPHWLIKQAIFNYLEKLEGGATLTELSSATAKDGEDAGEVQTDHAHQCFLEFAESILPQSVLRASITAAYRRPEPEVVPMLLEQARLPAATAEAANKLAASIAEKLRNQKSAGGRAGIVQGLLQEFSLSSQEGVALMCLAEALLRIPDKGTRDALIRDKISTGNWQPHLGNSPSLFVNAATWGLLLTGKLVSTHNEAGLTSSLSRIIGKSGEPMIRKGVDMAMRLMGEQFVTGETIAEALANASKFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLSVPEVIYPQFATHNAHTLSAIYHIAGQNYYPGQYEFQCLHGMGEPLYEQVVGKVAEGKLNRPCRVYAPVGTHETLLAYLVRRLLENGANTSFVNRIADQSISIQELVADPVTQIEQMATLEGGFGLPHPRIPLPRDLYGAERANSAGIDMANEHRLASLSCALLATAHNNWKAAPMLGCAASSETPAPVLNPSDHRDVVGHVQEATVEDVDNAIQCALNAAPIWQATPPAERAAILERAADLMEGEIQPLMGLLAREAGKTFANAIAEVREAVDFLRYYAVQARNDFSNDAHRPLGPVVCISPWNFPLAIFSGQVAAALAAGNPVLAKPAEQTPLVAAQAVRLLLEAGIPEGVLQLLPGQGESVGARLVGDERVKGVMFTGSTEVARLLQRNIAGRLDNQGRPIPLIAETGGQNAMIVDSSALTEQVVIDVVSSAFDSAGQRCSALRVLCLQEDSADRVIEMLKGAMAENRLGNPERLSVDIGPVIDAEAKAGIEKHIQAMRDKGRNVYQMAIADGEECKRGTFVMPTLIELESFDELQREIFGPVLHVVRYKRKEIDQLIAQINASGYGLTLGVHTRIDETIAKVVDNVHAGNVYVNRNIVGAVVGVQPFGGEGLSGTGPKAGGPLYLYRLLSTRPVDAIEQSFARGDAENAPDLRLREVLSKPLNALQAWAESSKLAELAILCKQFAGQSQSGITRQLTGPTGERNSYAILPREHVLCLAEVEGDLLTQLAAVLAVGGSAVWPESEISKALFARLPKEVQARIQRVADWSKDEVVFDAVLHHGDSDQLRSVCQQVAQRAGAIVGVQGLSHGETAIALERLVIERALSVNTAAAGGNASLMTIG

SEQ ID NO: 26986 - protein, 288 aa, Prochlorococcus marinus str. NATL2A
MNYKLKTRSEWLDEYHQGVRYGLQGKLILEESSPFQKITIYESKRYGKALLLDDCWMTAEKSEKCYHECLIHPALCCSTQIENILIIGGGDGGSARECLKYKEVKSIDLVEIDLRVIELSQKYLPTIGGDAWSDSRLNLQIKNGIDWVKHTQENSYDVIIIDGADPIGPSKELFSNSFLKDCKRILKQGGVLATQSESPESFQKIHINIVKVLREIFDYADPMYGSVSIYPSGLWSWTFASMKQQRYMHPKKSRVKEISENCQIWSTRWQQGAFNSIPAFIERELAKK

SEQ ID NO: 26987 - protein, 365 aa, Dehalococcoides ethenogenes 195
MDFKLTVLPGDGIGPEVMAEGLKVLNAVAKKYKHSFEYQYGLIGGCCIDKEGVALSPETLAMCKKSDAVLLAAVGDPRFDDPKLPVHPEDGLLALRRGLGLFANIRPVKVAPSLVNSAPIKAEIVKGTDFIFIRELTGGVYFAKPKKRWTTPSGIRKATDSMTYSEKEIERIVRVGFELARSRKKKLVSVDKANVLLSSRLWRQIVIEIAKDYPDITVEHILVDACAMKLILAPTYFDVIVTENMFGDILTDEASMLAGSMGMLPSASLAGIPAKGTKTFGLYEPIHGSAPTIAKQNIANPIATILSIAMMLRYSCGLETEAAEIEAAVDKVLAAGYATIDIFKEGNTKLGTAEMGSQIAKIIGG

SEQ ID NO: 26988 - protein, 580 aa, Oryza sativa (indica cultivar-group)
MDEKRAARTPRAGARNAVNGGESGCCSEKAARWGWRAPVELAVVGFVATLTLLVLLYGGTGSLLSFTSPRTEFVRKLAVQLHRAAAAASPSHGAPEDTPESSTRHDDDRLLGGLLSQAFDEHSCRSRYTSSLYRRRSPFRPSTYLVERLRRYEARHKRCGPGSALFQEAVEHLRSGRNAARSECQYVVWTPFNGLGNRMLALASTFLYALLTDRVLLVHAPPEFDGLFCEPFPGSSWTLPADFLITDFDGVFTMWSPTSYKNMRQAGTISNATAEQSLPAYVFLDLIQSFTDAAFCDDDQQVLAKFNWMVIKSDVYFAAMLFLMPAYERELTQLFPEKEAVFHHLARYLFHPSNDVWGIVHRFYEAYLARADELVGLQVRVFPEMPIPFDNMYEQIIRCSEQEGLLPKLGQTVVVTAANGSSVVAPSTKLTSILVTSLFPDYYDRIRGVYHARPTETGEYVAVHQPSHEREQRTEARGHNQRALAEIYLLSFCDRVVTSAVSTFGYIAHGLAGVRPWVLLRPPSPVARAEPACVRSETVEPCLQALPRRMCGAAEGSDIGALVPHIRHCEDVQKGVKLFS

SEQ ID NO: 26989 - protein, 590 aa, Oryza sativa (indica cultivar-group)
MERSGGGGADGDEERLPLHHGFETERAAPWAAAESKPPPPPRGRFGRASVRAALAVCFLAIPAVLLLQRWQAGSSPEWLFEIEPPADGDRDMQDDLPDDLTASQYIGYDKFLGGLLQEGFDEVSCRSRYQFARYHKNFTRIPSSYLLERLRRQEALQKKCGPGTKSYKQAVKLLRSSQGVNMTTDCNYLFLTVHAGLGNRMLEIASAFLYALLTNRILLLDRYQEIGDLFCEPFPGTSWLMPSDFPLNYGEFTQSSPESYGNMQQNKVVGDNTDRSLAGFRPPYVFLYLDGNYEFHDKLFFCEDDQQFLQDVPWLIMRTDMYFIPSLFLIPSYQDELSRLFPEKDAVFHHLARYLFHPTNSIWYSVKGYYRSYLAKANKTVGIQIRIFEKEGILQKNGRFPYVLEQILSCAQNEKLLPEISMKDEAEAPTATKNNQTIAVLTTSLSSWYSDQIQKKYSEHPTVDGTRVEVYQPSHEEYQRSKNKKHNMKALAEIYLLSMTDVLITSGFSTFGYAAQGLSGLTPWIMFRSENHAMPDPPCRRAMSIEPCFHQAPFYDCKAKRNADLGKMVPFVRHCEDVSWGLKVVNQTQW

SEQ ID NO: 26990 - protein, 1425 aa, Ashbya gossypii ATCC 10895
MTAGHRDERPDREGGSERDEHLNRVVQSVSDATKRLSQISNSSTAHTKTGKRKNRDTVGPWKLGKTLGKGSSGRVRLAKNMQSGKLAAIKIVPKRNVRHNQKQVTALPYGIEREIIIMKLITHPNIMALYEVWENKSELYLVLEYVEGGELFDYLIARGKLPEQEAIHYFKQIVQGVSYCHNFNICHRDLKPENLLLDKKNKTVKIADFGMAALETTNRLLETSCGSPHYASPEIVMGQKYHGSPSDVWSCGIILFALLTGHLPFNDDNVRKLLLKVQHGRYQMPSNVSKEAKDLISKILVVDPEKRITVDKILEHPLLVKYDNPGKGGLACPLEKPEERPKVLDIHSIDDIDETILSNLQILWHGAPKEYLVDKLLQSGFTEEKLFYALLLRYQQRQSVEPTSVPSNMASTNGSGAFARASNNDQSVINAPKVTQKSQFSINSLLVSPKKTREGYVASSSRVFKHSVSRRSLHVSPSPMKSSTSCRSLKSSSSKRLQSPNPKAITQPVKVTSPQPRRRTLHNSASKRSLYSLTSISKRSLNLNEFLQEANEVKTPKLPSMPLQDQPRSEAPKTPTKTTYGADSHGGEKPTFISVLHDCPTVDSEGMVFKSSSGTPMIAANAPIIQPAFIFGVGAFPGTKQPSSNSLSKPSLNSQSSPKQAQEATANSMRETIRDRQTLVVEKRVPSKTESVPPAFPRVRPIMERKHGSDLTLVRDTRSVAKEKRSSLSLDPRRTAPEPPRGIETLLRRYSLKNSIKSRSSLKKKRDSGAWSITDKTIFQDLGQVPEDEEQEKDSEEKGNDTFISTTETSDTPSSKFKVTTSTPIKKDDATAISAENAAVGTEQSGSEDEATNFDSNAHSYPISTDLKTEDDLTPIKPQGQTDLLRMPSSFMNSSNTFANLNNFISNIDKEYSPENSDSGRIEKDEPAGKAQPEQITVKKRQRTLAPGGYLSPSIPRMESENSLNQELGSRISDLSDLSFANDMPTYTNTAHAVSISPGTRNVCSFSPLEPRSPQDVSNNGKMRSNLHIPLRQLSEDMCDKTITTQEGESVNIFEDAPEEEGSLTTSTSGSVPNIHQKAISIDTMNTSCALVPVSHVRTSIHMNGDSSVLDWSTSDGILSKARPLPTSNHVRKKSGNRLSNNLTLSKSMMSMFKNLDQINVTDIQDPMPVSDLLSKGVDPIEPIEPLKNDQVTLKAESIGAESDSINMDLADRKHVTIFHDNVSDKNFKSTRMENSDKGSLGSGAPQATHLFHTGNKDMKSHETLLSPITETPAAALSATSLTRKESISSDGKSVKDETKKSGKGNWFMRLIMSFTKPKKTVIQEHMTVLPFDDVNIITLQQFSYQGVEYEIRQMERRKDKQKVEYDCRLLDGDFKFKINIYGENSAATKVSVKQKGRSDELAFTKLNTDIEALIKAKENAANVK

SEQ ID NO: 26991 - protein, 582 aa, Kluyveromyces lactis NRRL Y-1140
MGKMSFIEGLQKRFFLGYSYKYNTFELDPIILATSIKVAVLDYFRNTPWYWIIRDAVFYHLLFNVLSRIILYIRGYGLLTSISKLFHYASRRLFEVLLSLPMVRGSVDKEVSKVLATIEKDMIKNDANLKDFPELPRTGLSEADVLKELDKLNSVLKHSDWENGKVSGAVYHGGDDLIDLQSKAFKKFCVANQLHPDVFPGVRKMEAEVVSMVLNLFNAPPTGCGTTTSGGTESLLLACVSAKMLGLRYKGITEPEIIIPKTAHAGFDKAGYYFGIKIHHVDLDPVTFQADVKQMRKLINRNTVMLAGSAPNFPHGIIDDIVSIGKLGETYKIPVHVDCCLGSFIVAFMSKAGFNDVPLFDFRVPGVTSISCDTHKYGFAPKGSSVIMYRNPELRKQQYYVSTEWTGGLYGSPTLAGSRPGALVVGCWATMVHVGADGYINSCKDIVGKARELKEFIQKEIPELQILGDPLCSVISFTSNKIDIYELSDTLSKSGWHLSALQNPSSIHLALTKLSLKSVDELKHLLKSTVDKMKQSPDAKPSSDGTSALYGVAGSVKTVGVADRLIEGFLDSLYKLEPEHAT

SEQ ID NO: 26992 - protein, 797 aa, Gibberella zeae PH-1
MSDDWTADPLVLDFEHLARSDVGLVGGKNSSLGEMIRALGPEGIPVPPGFATSSYAYWHYVDANNIRGKIDELVDQWQSGHQTLAETGHAIRTLFLRGTWPADTTEAILSGYRDLCDKVGVDDVSVAVRSSATAEDLPDASFAGQQETYLNIQGSEALLDACRRCYASLFTDRAISYRHIKKFNHENVALSIGIQQMVRSDIGGAGVMFSIDTESGFDKIVLINAAWGLGENVVQGTVNPDEYQIFKPLLSNEKLSPILSKKLGDKAIKMVYGDKCVPTRNVPTSRAERASYVLEDDEILQLARWACRIEEHYSCPMDMEWARDGSSGKLYIVQARPETVQSRRDTAAFKTYKVGEHGHTLTTGLSIGDKAVAGRICLLTSVSDMDKFIDGSILVTESTDPDWVPVMKRAAAIVTDYGGRTSHAAIVSRELGVPAVVGTGNATYVLHTGQDVTVSCAESDSGLVYDGISDITTKTVQISDFPSVRTKIMLNLANPSAAYRWWRLPVDGIGLARMEFVVSNSIRVHPMALIHFDHLEDEAAKKEIADLTAGYAYKPDYFVDKLASGLATLCSAVYPKPAIIRMSDFKTNEYARLIGGAEFELKEENPMIGFRGASRYYSPRYKEGFALECRAVKKVREKMGLTNAIVMIPFCRTVKEARKVLDVMEQNGLKRGEKGLMVYVMCEIPSNVILASSFTQHFDGFSIGSNDLAQLTLGVDRDSGELASLFDEQDEAVKWMIARAITVARREGCKIGLCGEAPSNHPEFAEFLVNAGIDSISVSPDSFVQVMKHIVACEKGL

SEQ ID NO: 26993 - protein, 553 aa, Oryza sativa (indica cultivar-group)
MQVQQRKPKACAESAAAARGADQQQCDCRPLEAGEESLERSVPRKRKPAAAVAAAEKRWSSVAYVVLAAFVMATVFAVLGGRRPAVWIAATKALRRGSDDKSIPLARSAADKLLGGLLPEGFDEKSCRSRYESYLYRRNPGRRPSPHLVARLRMHEELQRRCGPNTESYNRAVQRLRDGGAAEADAHSPDDEQCKYVVSISYRGLGNRILAAASAFLYAVLTGRVLLVDPSNEMDELFCEPFPGTTWLLPRDFPLASSNANFSADTAESYGNMLKNKVLGTDGSTDGDMPAAQMPAFAYLHLDHDYGDGDKMFFCDDDQRLLSNIQWLVMRTDTYIVPSLFLVRVFDHRQAKSPHVVLEQITSCAWKEKLLPEVLDAVEDAAMPTPPTTPHGGSNNSKAVLITSLRPWFYERIKAMYWERATATGEDVSVHQPSHEEYQHFGEKSHDGKAWAEMYLLSLCDVLVTSGWSTFGYVAQGLGGLRPWVMYKPVNITAVPDPPCGRDVSMEPCFHSPPFYDCKTKRGVDTGTILPHVRHCDDVSWGLKLVDPNGSPN

SEQ ID NO: 26994 - protein, 457 aa, Propionibacterium acnes KPA171202
MSTEVTLPALGESVTEGTVSRWLKAVGDTVEADEPLLEVSTDKVDTEVPSPASGTLLEIKVPEDEDAEVGAVLAIIGDPSESGSAPAKPTAEPAEKAKPEPVKSEAEEAPAPAAPKPAEAPKPAGTNEVAPRATNPSSDVYVTPLVRKLARENNVDLSTITGTGVGGRIRKQDVLAAAGKSGEAPSAPQAPAAAPAPAAPKPAGSARKASQEVSPEAAALRGTTEKMSRLRKVIASRMVESLQISAQLTATVEVDMTAISRIRNAEKAAFKAREGVGLSYLPFITKAVVEALKANPTFNANIDTEAGTITYGSSENIGIAVDTPRGLLVPVIKNAGDLNIAGLAHQIGDLAARTRDNKVTPDELSGGTFTITNYGSAGALFDTPIVNQPEVAILGTGALVKRPVVVTNEFGEDTIAVRDMMYLSLSYDHRLIDGAVAARFLSGIKARLEEGDFAGEF

SEQ ID NO: 26995 - protein, 740 aa, Arabidopsis thaliana
MCELDILHDSLYQFCPELHLKRLNSLTLACHALLDCKTLTLTELGRNLPTKARTKHNIKRIDRLLGNRHLHKERLAVYRWHASFICSGNTMPIVLVDWSDIREQKRLMVLRASVALHGRSVTLYEKAFPLSEQCSKKAHDQFLADLASILPSNTTPLIVSDAGFKVPWYKSVEKLGWYWLSRVRGKVQYADLGAENWKPISNLHDMSSSHSKTLGYKRLTKSNPISCQILLYKSRSKGRKNQRSTRTHCHHPSPKIYSASAKEPWILATNLPVEIRTPKQLVNIYSKRMQIEETFRDLKSPAYGLGLRHSRTSSSERFDIMLLIALMLQLTCWLAGVHAQKQGWDKHFQANTVRNRNVLSTVRLGMEVLRHSGYTITREDLLVAATLLAQNLFTHASSSLIDLNQFPSDSEIEDPLNHHQLLSSSCFIAADFETLQNPSSEPCSSLVLFDCKTAGSEKTETKDPPNPNFPCPLSLCLTENKNRKRRAVEQRKRTGGVKKAKVAPFSQTARETPEWLVNVMRDMKEAKDAKLIFEKTLFVTDVNPTQNRLSMPFNNLLRNDFLTSVESRIIDKDIKNDKKIGVGAILVDQRCKKWGVMLKRWEMKKESGPVESSALPWNREALPLLSVSAKFLVSQLETINWLINSYGDLSSGDYGVFFCLISPEHCPKFYWPPEVFILKGLSLSLLLKLASSKSSRTPENLGLVPCDRNNITREADSTMHCLNMSKAKILCHFQDSKLRC

SEQ ID NO: 26996 - protein, 342 aa, marine gamma proteobacterium HTCC2143
MTAINNTKIVLKSRPVGMPVDSDFEILSVPQRAPGSDEMLLKTLWLSLDPYMRGRMSDRKSYAKPLELGDVITGGIVSQVVESNIADYPVGTLVSGMYGWQSYAIAKADDYRLFKVDPELAPISTAVGTTGMPGQTAYFGLLRVGEPKAGETVVVSAASGAVGSVVGQIAKIEGCRAVGIAGGQAKCDYVINELGFDACVDYKAEDFPQQLAAACPAGVDVYFENVGGAVLEAVAPLLNKGARVPICGYISAYNATSEDQIRTPEEVFNGLAHPPFNRFFIVTEWIEEFEESTRRLGQWIKEGKLKYRETVVEGIDSAPSAFRMLFTGENFGKLMIKVADPV

SEQ ID NO: 26997 - protein, 513 aa, Wolinella succinogenes DSM 1740
MRGNLYTLLWQNAQEHPRKTALFVDKLQLNYKELLRESDKVASFLQKEGIKAGDRVALILSNSWEYIATLFGVLRLGAIAVPVNTMLKSDEMEYILKDSGAMLAFISGKFEKEAKNLLYTTGLKKVIWHDAEVKCDARNLRYEEMVEAKNLPKEWAKGSGEVAVIIYTSGTTGFPKGAMLTHDNFFSNLAAVTERFKIHAKDRFIVYLPMFHAFTLTATILLPFYRSCSLVVIKSILPFSNILKQVLLKRVTIFLGVPDVYNALIRAKLPWYFLWFNSVRIFVSGASALSESTLARYKEKFKRAVMLEGYGLSECSPVVAANPLERQKVSSVGPAVPGYEVKIVDDELMELPVGERGEIIVRGGCVMKGYLNHPEATQNTIVNGWLLTGDIGKMDEEGYIYILDRKKDLIISKGINIYPREIEEAILSGFPTVKSCAVVGWQDESLDEIPVAFLEYEEGAKPHSESEIKGYLKKHLANFKIPKHLYVRDELPKNATGKVLKRVLKEELKQAGL

SEQ ID NO: 26998 - protein, 279 aa, marine gamma proteobacterium HTCC2143
MESARDKLMSDKSLDIQTLFSVAGKVALVTGGSRGIGRMIAQGLLQAGAKVYISARHEDVCQQTASELSQYGECIAIAADVADEDSRDKLCEALAAKEQGLNILVNNAGAAWGDSYENYPERAFDKLMKINVTSVFTLTQALTPMLEAAASSQDPARVINIGSMDGLHIPTVHGAGTYAYTASKAAVHQLTRHLAVELGRRNITVNAVAPGFFPSKMTDYVFDQFGEGIRSNSLLGRTGEDEEMAGIAIYLCSRAGAYTHGAVIPVDGGTSINHQHVQN

SEQ ID NO: 26999 - protein, 413 aa, Fagus sylvatica
MAGICCGVVGEGETTAPIELSSRPSRRRRIDLVPLKLMADVAAPQPLETDKKRQKLCLNTTSSLPSQVVENCKCVEEENEEKKKTNKNEALHTNQAANSCESSKPVEGRNNEEAVQECPKFGVTSVCGRRREMEDAVSVHPSVSNNFHFFGVFDGHGCSHVAMRCRDRLHDIVKEEVESVTEGMEWKDTMEKSFDRMDKEVQEWRVPIKTTNCRCDVQTPQCDAVGSTAVVAIVTPEKIIVSNCGDSRAVLCRNGVAFPLSSDHKPDRPDELVRIQDAGGRVIYWDGARVLGVLAMSRAIGDNYLKPYVISEPEVTITDRTAEDECLILASDGLWDVVSNETACGVARMCLRAQKPSSPPRSPGNDMAVGAASESSDKACSDASILLTKLALARHSTDNVSVVVVDLRRNHQQ

SEQ ID NO: 27000 - protein, 519 aa, Frankia sp. EAN1pec
MHHFRQTPIGTWGAIVTATSDEHQKHRVVIIGSGFGGLFAAQALRREPVEVTVVAKTTHHLFQPLLYQVATGILSEGEIAPTTREVLRRQENVKVELGEVVSIDLATKSVTSNLLGRTDVQHYDSLIVAAGAGQSYFGNDHFAEHAPGMKSIDDALELRGRIFGAFEVAETTPDPADAARYMTFVVVGAGPTGVEMAGQIAELSHRTLRQDFRRIDTTKARIILLDAAPSVLGTFGEKLAAKATSKLEKLGVEIQLGARVVNVDSRGIDVEDSDGTRRRIESVCKIWAAGVAASPLGKQLAEQSGAVLDRAGRIQVQPDLTLPGHPEVFVVGDMATLDRLPGVAQVAIQGGKYAAKTISTRLRGGPPMRNFEYKDKGSMATISRFSAVASIKGVQLSGFVAWLMWLAVHLVYIIGFKHRVTTLLHWTVSFIGRGRSERTVTTQQIFARSALQRLGEGFMPTLPDDWASRGPSAATRPAGQPGAVPKARKAPAGNPAPGAESAHLGPDGAASGSASTGTA

SEQ ID NO: 27001 - protein, 583 aa, Yarrowia lipolytica CLIB122
MIPFTKINLELLLLPLLIIPITLFLLVLNVQVNTVHRRYKEYRLKLARCPQQSTGLFGWWLIYAVVRCNRDRFYSAKVVDYFTKLRTFIVSLGGELVIYTSESENIKALLATQFSDYDLGKTRHALLFTLMGDGIFTLDGQGWAHSRALLRPQFSKETVSPLSSLETSLQQLMAIVKRRVALKGEVDIQELFFMLTMDTATNLLYGESVDSLGDCLKETKKETHVMTDGKRNLLQSRDHHSNVPNEWEPIYGTYEKKGLGIGSENSLQSGVSPRDSPVFEVSVSEDIRKAYPAALTTALEFSAMRSKLQRFYWIWGDVLYRQKFHSAVNTVHAFSNHFVNQALKLTPQELQMKSAEKYTFLYELAQRTRDPVAIRDQLINILIAGRDTTAALLSFVFLCLVANPEKLAKLREGIMTDFGTSTDSITFESLKRCVYLRYVINEALRLCPPVPINMRQANKDTTLPTGGGKNHDEPIFVAKNQIVTYSVLFMHHNQNIWGPDASEFRPERWGEPACPKGWEYLPFNGGPRICLGQQYALTEAAYVIVRLVQEFTEIEWRDRKGLPVLFKTHITMSLGEGLRVHMK

SEQ ID NO: 27002 - protein, 553 aa, Prochlorococcus marinus str. NATL2A
MVQYYLEGKKLNQVEKNKAAKDGLEIGKDIDKFAEMGWEQMDKTDLELRLKWYGMFWRPKTPGKFMLRLRIPNGIINAEQLKVIASIVARYGENGSCDITTRQNIQLRGVLISDLPEILNRLKKVNISTTQSGFDNPRNVTGNPIAGVDPEEIIDTRIYTSKMQDHLTSDGKGNSEFSNLPRKWNTAIAGSKDNFLLHNDLIFHPVKINEVLGFSVWIGGVLSSVMNEYAVPLNAWVEEEKIYELTSIILSLWRDNGERNIRPKGRFRFYLDKIGIETFRNLIEKQYGTLKEDPGSIFSDKPRSFFGIHSQKQEGKYFAGIHVPVGRLLAEDLQDLANICENFGDKEIRLTEDQNIIITGIDTNLIEEFKEQSILQKFPLEPETIAAGTVSCTGNTYCGFALTNTKDQALKVSHELDKELDLKDELKIHWTGCPNSCGQAYMGGIGLTGKKAKDKEGKTVEAYDISIGGSQGPNYKLGELIKKSVPQNELKDVLKDLLISDFDAKEKIFLSKKSGSLTRFMNWFSPLGKDKPLINRANGSHDIFSKFMNRISN

SEQ ID NO: 27003 - protein, 397 aa, Fagus sylvatica
MFSELMNFLRACFRAKSDRHVHTGSNARGRQDGLLWYKDSGQHFNGEFSYGCGQANNLLEDQSQIESGSLSLNETGPYGTFIGVYDGHGGPETSRYVNNHLFQHLKRFTSEQHSMSVEVIRKAYQATEEGFLSQVTKQWPLKPQIAAVGSCCLVGVICGGTLYIANLGDSRAVLGRVMKATGEVLSIQLSAEHNVAIESVRQELHSLHPEDPQIVVLKHNVWRVKGLIQISRSIGDVYLKKAEFNREPLYAKFRLREPFKKPILSADPAISVHQLQPHDQFVIFASDGLWEHLSNQEAVDIVQNHPRSGSVRRLIKVALQEAAKKREMRYSDLKKIDRGVRRHFHDDITVIVVFLDSNLVSRASSVKCPSISVRGGGINLPHNTLAPYTTQMEVGST

SEQ ID NO: 27004 - protein, 708 aa, Dehalococcoides ethenogenes 195
MDLSWLVWTAGLIAVLFALYLIRDVMRRDSGTPAMQDIAGRILEGAVAFLRRQYRTIAILAIVAAVAVGAVVGLLGGERGLEAYGITGFGIAWRTALAFMAGALCSGISGIIGMYISVKSNLRCAAAAAKGGLSEAVTVAIRGGAVSGFLIVALSLLGVAGIYYMYGGNPEVTPHLIIGFGFGASFVALFAQLGGGIYTKAADMGADLVGKVEAGIPEDDPRNAAVIADLVGDNVGDCAGRGADLFESTAAENIGAMILGITLYLATGNAAWVLFPLVVRAFGIIASIVGIMFVRGKDNESPMNALNRGYFTAVGLSIIGLFVANQTIGGDLWLFGAGVIGILTSVAMVFITQYYTEFRYNPVKEIANASRTGPATNIVSGTAVGLETAMPTAITIGAALLLSYWMGGQTGIAGGAVFGTAAATMGMLMTCPFILAMDTFGPITDNANGVIEMAGVGGKVRKITDHLDAVGNTTKALTKGYALASAGLAAFLLFEAYLERVAFLRGETEMMAVDLSRIEVFVGGLLAVALVFFFSAVAIKAVGKTASKIIEEVRRQFKADPGILAGTSRPDYARAVDITAAAGLREMIFPGLLPVLSPIVLGIFLKVTGYDSAMAIAGFLMVGTISGIMMAAYLNNSGGAWDNAKKYIETGEMLESDGSPVMKHTVTHAATVVGDTVGDPFKDTAGPSIHVLIKLLSTITLVLAPLFI

SEQ ID NO: 27005 - protein, 564 aa, Candida glabrata CBS 138
MSQAQSLSPSESAENSPVREVNVANSFKDDDFILEQKQTADVSAMSPEAEAPPKPISAYFTVICLCLMIAFGGFVFGWDTGTISGFVAQTDFKRRFGQQAADGSYYLSDVRTGLIVAIFNIGCAIGGLTLGRLGDMYGRRLGLMAVITVYVVGIVIQISSTTTWYQYFVGRIVSGLGVGGIAVLSPTLISETAPKHLRGTCVSFYQLMITLGIFLGYCTNYGTKTHTNSIQWRVPLGLCFAWALFMLVGMSMVPESPRFLVEKGRFEEARRSLARSNKVSMDDPIVTAEIENISAGVEAEKSAGNASWGELFSTKGKILQRVVMGIMIQSLQQLTGCNYFFYYGTTIFKAVGLEDSFQTSIILGIVNFASTFVALYVVDRFGRRKCLLWGSSTMAVCMVIFASVGVKSLYPNGKDQPSSTTAGNVMIVFTCLYIFCFATTWAPTAYVIVAETYPLRVKNRAMAIAVGFNWIWGFLIGFFTPFITTAINFYYGYVFMGCLVFSFFYVFFFVCETKGLTLEEVNEMYEEGVLPWKSAQWLPTTKRTSGYDVDAALHDDKPWYKRFA

SEQ ID NO: 27006 - protein, 483 aa, Bradyrhizobium sp. BTAi1
MPTRALSSYGKPTLLTSFQDFNLADALTRALKEENYTTPTPIQAQTIPIALQGRDVIGIAQTGTGKTASFALPILHRLLENRIKPQPKTARVLVLSPTRELSGQILDSFNTYGRHIRLTSALAIGGVPMGRQVRALMPGVDVLVATPGRLLDLVQGNALKLTQVEFLVLDEADRMLDMGFINDIRKIVAKLPIKRQTLFFSATMPKDIAELADAMLRDPARVAVTPVSSTVERITQRVIQVDHSAKPSLLAQLLKDEPVNRALVFTRTKHGADKVVKGLEKAGIPAQAIHGNKSQNHRERTLAAFRTGEIRTLVATDIAARGIDVDGVSHVVNFDLPNVPETYVHRIGRTARAGADGVAISLVAGADELSYLRDIERLTKTTLPREDRRTPGHRDAAPAGQPQRPGGRPGMQNARANDGGNAAKGPRRRRRSNAKMPALPGNRQEPNRPSQGGGKSGSIQGVAFLHREGRPKNHAHNRNQRPN

SEQ ID NO: 27007 - protein, 195 aa, Triticum aestivum
MATMAGRYCCSYSSPSASAPPPHRQRGPPLQPRPTGGRGRGLRRPSLRAVASAAAEPVKAATDAEFFQPADSRPIMLFDGVCNLCNGGVRFVREHDPGRSIRYIPLQSDSGRKLLRRSGRSPDDISSVVLVEKDRSYIKSDAVLRIMEYLNLPFPQLAAFLKIAPLFVRDFAYDNVANNRYVVFGRSETESCEIL

SEQ ID NO: 27008 - protein, 574 aa, Oryza sativa (indica cultivar-group)
MDLKERIRRSPTPPTQGEELLAASPAGPRGGRKGRAVVLPLSAAALVACAVVLLLLAGGSAARRGQFVGADPTVLPSRGGGVGDLHLSQSKSNDGENVTIASSEVVNDKLLGGLLTTGFDEQSCLSRYQSVLYRKASSHFPSAYLLERLREHEALQKKCGPHTESYKKAIEQLKAGQGAKVMECNYLVWVAYSGLGNRILTMASAFLYAILTRRVLLVDIDKGTADLFCEPFPETSWLLPPKFPIKQFKNFSNGSPESYGNMLKNKAIHSNPAFLYLHMAHDYSDYDKLFFCEDNQQYLRNIPWLILKSDNYFVPSLFLIPAYQEELTRLFPQRDSVFHHLGRYLFHPSNVVWGMVTRYYDSYLARADERLGIQIRVFDPEPGPFQHVLDQVLACTLKENLLPAINSKQPIVSTRHSRLKSVLITSLNSGYYEKIRSMYWEHPTTNGEMISFHQPSHEEHQNSDKKMHNMKAWAEIYLLSLSDVMVTSAWSTFGYVAQGLSGLRPWLLFKPENRIAPDPPCRQVLSMEPCFHAPPFYDCKAKRGADTGKFVPYVTLYLSYRKAIFDMVNTNAVV

SEQ ID NO: 27009 - protein, 456 aa, Escherichia coli CFT073
MEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGAWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 27010 - protein, 567 aa, Oryza sativa (indica cultivar-group)
MFVNFPPVAAIYRSICPFELAKSQQQRPRAPSLLCNKQPHVPHSWPPSSQQRTTTTTVSSHGLFRLPTTLPPPVLTRGSIPPPPSRRPHPPRAVVDRVRAVLLDTGRGRCRVGGAAGAAGGVARGAVLGAQGEVPGKAEPVGEGEAGEGAHIVVHGGRHQGARQDAHGGDRGRQALQGGHRHGRFMMRLKLPNGVTTSEQTRYLASVIEAYGKDGCADVTTRQNWQIRGVTLPDVPAILDGLNAVGLTSLQSGMDNVRNPVGNPLAGIDPDEIVDTRSYTNLLSYITSNFQGNPTITNLPRKRNVCVIGSHDLYEHPHINDLAYMPAVKDGKFGFNLLVGGFISPKRWEEALPLDAWVPGDDIIPVCKAVLEAYCDLGTRGNRQKTRMMWLIDELASGTESCVPKSARWMEFIHKKPSRSKPKEHNSVSHLQSNFQNLNQESRDAMEGSNLKSAALLEQLRVHLASGAGKELVEKIGFVYQLNISPKKLAFDEEVFVVDLKKGVVSKGPYEGKPDATFSFTDDDFLAISSGKLNPQMAFIMGKLKIKGSISAAQKFTPDIFPKPSKL

SEQ ID NO: 27011 - protein, 432 aa, Haemophilus somnus 2336
MTTSATLFYRAQQVIPGGVNSPVRAFKGVGGTPVFIEKANGAYIFDIEGKQYIDYVGSWGPMILGHNHPSILSAVLKIAENGLSFGTPTPLEIELAELICQLVPSIEMVRMVNSGTEATMSAIRLARGYTKRDKILKFEGCYHGHSDSLLVKAGSGSLTLGQPSSPGVPEDFAKHTITCEYNNLQSVKNAFEQYPDQIACVIVEPVAGNMNCILPKQDFLQGLRQLCNEYGSLFIIDEVMTGFRVALGGAQSYYEVTPDLTTLGKVIGGGMPVGAFGGKKEIMQYIAPTGPVYQAGTLSGNPIAMSAGIACLNELKKEGNEQRLAMLTKKLALGLKNLANQHNIPLVVNYVGGMFGIFFTTQNEVTSYQQAIQCDIERFNLFFHKMLEQGVYLAPSAFEAGFMSLAHTDADIDRTLQAADIAFASLRSSSFS

SEQ ID NO: 27012 - protein, 457 aa, Candidatus Protochlamydia amoebophila UWE25
MVKHIVILGAGISGLATAWFLKKLLGSSVQLTLLEANSRAGGWIQTIHSQDFLFETGPRSCRSKGSGREMLQLIEELGLCDEIIGAHSSANLRFLYFQKKLQPLPSSFFHILFNPLVKGWLKAVYRDLNSPRSLKEDESIEEFFSRRIGKEWTSRLIDPFVSGIYAGDCKKLSMKSCFPLFWKWEQENGSLIKGIWNQKKEKKSSSAFVSYWMKQPLFSFKQGMGYLIQSFVHQLDANIHFSSTVKTIEMEKEGATVVLDNGKVFKADHLISTLPASKLAPLLGSEFSETASLLQSMESTSVMVVNCGYRRPVLKKSGFGYLIPFQEKESILGCVWDSAVFPKQNFSPEHTRLTVMMGGTQHPQIDDRQKGLALALSSIERHLAIDSVPDEVYVSLAKQAIPQYQIGHYLTLINLSQSLSLYPQFTFTGHSFDGVSVNDRVLQARLLAVKIAKGFNI

SEQ ID NO: 27013 - protein, 677 aa, Candidatus Protochlamydia amoebophila UWE25
MVKNMSSHLQVSVPQPLDSEQKQIMKQIANTIRGLSMDAVQKADSGHPGLPMGCAELGAYLYGYYLKQNPKNSKWLNRDRFILSAGHGSMWLYSCLHLAGYKITLEDIKNFRQLHSPTPGHPESFMTDGVETTTGPLGQGVGNAVGQALGFKILGEKFNTEKHPIFNNKVYVLMGDGCVMEGISSEVSSLAGHLKLNNLVAIYDANHVSLDGPLAESSSEDTKTRYKAYGWDVFEIDGNDIEAIDTVFSQIRHYQEKPCLVIAHTIIGKGAPNKGGTYKAHGSPLGVEEIKAAKDELGIPQEDFYVPQAVINYFQNKLVSDAKEQNEWKQIFEEWAKENPSKFQELEVMLHHKLPDDFEQKLQHLMIKAPISGRKASQEVLNSLADMIPQLYGGSADLSSSDMTMLKKFSLIAPNEFHGRNIKFGVREFGMATIATGLYQTGMILPFVGTFLTFSDYMRNAIRLAALQHAQVFYQFTHDSIFLGEDGPTHQPVEHYAALRAIPQLQVIRPADSYEVKMSWIAALQYKGPTALILSRQNLPDLAGTNIPYVEGMGRGAYIVKKEKGKADFTLVATGSELSLAMNVANELEKLGKNVRVISMPCWALFEKQPIDYKESLFGGDIGKRVSIEAGVDLGWHKYIGRDGIAICMEHFGASAPAGVLAKEFGFTVEAILERIL

SEQ ID NO: 27014 - protein, 220 aa, Oryza sativa (japonica cultivar-group)
MASTTAAAEDHKGKRPLPPEEADEAAAAPPPAAAEEEGEKLVLVSDDGVEVLASVAAARVSKTLRGMIEDECATGAIPIAGVHSDVLALLVEYCERHAPHYDPEASDRDRYPFPPFPVELPPTASSIKPVTFVDPDADPHGLKAFDKKFLDVDNSTLFEIIMAANYLNIEELLDDACTAVADKMRGKKPEEIRDIFEIENDYTPEQEAEVRRENAWAFED

SEQ ID NO: 27015 - protein, 101 aa, Triticum aestivum
GRPGRYQEDILVHRPPGQAETMPDIQSIEIQTEIQWFMRPYLLDFLLEAHHAFQLLPETLHLARDLPDRYCSRRVVYKRHYQLVGCAALLIAAKYLGRDHA

SEQ ID NO: 27016 - protein, 939 aa, Mycobacterium smegmatis str. MC2 155
MTLLSEPDFGTPAKPGPATVTVEVDGIPVSVPEGTSVMRAAAEAGIDVPKLCATDRLDAFGSCRLCLVEIDGRRGTPASCTTPVAEGMVVHTQTPKVAKLRESVMELYISDHPLDCLTCPANGDCELQDMAGVVGLRQVRYGYEGANHFDAEPDHSNPYFDFDPSKCIACSRCVRACGEIQGTFALTIEGRGFESKVSPGAGELFMDSECVSCGACVQACPTATLQERSVVELGIPTRSVTTTCAYCGVGCSFKAELRGDELVRMVPQKAGGANEGHSCVKGRFAFGYATHPDRVLRPMVRDKITDPWREVEWDEAINTVARRMQEIAQRHGAGAIGAITSSRCTNEEVYVVQKMVRAAFGNNNVDTCARVCHSPTGYGLKQTFGESAGTQDFRSVAEADVIVVIGANPTDGHPVFASRMKQRIREGARLVVVDPRRIDLVRSPHIEADHHLQLRPGTNVAVVNAMAHVVVTEGLTDASFVAERCEGFEEWAEFIAREENSPEAVEPITGVPAEELRAAARLYALAPNAAIYYGLGVTEHSQGSTMVMGMANLAMACGNIGRDGVGVNPLRGQNNVQGSCDMGSFPHELPGYRHVSDDAVRQVFENLWGTELLAEPGLRIPNMFDAAIEGSFRGLFVHGEDIAQSDPNVKHVLAALESMELVVVQDLFLNETSKYAHVFLPGASFLEKDGTFTNAERRINRVRAVMKPKSGMHEWDIVCRIATAMGYPMHYDHPSQIMDEIATLTPTFTGVSFDKLDQLGSIQWPCDEEAPEGTPIMHVDAFTRGLGRFVPTPFVPTDERSTRRFPLILTTGRILSQYNVGAQTRRTANIAWHAEDVLEIHPHDAEVRGIADGDLVTLASRVGETTLHAQTSDRMPTGVVYTTFHYPVTGANVVTTDSSDWATNCPEYKVTAVQVALAPPSARQAEARVDELPETELVR

SEQ ID NO: 27017 - protein, 349 aa, Uromyces viciae-fabae
MATQTLPAQMTALYYEKPRDFSIIKADVPLIDHDEVLLKVSMCGVCGTDQHIHEGEFIAKFPLIPGHEVIGTIVLAGNQVENVKVGDRVVCDVSETCHKCFFCQRGTPLFCESFEAHGVTLNGGFAEYAKFRAAKVFPIKNLTDEQATLVEPASCAVHGLDKIRPKPGSECLLIGAGPTGLMLAQLLKLNGAQRVVLAANKGMKMDIARKINAADEYIDLDRKDAANQWAQLKEDNPHGFDVVVEATGVESIVNDSINYVRRGGTLLVYGVYDNAARVTWSPTKIFQDEINIVGSFAQIHCFPRAVAYLESGKIRTDGMVTHVYKIEEYQEALDKMASRQCLKIAVKPN

SEQ ID NO: 27018 - protein, 282 aa, Nostoc punctiforme PCC 73102
MKNQQFGNWQTTVLGIVLATLVILGLNSFIIINPGEAGVISILGKARDGALLEGIHVKPPFISVIDVYDLTVQKFEVPAESSTKDLQNLSARFAINFRLDPIKVVEVRRKQGTLANIVSKIIAPQTQEAFKIAAARRTVEEAITKRSELKEDFDQALGDRLDKYGIIVLDTSVVDLAFSPEFARAVEEKQIAEQRAQRAVYVAREAEQEAQADVNRAKGRAEAQRLLAETLKAQGGQLVLQKEAIEAWKSGGAQMPKVLVMGGDSKSGVPFIFNLGNVPNQP

SEQ ID NO: 27019 - protein, 126 aa, Triticum aestivum
AYLGDTIEQVCTKKQAGTGPEFPGYRRPTRPTLQGVLCASFLLTLNWFPFLVMAPVTYYHVKLYMNRKHLIDVTEIFRQLHGEKKYRMIKLAFYFALFIISIYRLVMTAVLLFIDEDANLVETRTI

SEQ ID NO: 27020 - protein, 183 aa, Nostoc punctiforme PCC 73102
MQFTTQNNQAYCGVASMVMVLNGLQIPAPEASQYKPYRVFTQENFFSNDNTKKVLTPEVVSRQGMTLDELGKLLSSYGVKVNVYHATDTSLEQFRKQAAENLKQPQNFILINYLRKEIGQEKGGHISPVAAYNEQTDRFLILDVSRSKYPPVWVKTTDLWKAMLTNDPASKKSRGFVFVSKNL

SEQ ID NO: 27021 - protein, 416 aa, Cryptococcus neoformans var. neoformans B-3501A
MAENYQKKELLALMNTGGNKVCVDCNAPSPQWASVSYGIFICLECSGVHRGFGVHISFVRSITMDKWSDEQLNKMKTGGNEKFKDFMENYGPEGGYTKGMGMQEKYNSWAAAQYREKLTAECAGQPWSASSPPANFGLPSRPASSQTTRKSRAAGGITGSSLNPSRTNSPSIPQGSDDLYGQKSANEAFFERMGNANATRPDHLPPSQGGKYSGFGSTLEPDVASSHPSYSLSSHAAPTLDEFQRNPLGALTKGWGLFSSAIVSAGREINNAVVQPGLDRAQALAAGENSEEWKRYVNQASAQAKDAGGWLGQRAHEGWEGLNDVAKTKGGVDLNESFGKLGLGKSSIPGSRGYGQAGALDRAEDGLLSPHGAGNDDEEDFFESWGATPTASTTSATTGAKSIADKGKKKDDEKNE

SEQ ID NO: 27022 - protein, 113 aa, Synechococcus sp. CC9605
MADDTIFGKILRGEIPCDEVYSDEQCLAFRDVAPQAPVHVLVIPRKPIESLRSGAAEDAASLGHLLLVAARVAKQEGLDDFRTVINSGAGAGQTVFHLHVHVIGGRPLAWPPG

SEQ ID NO: 27023 - protein, 338 aa, Aspergillus oryzae
MATPKVGINGFGRIGRIVFRNAIASGDVDVVAVNDPFIETHYAAYMLKYDSTHGRFQGTIETYDEGLIVNGKKIRFFAERDPAAIPWGSAGAAYIVESTGVFTTTEKASAHLKGGAKKVIISAPSADAPMFVMGVNNKEYKTNINVLSNASCTTNCLAPLAKVINDKFGLVEGLMTTVHSYTATQKTVDAPSAKDWRGGRTAAQNIIPSSTGAAKAVGKVIPSLNGKLTGMSMRVPTANVSVVDLTCRTEKAVTYEDIKKTIKAASEEGELKGILGYTEDDIVSTDLIGDAHSSIFDAKAGIALNEHFIKLVSWYDNEWGYSRRVVDLIAYISKVDGQ

SEQ ID NO: 27024 - protein, 342 aa, Oryza sativa (japonica cultivar-group)
MVRLAARLWDDAQRDAGYRVLTPTPHLDMGPRADPALRASIVNGAATEVASDAAAPWPWSGVFRLPEGWTAATSEIGGVMKATKAVAMFQSLAAKNGAVVRDRTEVVGIAKQGDGSIVVKTSSGEEFHGAKCIITVGAWASKLVRSVAGVDLPVQPLHTLICYWRARPGREHELTPESGFPTFASYGDPYIYSTPSMEFPGLIKVAAHGGPPCDPDRRDWLAGAGAGLVEPVARWIDEVMPGHVDTAGGPVIRQPCMYSMTPDEDFIIDFVGGELGKDVVVGAGFSGHGFKMGPAVGRILAEMALDGEARTAAEAGVELRHFRIGRFEDNPEGNLAENKVKN

SEQ ID NO: 27025 - protein, 88 aa, Brassica napus
PFFAIANFFGGFIVYFYIILPIFYWSNAYDAKKFPFYTSQTFDFTGQQFNTTRILNQKTFDINLPAYESYSKLYLSVMFALIYGLSFG

SEQ ID NO: 27026 - protein, 887 aa, Escherichia coli CFT073
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETLEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 27027 - protein, 495 aa, Escherichia coli CFT073
MDNGRHKKNVRPAGDKYIEVMMSTEIKTQVVVLGAGPAGYSAAFRCADLGLETVIVERYNTLGGVCLNVGCIPSKALLHVAKVIEEAKALAEHGIVFGEPKTDIDKIRTWKEKVINQLTGGLAGMAKGRKVKVVNGLGKFTGANTLEVEGENGKTVINFDNAIIAAGSRPIQLPFIPHEDPRIWDSTDALELKEVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 27028 - protein, 360 aa, Pseudomonas aeruginosa PAO1
MSKQILVLPGDGIGPEIMAEAVKVLELANDRFQLGFELAEDVIGGAAIDKHGVPLADQTLQRARQADAVLLGAVGGPKWDRIERDIRPERGLLKIRSQLGLFANLRPAILYPQLAAASSLKPEVVAGLDILIVRELTGGIYFGQPREQRVLENGERQAYDTLPYSESEIRRIARVGFDMARVRNNRLCSVDKANVLASSQLWREVVEEVAKDYPDVELSHMYVDNAAMQLVRAPKQFDVMVTDNMFGDILSDEASMLTGSIGMLPSASLDANNKGMYEPCHGSAPDIAGQGIANPLATILSVSMMLRYSFSQATAADAIEQAVSKVLDQGLRTGDIWSEGCRKVGTREMGDAVVAALKNL

SEQ ID NO: 27029 - protein, 359 aa, Triticum aestivum
MAAASFLPLHLPASPRPATVAARAASGVASTVPAATQTSQLEETFGRKGLRFGTDATGAPTAELSVRNGSSLQLRLNDGLVTSYRPKVSWEGGDGCRELLHTVAAAGAVKGGVGLVLNEASSSSSLLGASEWSVADVDSDSYDAVQVELGCGVGGAKLEVSYVVTLYPLSMATAVIVKNNGAKPVELTGAVLSHIKFDKRRGTAVEGLRGCPYCSHPPPAAGFALLTPAEAMKREESGWFGGGGGEEPRQGAWTVEENLYTILKKKVSRVYAAPPEERKKRIYSTAPSKFTTIDQSSGLGFRLVRMGFEDLYLSSPGGLYEKFGNDYFLCTGPASILVPVVVGPGEEWRGAQVIEHDNL

SEQ ID NO: 27030 - protein, 176 aa, Arabidopsis thaliana
MVCLVSRTGRQSQRYNKGRRQVVGCIPYRLKISSDGTISDEFEVLVISSQKGHALMFPKGGWELDESVEEAASRESLEEAGVVGNVERQLGKWDFLSKSKGTFYEGFMFPMLVKEELELWPEQHLRQRIWMKVDEARDACRDWWMKEALDVLVQRLSLLSLKPMEEDENLPLISIY

SEQ ID NO: 27031 - protein, 448 aa, Pseudomonas putida KT2440
MNMPETGPAGIASQLKLDAHWMPYTANRNFQRDPRLIVAAEGNYLVDDHGRKIFDALSGLWTCGAGHTRKEIADAVTRQLSTLDYSPAFQFGHPLSFQLAEKIAELVPGNLNHVFYTNSGSECADTALKMVRAYWRLKGQATKTKIIGRARGYHGVNIAGTSLGGVNGNRKMFGQLLDVDHLPHTVLPVNAFSKGLPEEGGIALADEMLKLIELHDASNIAAVIVEPLAGSAGVLPPPKGYLKRLREICTQHNILLIFDEVITGFGRMGAMTGSEAFGVTPDLMCIAKQVTNGAIPMGAVIASSEIYQTFMNQPTPEYAVEFPHGYTYSAHPVACAAGLAALDLLQKENLVQSAAELAPHFEKLLHGVKGTKNIVDIRNYGLAGAIQIAARDGDAIVRPYEAAMKLWKAGFYVRFGGDTLQFGPTFNTKPQELDRLFDAVGETLNLID

SEQ ID NO: 27032 - protein, 296 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVWLGCRCAGGCATQGCRVQDSPNELPEREDPEGNLLWQLQATHWPAQCGGAVYEEVEKFITHSVPFSEINKAFDLMAKGGGH

SEQ ID NO: 27033 - protein, 125 aa, Pseudomonas aeruginosa PAO1
MSDDIQRYPSSLPFPFSRAVRAGGFLFLSGQVPMSPSGEVVRGDIQTQTEAVMARIGETLESCGARFDQLVKVTVWLSDMAHFAGFNEVYQRHVQGALPVRSTVTAGLALGVDVEVEVQAWVGEG

SEQ ID NO: 27034 - protein, 141 aa, Schizosaccharomyces pombe 972h-
MSFVSWGSLNYLAYTFYRLNGANMLLQIFCVIMFSDLEMDYINPIDLCNKLNDLVMPEIISHTLVTLLLLLGKKWLLFLANLPLLVFHANQVIHKTHILDATEIFRQLGRHKRDNFIKVTFYLIMFFTLLYCMVMSLIQEE

SEQ ID NO: 27035 - protein, 370 aa, Triticum aestivum
  misc_feature (271)..(271): Xaa can be any naturally occurring amino acid
  unsure (1)..(370): unsure at all Xaa locations
NKFVQKSRLVPVRNSRDIVDPRVREEMSADPSVFLMGEEVGEYQGAYKITKGLLDKYGPDRVLDTPITEAGFTGIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTFTAFSKMVGYALQAAEILSKEGISAEVINLRSIRPLDRAAINASVRKTSQIGXPVEGGFPPHGVGAEICMSVVGGHFEYLDAPVERIAGADVPMPYAETLKDWNSTVEELRANDLLQSPWGRQSICSGSLVLSKNSDNPNRQESHHVRKKKK

SEQ ID NO: 27036 - protein, 337 aa, Streptococcus bovis
MVVKVGINGFGRIGRLAFRRIQNVEGVEVARINDLTDPAMLAHLLKYDTTQGRFNGDVVVKDGGFEVNGQFVKVSAERDPEQIDWANDGVEIVLEATGFFATKAAAEKHLHEGGAKKVVITAPGGSDVKTIVFNTNHEILDGTETVISAGSCTTNCLAPMADALNKNFGLKVGTMTTVHGYTGDQMTLDGPHRKGDFRRARAAAENIVPNSTGAAKAIGLVIPELNGKLQGHAQRVPVPTGSLTELVSVLDKKVTAEEVNAAMQAAATESFGYNTDQVVSSDIVGISFGSLFDATQTEVTEAADGTQLVKTVSWYDNEMSYTSQLVRTLEYFAKIAK

SEQ ID NO: 27037 - protein, 398 aa, Streptococcus bovis
MAKLTVKDVDLKGKKVLVRVDFNVPLKDGVITNDNRISAALPTIKYIIEQGGRAILFSHLGRVKEEADKEGKSLAPVAADLAAKLGQEVVFPGVTRGAELEEAINNLKDGEVLLVENTRFEDVDGKKESKNDPELGKYWASLGDGIFVNDAFGTAHRSHASNVGISANVEKAVAGFLLENEIAYIQEAVENPVRPFIAILGGSKVSDKIGVIENLLKKADKVLIGGGMTYTFLKAQGIEIGNSLVEEDKLDVAKELLAKANGKLILPVDSKEANAFADYTEVKDTEGAAVDAGFLGLDIGPKSIAKFDEELTGAKTVVWNGPMGVFENPDFQAGTIGVMDAIVKQPGVKSIIGGGDSAAAAINLGRADKFSWISTGGGASMELLEGKVLPGLAALTDK

SEQ ID NO: 27038 - protein, 161 aa, Triticum aestivum
  misc_feature (13)..(13): Xaa can be any naturally occurring amino acid
  misc_feature (77)..(77): Xaa can be any naturally occurring amino acid
  misc_feature (98)..(98): Xaa can be any naturally occurring amino acid
  misc_feature (108)..(108): Xaa can be any naturally occurring amino acid
  misc_feature (125)..(125): Xaa can be any naturally occurring amino acid
  misc_feature (144)..(144): Xaa can be any naturally occurring amino acid
  unsure (1)..(161): unsure at all Xaa locations
MPVPLAPYPTPPXLPFTPPAPNAGAQSQLVCSGCRNLLMYPAGATSVCCAVGSTVTAVPAPGTEMAQLVCGGCHTLXLMYIRGATSVQCSCCHTVNLXAMGANQVAHXVNRGSCRKLLKYQYGAXRSLKCAVCSFVTSGGASSXGAKQNPATEVSYTEGSE

SEQ ID NO: 27039 - protein, 306 aa, Nostoc punctiforme PCC 73102
MTNGSSKIVRLSVVEVQNPKSDRGLFVGLVTLDLIYLAESAPKNNQKIVATDYTVAAGGPATNAAVTFSHLGNQATVLGVVGSHPMTQLIRGDLANYKVAIADLEPTTDLAPPVSSIIVTQATGERAVVSINAVKTQASSASIPPDILQNVNIVLIDGHQMAVSYFIAQAAKAKNIPVVIDGGSWKPGFEQILPFVDYAICSANFYPPNCQTGEDVFAYLAGFNISYIAITHGQKPIEYLSRTASGIVDVPQIHAVDTLGAGDIFHGAFCDYILRESFTDALALAAKIAADSCKFFGTRRWMDLKC

SEQ ID NO: 27040 - protein, 390 aa, Cryptococcus neoformans var. neoformans B-3501A
MASTITRSIPRALRARTAPLSTAARLVARNALLTTAAPTVPRSPARFLLAEGQRRAASSDEGVTMMTVRDALNQAMEEEMIRDETVFIIGEEVARSPRDCWTSLERTGSSTVQTPITEAGFTGMAVGAALAGLRPVCEFMTWNFAMQSIDQIVNSGGKTHYMSGGNVPCPVVFRGPNGAAAGVGAQHSQDYCAWYGSVPGLKVISPWSASDCKGLLKSAIRDSNPVCFLENELLYGVQFPMTKEELSEDFLIPIGKAKIEKAGSDVTIVAHSKMVTHSLEAAELLEKEEGIKVEVINLRSIRPLDIETIITSVKKTKHLITVEGGFPAFGVGSEILAQICESTAFDFLDAPPERITGADVPTPYAESLETMAFPDTPLIAKVIRRHLYRQ

SEQ ID NO: 27041 - protein, 194 aa, Bacillus cereus ATCC 10987
MRESSQIRETTETKIKLSLQLDDGKNVSVRTGVGFFDHMLTLFARHGRFGLQVEAEGDVFVDAHHTVEDVGIVLGNCLKEALHSKEGINRYGSAYVPMDESLGFVAIDISGRSYIVFQGELTNPKLGDFDTELTEEFFRAVAHAANITLHARILYGSNTHHKIEALFKAFGRALSEAVERNANITGVNSTKGML

SEQ ID NO: 27042 - protein, 463 aa, Burkholderia sp. 383
MQQHTMRRELGARQISFMALGMAIGVGLFLGSASAIKAAGPGALVAYLIGGAMIFLIMRALGEMAVHRPVSGSFGAYAFEYVGPFAGYVVGWSYWLLMVGVGVAETTAIGIYMGFWFPDVPQWLWVVSAIAAISAFNLLNVKVYGELEFWFAIVKVVTIVLMIAGGALIVFTGIGHGGVPVGLSNLWRHGGVFPHGVLGVVSALPIVAYSFAGVEMIGLTAGEAREPQKMIPRAINSVLWRILIFYVGALFIIMALYPWHELGEHGSPFVTTFESLGLRQAAGIVNFVVVTAALSSFNCIVFSGARMLSSMAGNGLAPASFAALSASGSPSRAVRATVLFMSVGVVLNYVIPARVFGWLMSFLSFDVAVIWAMIVLTHMRFRRALAARGETVAFRMPYASVTSWICLVFVAFVFVMLGVDPTTRGSLYAGAAVMALMAIIYRRSRHLQAAARSTRVGLGVERV

SEQ ID NO: 27043 - protein, 233 aa, Arabidopsis thaliana
MSVRARRIVSGRSETVAANYAFDPLHDDKIIRNRLLTRTTTTRGEPPLKKLQKKFTSFVIELDKEEDNYSECGRLAKAFLQELSAFEIPLLKSQVVVAANLREKENFNELKDETNRQIMQAQADIEDLKKQLEESKIERQQKEECEAIRKLISAQPPRSETQKVIHELKKEIAELEAENTASWRLLELRKKQFALLLHVVDELQETMEDEQKSMVEEMQRNITADGAEAMSID

SEQ ID NO: 27044 - protein, 1486 aa, Cryptococcus neoformans var. neoformans B-3501A
MSNPTSPTDPPDAGPPAPAIASSSKTGRRSVRLFAPDEEDSSDEDGLIGVPAETTFNDDEVPPSNTRSASYPGPPAHTSPTSKISSIVSSASAAQPKLARSITYVAPSAISSRPAYPLHPAGPETLHASYETWRKTRYTLESFSRAKADGKNAAQRGRSYTDPDVGYFSPDAGDDGWGSDDEDELRSPGWGISHHNMDSGGKTDGSPQLPIKPADVTEDEGQERLDWQGMLESVLNSDVLKVEEQRIYNSMPTDSFREEIGKTLWWQIRAKLRGRTEAEEKKRVQERRARVVDPVLEEINEFKYDPKNNPEGEEDSDADPQDATSTAAPQSKALNQVNTILAKLHAVKGLYPNLAAMRADKSLYTDENFRKRADALTSWSIIVSSLQTQLKLLQKWTGSDELDITKPNTTHEKALVGKYKYHHSIDSKGTPGRDAADDSSFLDRVIKEDNLQRTFERRAFVDMINLVRNAKETVINYLPQFQEQNLPDFQYEIVRLIGFPGRLIIEAVKVRLDAASRLLDPNPMVVEDFIENLRLSISLAVLIRKQYDEIMAPDAEGRWKIPHCLPTEYNDVLLDALRTFFKLLHWRLRGVGKASYYKETEVLEEEAPFLYEAAEAIVGGDMVVAEQYCALSNKLLIRSANYLDQQLRVPIHSHSRDKERGGDKERDGSSSSQRDRNRDGSLAGPPKHMKVEELFSWYSKLLDSARMRHRKTQRFCRKLTQRFDNSAEYSIEETDVDMLVETLQDTGHFLVYTGKFEANGTYIVADGSLWGQPDDVRHLLKRVFSVTIPGSRVRPRQTTSQVSGGGGVLANGQVAAAQPDPADPYPEADDFDDEALAAYILLISPRQNFVWSGAVMTLDVDYIDYELADNRVRLIADGPTKRLALCKHYFTQALIHPDTGETIDLPCVVEAQAHLPTIQKQLVKIAKSSYRLSECIVQSAPLVRNAFRGKPGSQELVENWYSFATEHGTRVLVHIEPSAWDRFNRLLMRLAISWISFISQECNPTDRKTFRWTVAALTYAFNMTRGSNILALDRSEFSLLRRYVGVCVSLLVSHFDILGARSSMEAKKEADRIEAMRRLQRLQENLDDEFLPRTPTESGGQPRIDRSIRLTVEERLRLIAELEARRSELAPAPVGQVLDEEVSEDRALVFLAASKSNISMRWQQGAYIGGGASGSVYLGYSLQDNTVFAVKILPTVDLQSSPALYESIKRESDVMSLLSHPNVVGFLGLEVHRNRVCLFQEYCEGGSLAGMLEYGKIDDEEVVGAFTIQLLRGLEYLHTNRIEHRDLKPENILIGANSVLKLADFGTAKIIKSNKTLARTRGGAHAKMEGLEGTPMYMAPEMIKNQRTGKLGACDIWGLGCIVLQMITGRKPWSFLDFDNEWAIMFHLGATKEPPPLPDPNEMSDQGIEFIDQCLSLDPEARPVASELLQDEWLVPMLEQMAELEQEYPDVLAMGQSDSLVPPPENASLTSNAPTLQDDITPPPLE

SEQ ID NO: 27045 - protein, 101 aa, Bacillus cereus ATCC 10987
MKPNFSKGLLPAVVIEEDTKEVLMLAYMNEEAYEKTIETKRTWFYSRSRRSLWNKGETSGNVQHVQSLYLDCDQDSIVVVVKQVGPACHTGEKTCFHYKII

SEQ ID NO: 27046 - protein, 160 aa, Oryza sativa
LPTWLIVEQRQRPPRASTRCSSSSSKAATRRAAACCSSPATRSSPGSPAAAKKPRIEAPSPMPTFKVRKEKLGDRITALQQLVSPFGKTDTASVLHEAIEYIKFLHDQVAGSHKVNGNCEGKQLDLRSRGLCLVPVASTYTVASETATEFWHPTFGGTFR

SEQ ID NO: 27047 - protein, 107 aa, Bacillus cereus ATCC 10987
MKNAFTLLFETIEERKRNPLPESYTNYLFSKGEDKILKKIGEECTEVIIASKNNDNEELVKEIVDVLYHCFVLLAEKNISLEDIMEEVTERNGKLSRVGDRREIDTL

SEQ ID NO: 27048 - protein, 423 aa, Burkholderia pseudomallei K96243
MTQAAFDYVDGTLHAERVSTVELAERFGTPLFVYSRAALTAAYEAYAKACAGRRASIHVAVKANSNLGVLNVFARLGAGFDIVSGGELARVLAAGGRARDVVFSGVGKSADEMRVALEAGVKCFNVESIPELDRLNAVAASLGKRAPVSLRVNPDVDPKTHPYISTGLKANKFGIAFDDARATYRAAAALPNLEVVGIDCHIGSQITELSPYLDAIDKLLDLVERIEADGVQIHHVDVGGGLGITYDDETPPDIGAYVRAVLARIDARGHGQREIWFEPGRSLTGNAGILLTRVEFLKQGEEKNFAIVDAAMNDLARPAMYQAFHAIVPVAPRTDVAAAVYDIVGPVCESGDWLGRERSLAIAPGDLLAIRSAGAYGFTMSSNYNTRPRAAEVIVDGANAHLVRPRETVESLFEHETILPEGR

SEQ ID NO: 27049 - protein, 311 aa, Prochlorococcus marinus str. NATL2A
MVPEHSLSKFESTSSKMSTITGKTNLVGLLGQPVNHSLSPIMHNAAYEEMGLDWCYVAMPCESQDLEKVTKALRFLDFKGLNITIPHKQEVLKACNKLTEISNEIQAVNTLIPEENNQWIGANTDVQGFLTPLKDHNLKNKNVVVIGCGGSARAVVMGLSSLNVKKVTIIGRNDSSLNIFVKSTRNLLSRRGISIESINNKELNVSPYIQEADLIINTTPIGMNDSKTNQENVPLGREIWDCLSNKTILYDLIYTPRPTNWLQIGQQKNCFTIDGLDMLVEQGAFSIRLWSGFHDVPVQTMKSSAEKHLMV

SEQ ID NO: 27050 - protein, 208 aa, Avena sativa
MDMTGSEQWSSSSSSSYSVEHGGPAVWTTPPKRPAGRTKFKETRHPVYRGVRRRGNAGRWVCEVRVPGQRGERLWLGTYLTAESAARAHDAAMLGLHGRSASACLNFADSAWLLDLPSPLSDLAAVRRVALAAVVRGQCRKLVGDIAALLCRWDIRGAGRAGQRHVRAGRVRGNGLRHVLRGPRGGIAAGAAAAARRRLLGHRRRWRS

SEQ ID NO: 27051 - protein, 197 aa, Triticum aestivum
MKLEVSPRQRTQEAEQNEGPEVWKHPKQLCASLGYGEEEEVPRLVPPLDDGVFRSGFPDAANFRFLASLNLRSVVYLCPEPYPEQNARFLGRSGIKLHHFGIQGRKELFVGIPEEMIREALKVILDVRNHPVLIHCKRGKHRTGCVVGCLRKLQKWRLSSVLDEYLHFAAAKARKTDQRFMELFDTSSLVHLLASQC

SEQ ID NO: 27052 - protein, 172 aa, Glycine max
  misc_feature (22)..(22): Xaa can be any naturally occurring amino acid
  misc_feature (51)..(51): Xaa can be any naturally occurring amino acid
  misc_feature (114)..(114): Xaa can be any naturally occurring amino acid
  unsure (1)..(172): unsure at all Xaa locations
LRLRSYWGLNVYNANTNPIFSXHLYTVQGQKYNIPKIVDDHIELNVAEYEXQGIIHLRVLFDLTYSFGFATITSTLTHAVCFYGKEIMERYRASSRGIEYMHTLLFIRYDDIPXRWYHSLLLETLLVTVALCMFIKDQVQMPWCGLLYAGVLAFGCTLPISLITATTYQTPG

SEQ ID NO: 27053 - protein, 562 aa, Polaromonas sp. JS666
MNAATLDRPWLKAYPAGVPADIDSSQYPSLVALMEESFQKYGSRVAYSFMGKDVTFGQTDSLSVAFAVYLQGLGLLKGDRIAIMMPNVPQYPVAVAAILRAGYVVVNVNPLYTPRELEHQLKDSGAKAIVIIENFAHVLEQCIATTPIKHVVLCAMGDQLGMLKGALVNYVVRNVKKMVPAFNLPGAVRFNDAVAQGTRGTLKRPDIKPDDVAVLQYTGGTTGVSKGAVLLHRNVIANVLQSEAWNGPAMASLPAGEQPTYVCALPLYHIFAFTVNMMLGMRTGAKNILIPNPRDLPAVLKELSKHTINSFPAVNTLFNGLANHPDFNTVDWSHLKISVGGGMAVQSSVAKLWLEKTGCPICEGYGLSETSPSASCNPTNSKAFTGTIGVPIPSTWFKLIDDDGNEVPPGQPGEIAIKGPQVMAGYWQRPDETAKVMTPDGYFKSGDIGVLDENGFFKIVDRKKDMILVSGFNVYPNEIEDVVARLDGVMECACVGVADEKSGEAVKLVIVKKNPELTEAQVREYCKANLTGYKQPKVVEFRADLPKTPVGKILRRELRDKK

SEQ ID NO: 27054 - protein, 220 aa, Escherichia coli CFT073
MKDIDTLISNNALWSKMLVEEDPGFFEKLAQAQKPRFLWIGCSDSRVPAERLTGLEPGELFVHRNVANLVIHTDLNCLSVVQYAVDVLEVEHIIICGHYGCGGVQAAVENPELGLINNWLLHIRDIWFKHSSLLGEMPQERRLDTLCELNVMEQVYNLGHSTIMQSAWKRGQKVTIHGWAYGIHDGLLRDLDVTATNRETLEQRYRHGISNLKLKHINHK

SEQ ID NO: 27055 - protein, 475 aa, Mycobacterium smegmatis str. MC2 155
MSAEAHCPGPAPQGPDRDTGVPTGPIPGSSKCYRDPVGAPGGRVPFRRVHLSGGRHLDLYDTSGPYTETDTPARLATGLPSRPGVVTDRGTQLQRAREGVVTSEMAFVAARESLRPKVVRDAVAAGHAVIPANHRHPESEPMIIGRAFRVKVNAGIGSPPDAVIGDMVRAIRWGADIVTDLSGSDCDRMVRNMPVPVGTVPLYQALGRVHGDIAALTWNTFCDTVIEQAESGVDCMTVHAGLRREHLSLAAGRITGIVSRGGAVIADWCLLHNAESFLYAHFDQLCETLARYDVTLALAAGLQPGSVADANDAAQIAELRTLGQLARVAHRHGVQVVVEGPGRVPMHKIAESVRIHQQLCRNAPSYTIGPLTTDVAPEHDHATAVIGAAVAAQAGTSMLCCLPRPARLRESVIAHKIAAHSADLAKGHPQAHEHDHAISRARCETHCRDRLALSPDPDAAFTGHDHSKGSYLPFP

SEQ ID NO: 27056 - protein, 129 aa, Candidatus Protochlamydia amoebophila UWE25
MVNLKKIETMQAPKAIGPYSQAVLADKHLYVSGQLGIDPTTGKLELNDISLQINRVLDNLEAILKEAGCTFQNIVRCDVFLKDLNDFAIVNEAYSKRFSHSIPPARQTVQVAKLPLDALVEISCIAIIS

SEQ ID NO: 27057 - protein, 136 aa, Streptococcus bovis
MTITAADIRREVKEKNVTFLRLMFSDIAGTLKNVEIPATDEQLDKVLSNKAMFDGSSIEGFVRINESDMFLHPDLDTWTVFPWGGENGAVAGLICDIYTPEGEPFAGDPRGNLKRALRHMEKVGFKSFNLGPEPEF

SEQ ID NO: 27058 - protein, 432 aa, Schizosaccharomyces pombe 972h-
MPAIMEKNMLVSESLRTTELLGHVKPIDSVVTWSSPGSSRQAIGEAFKNTIEEIERAAVRGEPADSDAFFVADLNGVYRQLLRWHAKLPRVQPFYAVKCNPDPKVLALLNKFGTGFDCASKGELEQILGLGVSPDRIVYANPCKAITYVRYAASKGINLMTFDNADELYKVKQHHPNSRLLLRISTDDSNSLCRLSLKFGASLDDTGKLLDIAKSLELNVVGVSFHVGSGSYDPSAFLDAIQRSRQVFDQGLERGFNFDLLDIGGGFMNDSFDGVADLIRSALDTYFDPSIRVISEPGRFFVSSSFTLAVNVIAKRKLDDEEKVMYYVNDGVYGSLNCILFDHQHPVARVLKCGSRFVYNDLVGTGQHRCFIWGPTCDSLDVIANDAHLPYELNVGDWIYFEDAGAYTVAAASCFNGFKTSRIVYLDTDILD

SEQ ID NO: 27059 - protein, 351 aa, Arabidopsis thaliana
MVKALVIINCIILAIGNCGGPLIMRLYFNNGGKRIWFSTFLETAGFPVIFIPLLFSYITRRRSNNVGDSTSFFLIKPRLLIAAVIVGILSGFDNYLYAYGIAYLPVSTAALIIASQLAFIAIFSFFMVKHKFTPFTINAVVLLTVGAAVLGMHTETDKPVHETHKQYITGFLITVAAAVMYAFILPLVELAYQKAKQTMSYTLVLEFQLILCLLASIVSVIGMFIAGDFKALPKEAREFKLGEALFYVVAVFSAIIWQGFFLGAIGLIFSTSSLVSGIMISVLLPITEVLAVIFYHEKFQAEKGLSLALSLWGFVSYFYGEIKSGEDKRRIQQEESQETEQSSLSRPISEC

SEQ ID NO: 27060 - protein, 522 aa, Corynebacterium ammoniagenes
MTQPATTPRPVLVVDFGAQYAQLIARRVREASIYSEVVPHSATVKEIKAKNPAALILSGGPSSVYADGAPQLKPELLELGVPVFGICYGFQAMNHALGGNVAQTGDREYRRTEITHTGGVLHDGLEENHKVWMSHGDAVDKAPEGFTVTASSAGAPVAAMECVAKQMAGVQYHPEVMHSPHGQEVLVRFLTEVAGLEQTWTSANIAQQLIDDVRAQIGPEGRAICGLSGGVDSAVAAALVQRAIGDRLTCVFVDHGLLRAGEREQVEKDFVASTGANVITAHEADAFLSKLAGVTDPEAKRKAIGAEFIRSFERAVAQALEESPEDSTVDFLVQGTLYPDVVESGRGDGTANIKSHHNVGGLPDDVEFELVEPLRLLLRRSPCRSRELGLPEEIVARQPFPGPGLGIRIIGEVTEERLEILRQADLIARTELTNAGLDGDIWQCQSYCLPMSAPSSPRRRPHLRHPIVLRPVSSEDAMTADWTRVPYDVLEKISTRITNEVNDVNRVVVDITSKPPGTIEWE

SEQ ID NO: 27061 - protein, 1375 aa, Cryptococcus neoformans var. neoformans B-3501A
MSVLAAISSLPATSYYHPIAQVPAGASKLNPYLPLPQSSTPTVLFTNANLLHSLPTASLSRTVIHVFDAEEIVTPKGANAVSLISRSSQGAYDHALLSLRLAQDKDAVVYHFIPSGLEGEIQTLEDAQAWLSGPLDAPDLSNGDDAEPSAEAKLIAAYESISLSLLKLTRRPQRPFIHSKAESSRLVVNFLPSPVKSENTIDVVLAIPAPKEKLSSSLSGVQEVVVVEAGSGKYGPAWASVVDALEGADVTIRSVLVGASASSEEIAAAITGDTPITRIGKPLSYNIPSNAVTVPSPESTYTELLASSPSPLEVLNDPSHLAANESTSPLYAFGKAVAIRKERARLVELAKKVLKAPNTKPEVHEALSAWLLVRDEKKGAVEAGKKVEAAIGAGKGDEKEIVELGQKGHWEKRALWIVISNSWAVDLASSGLHHALASGLDINLLVYETAASPFSPNAPAQPPKERKKDLALYALNMGDVYVASVAVYADYAGVLNAMREAENYSGPGLVLAYLPWGEKEDGQAVSDSENAGPLERLRETKRAVSGGWWPMFRWNPSLPDEKRFSLDSSHIKAALSEFLDRQSHLSQLTLATPAIDSSVTSSAGTELLAARKEKARKAYDALLNSLDGPGLLVLYASDGGNAEKLAKRLVGRAKMRGVSASLRVLDEVAGSIVETLSQEQNVLIVSSTAGQGESPLNGREFTKALSKLSPSDEFKETKVAVFGMGDSHYWPRPEDAGYYNKPARDLFPKLISLGCQELLPLGLGDDSDPDGVQTGYKPFEASLWRALGVDSVEVTEEKEEVVANEHIKIASDYLRGTILEGLADKSTGAISASDAQLTKFHGTYMQDDRDIRESLKAQGLEPAYSFMIRVRMPGGICSAKQWLDMDRISDEHGNGTFKLTTRQTFQFHGIIKSHLKKAMQAINKSLLDTIAACGDVNRNVQCTVNPSLSKTHATVYEFSKAVSEHLLPATNAYHEIWLDKKKISGDAVQPFDSDSEPLYGPYYLPRKFKIAIAVPPDNAVDVFTNDVGFIAIVENDEVIGYNVSVGGGMGVTHGNKKTYPRLGDVIGFITPEDGKKVAESIMLVQRDHGNRQDRKNARLKYTVDRLGLPKFKAFVEERWGKKFAPARAYHFDSNLDHYGWSQGHDGKWHFTMFIENGRVEDNSRHQFKAGLREIASVHKGTFRLTANQHLILSDIASEDLDEMKRLLAKWGLDNLDHSGVRLSSSACVAFPTCGLAMAESERYLPVLIDKVEKICEEAGVKSDDLVMRMTGCPNGCARPWAAEVAFVGKAPGSYMMMLGGSHLGTRLNKPFLESASEPEILAVLKPMIKRWALERHEGERFGDWTIRAGYIKPTTHGTNFWEDAFPAQAGTTVTA

SEQ ID NO: 27062 - protein, 484 aa, Oryza sativa
  misc_feature (134)..(134): Xaa can be any naturally occurring amino acid
  unsure (1)..(484): unsure at all Xaa locations
MASYDKAIESYKKAITTAASVAASVMLVRSVVNELVPYEVRDVLFSGLGYLRSQISSQHTIIIEETEGWSHNHVYNAVRAYLATRINNNMQRLRVSSMDESSEKMVVTMEEGEELVDMHEGTEFKWCLISRSIXADPKNGNGSGQREVRSYELSFHRKHKEKALESYLPFIIATAKAIKDQERILQIYMNEYSDSWSPIDLHHPSTFDTLAMDQKLKQSIIDDLDRFIKRKDYYKRIGKAWKRGYLLYGPPGTGKSSLIAAMANHLKFDIYDLELTGVHSNSELRRLLVGMTSRGILVVEDIDCSIELKQREAGEERTKSNSTEEDKGEDKVTLSGLLNFVDGLWSTSGEERIIVFTTNYKERLDQALMRPGRMDMHIHMGYCTPEAFRILASNYHSIDYHVTYPEIEELIKEVMVTPAEVAEALMRNDDIDVALLGLLELLKSKIKDASETKAESKDANKQTEENKDSKAMENKNDSSTDECT

SEQ ID NO: 27063 - protein, 400 aa, Fusobacterium nucleatum subsp. vincentii ATCC 49256
MEEKMKISDRVKNMKYSAVRKLAPLAAEAEKKGIKVYRLNIGQPNIETPKLFFEGLKNIPDQVIKYADSRGISVLLEQVIEVYARDGHILKKEDIIVTEGGSEALTFAMLAICNPDDEVLIPEPFYSNYKSFLDISGAKIIPIPTDIKNNFALPKKEEIQKLITSKTKAILYSNPCNPTGKVYTEVEVKLLADLAIENDLFIIADEPYREFIYDDKDKHHSLLDIEKAKENVIIIDSVSKHYSACGARVGFLISKNKDFMTYIMKLCQARLAAPTVEQYAVANLMKAPKEYFKEIKEIYRRRRDIIVDSLNKIEGVTCSTPKGAIYAFAKLPVESSEDFCKWLLTEFVYDNSTVMLAPGEGFYETEGLGKNEVRFSFCVGEDDIEKAMKVLEEALKVYKK

SEQ ID NO: 27064 - protein, 237 aa, Avena sativa
MDMSGSEQWSSPSSSLEHGGPAVWTTPPKRPAGRTKFKETRHPVYRGVRRRGNAGRWVCEVRVPGQRGERLWLGTYLTAESAARAHDAAMLGLLGRSASSACLNFADSAWRLTVTPGLSDLAGVRRAALAAVANFLRREAAGGAANVPADEDTSSASADNAGGSSATSQPYVDGTFDFEMPAGMGSDIFELDMSGEMDQGTYYAGLAEGLLLEPPPQHAGACWDTGDGGADPALWSY

SEQ ID NO: 27065 - protein, 219 aa, Burkholderia pseudomallei K96243
MAFLLHQARFFTTVNHLRDLPPTVQPEVAFAGRSNAGKSTAINVLCNQKRLAFASKTPGRTQHINYFSVGPAAEPVAHLVDLPGYGYAEVPGAAKAHWEQLLSSYLQTRPQLCGMILMMDARRPLTELDRRMIEWFAPTGKPIHSLLTKCDKLTRQESINALRATQKSLDAYRDAGYAGKLTVQLFSALKRTGLDDAHALIESWVRPAAADEDRAAVAE

SEQ ID NO: 27066 - protein, 192 aa, Chlorobium tepidum TLS
MNITTADFFCSYSSLNGLPSDGRPEIVFVGRSNVGKSSLLNSLCARKGLAKTSSTPGKTRLINYFIINDNLYFVDLPGYGYAKVGQGERESWGKLLTGYIQKRGEIALVVLLVDSRHPGMASDLEMMEFLDYCGRPFGIVLTKWDKLKQAEKSKASRTIESCAPNARFIVNYSSLSGSGRDRLLASIDTFTQ

SEQ ID NO: 27067 - protein, 438 aa, Bacillus cereus ATCC 10987
MYLHGTSRINGQGHLEIGGCDTTQLAKQYGTPLYVYDEESIRGKCRAFHRAFKESGFSYQVAYASKAFLCMEMCRVAREENMSLDVVSGGELYTALQAGFPASRIHFHGNNKTDEEIVMALQANIGCFVVDNFLELEILHDLAVQHGKFVNILIRVTPGVEAHTHEYITTGQDDSKFGFGVSNGQAMQAIELALQKSNYNVLGIHSHIGSQIFETAGFVRAIEVLHQFLEEVRERTNYVVKVLNVGGGFGIRYTESDTPLTLETYVRAVTSAVREQFTVCNYPLPEIWVEPGRSIVGDAGTTLYTVGSVKDIPGIRKYVSVDGGMTDNLRPALYNARYEAMLANRGNDENEEVVSIAGKCCESGDMLIWDINLPKVASADLLAISCTGAYGYSMANNYNRIRRPAVVFAKGGTSQIVVERETYENIIGNDRIRIKELV

SEQ ID NO: 27068 - protein, 258 aa, Avena sativa
MDTGPEYNLTPTSSSSSQELGMALSSPTSPTPKRPAGRTKFKETRHPVYRGVRRRGSNGRWVCEVRVPSKSGERLWLGTHVTAEAAARAHDAAMLAMHGHTSAACLNFPDSAWLLNVPSNLSDLADVRRAAIEAVVEFLRLEAIKDGAAAVAVPIDGVVASAALAPSSHADNASPAATSQPSAASEVPEALGGDMFELHTSGEMGLGTYYADLAEGLLLEPPPAAASSEHGGDCGDAPDMMRRYGNGATEIRLSLAAE

SEQ ID NO: 27069 - protein, 140 aa, Triticum aestivum
  misc_feature (37)..(37): Xaa can be any naturally occurring amino acid
  misc_feature (94)..(94): Xaa can be any naturally occurring amino acid
  misc_feature (98)..(98): Xaa can be any naturally occurring amino acid
  unsure (1)..(140): unsure at all Xaa locations
MLVRLKGPVRMPGESHAYQQGEQWRGMMVDTTILALXDARAKEKPYIDSKGIYVIRRHVKVNLVRKHCSGANDLGSEDMPGATSHGMRVQAYLXDGYXQDIGTTEAIYKATVGITKKPIPDTRFYDRSAPIYTQSRDLPP

SEQ ID NO: 27070 - protein, 430 aa, marine gamma proteobacterium HTCC2207
MTYAGPRSKELFDAAQKHIPGGVNSPVRAFRAVGGTPIFFDRAAGAYMFDADGKRYIDYIMSWGPMILGHGHPQVLDAIREQLEKAMTFGTPTELEILLADKICERVPGMDMVRMVNSGTEATMSAIRLARGATGRDKIVKFEGCYHGHSDSLLVKAGSGALTLGVPSSPGVPISLADHTITLSYNNIEQVRQTFAEIGDQIACIIVEPVVGNMNCVPPIPGFLQALRECCTASGAVLIMDEVMTGFRIGPQGASAYYEVMPDLVCLGKVIGGGMPVGAFGGKRELMEQIAPLGPVYQAGTLSGNPVAMAAGLTTLNLVSEPGFLDPLVRRTGDLVKGLRERAASAGIPLTSNHVGTMWGVFFSEEEKIVNYQQVMKCDTERFGKFFHGMLEAGIYLAPASYEAGFMSAAHTDDDIQFTLDAAEKVFKTL

SEQ ID NO: 27071 - protein, 391 aa, Beta vulgaris subsp. vulgaris
MNRQIKNFTLNFGPQHPAAHGVSRLVLEMNGEVVERAEPHIGLLHRGTEKLIEYKTYLQALPYFDRLDYVSMMAQEHAHSSAVERLLNCEVPLRAQYIRVLFREITRISNHSLALTTHAMDVGALTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGPGVCWDLRRAAPYDVYDQLDFDVPVGTRGDRYDRYCIRIEEMRQSVRIIVQCLNQMPSGMIKADDRKLCPPSRYRMKLSMESSIHHFEPYTEGFSVPAPSTYTAVEAPKGEFGVFLVSNGSNRPYRRKIRAPGSAHSQGLDSMSKHHMPADVVTIIGTQDIVSGEVDR

SEQ ID NO: 27072 - protein, 155 aa, Beta vulgaris subsp. vulgaris
MMAQEHAHSSAVERLLNCEVPLRAQYIRVLFREITRISNHSLALTTHAMDVGALTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGRAT

SEQ ID NO: 27073 - protein, 372 aa, delta proteobacterium MLMS-1
MSKLAADPDYETFVLNMGPQHPATHGALRVKLLMDGEYIVEAEPVLGYIHRMHEKMGENRTYHQFLPNPSRLDYLSAMSCTHGHVAAVERAAGLTVPERAEYLRVITVELNRISSHLLWLGAFVLDLGGFTPLLYVMDDREQILDMLERVTGSRLTYCYFRFGGLYNDVDDDFVESARAFVKRMRDKMPMYHNLISKNVILRQRLEGVAPISAEMCRKYGATGPVARGSGIPYDVRKHEPYSVYPEFDFDIPVYEHGDSMARYLVRMDEIEQSLRIIEQGLDKLPDGPVMAEKVPKIIKPPKGDYYYAVEAARGSFGVRLVSDGTNSPYRLKLRSPCFSNVSLFGEAARGLLLADAVALFGSLDLVIPDIDR

SEQ ID NO: 27074 - protein, 377 aa, Arabidopsis thaliana
MKTTPGLRIFKPIIPHTPKPDSRIYVEDAWTMLKPAIRAIFLDEPQDFACSGLFNAVNKSWCEKSSGEALYKLILEECEIYISAAIQSLESQCDTDPSLFLSLLEKCWLDFRRKLQFLCSIAGGEGQTVGPHSVWDLGSELSPKHLFSAQKVRDKLLSIILQLIRDQRSFMSVDMTQLKNTTRPVMSVHMTQLNNLRGLFYGQSLYKSPFFKKPFIDCAVEFYSAEAMQFKEQSDIPLYLKRVEDAAWEAVERILLKDHVSVILEKGFVKFMDERSHDDLSRMYYMFSEADLLGHLNDALNSYIRQTGQKILKEDSLSLEELKNSVDKICLTCFSEDASLEKTAKQCFKDLGLAWEETKTESLDLDNDWKDSTIWLG

SEQ ID NO: 27075 - protein, 257 aa, Neisseria meningitidis MC58
MYRQIGMWDQKWVIGNWKMNGRLQNNNALMHRFRIHPTAERVLIGLAAPTVYLLQLHNAMQIVLNNRILTCAQDVSRFPNNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 27076 - protein, 470 aa, Arabidopsis thaliana
MTRVNQLPCDCVSTAEESLTSGTCITPTHVTSLSSPLDRSGDVDPLPVSDESGGSKADESMTDADETKKRKRILSGDCEADENNKSDGEIASLNDGVDAFTAICEDLNCSLCNQLPDRPVTILCGHNFCLKCFDKWIDQGNQICATCRSTIPDKMAANPRVNSSLVSVIRYVKVAKTAGVGTANFFPFTSNQDGPENAFRTKRAKIGEENAARIYVTVPFDHFGPIPAEHDPVRNQGVLVGESWENRVECRQWGVHLPHVSCIAGQEDYGAQSVVISGGYKDDEDHGEWFLYTGRSRGRHFANEDQEFEDLNEALRVSCEMGYPVRVVRLAEQNSIALSHSHFFVKFPISKVVPQRIEKCWRKARFPDSFKVCRYLFVRCDNEPAPWNSDESGDRPRPLPNIPELETASDLFERKESPSWDFDEAEGRWRWMKPPPANHEQRERMKMAMTCLLLFVLIILVGSSSILYQY

SEQ ID NO: 27077 - protein, 148 aa, delta proteobacterium MLMS-1
MSGYFKDIYDGGKSLVVGLGITFRYMIQPVVTLQYPRQTVKMAPRYRGHIDLIFDAEAESGNKCIACGMCQRNCPSDCITLKSEKPEGAKKKVLTGYQLDFTKCSLCGLCVESCPTDALEFSKEYNLAGLKAEDYVFDLLKRCEERRR

SEQ ID NO: 27078 - protein, 148 aa, Oryza sativa
  misc_feature (50)..(50): Xaa can be any naturally occurring amino acid
  unsure (1)..(148): unsure at all Xaa locations
AIEDGIRGKALAYGAKEKGARVVIANRTFARAQELGNLLGAPALTLAELXNYHPEEEMILANTTAIGMHPNVNETPLSKQALKSYAVAFDAVYTPKETRLLREAAECGATVVSGLEMFIRQAMGQFEHFTGMPAPDSLMRDIVLTKIQ

SEQ ID NO: 27079 - protein, 274 aa, Schizosaccharomyces pombe 972h-
MDSAEKKLDLSPIELAKRLACHMAVDENYPENPKVIGIGSGSTVVYVVERLLTKPGVDSVVFIPTGFQSKQLIVNNGLRLGDPDCYPNVDVSFDGADEVDDNLQCIKGGGACLFQEKLIAFLAKRLVIVADSRKNSHVLGEYWKKGVPIEVMPMAYASILPQLVELGAIEPKLRMGAPGKAGPVVTDNGNFIIDAHFGLIKNPKELFAKIKLLVGVVEVGLFCDMISAVYFGSKDGSVTVKKASGEKHIIPAPVTAAANEVDAKVAETNAKPLN

SEQ ID NO: 27080 - protein, 380 aa, Arabidopsis thaliana
METQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 27081 - protein, 179 aa, Schizosaccharomyces pombe 972h-
MSANLQNENPEVKELNQLPSRVEEEEDLLLSSTKQWLTEIESEQTNIKEERDPIDPQEIYDLLAKINDPEHPLTLAQLSVVKLEDIEVVDNVEGDSYITVHITPTIPHCSMCTLIGLCIRVRLERCLPPRFHVDVKVKKGTHASESQVNKQLNDKERVAAACENEQLLSVLNGMMATCV

SEQ ID NO: 27082 - protein, 540 aa, Bacillus cereus ATCC 10987
MSYEKVWANNEKLNQTEKNKLKKDGLEIFNDIPYYAENGFESIPKEEWDAFKWAGLYLQRPKEAGYFMMRVNIPSGIITNAQAEVLASIAEDYGRDVIDITTRQAIQFHWLEIHQIPDIFERLAKVGLSSAGACGDITRNITGNPLAGIDANELFDTTGIVKEVYDYFQHNEEFSNLPRKFKMSISSNIYNSANAEINCVAFTPATKEIDGEKKVGFHIKVGGGLSARPYLADELDVFVLPEEVKAVAIAIATIFRDFGYREKRHLARLKFLVADWGAEKFKEKLIEYTGPLQSKGESALKGWNAGYFYGVQDQKQDGLKYVGFNVPVGRLHAEEMFEIARIAKQYGNGQIRTCNSQNFIIPNVLPENVTGLLNEPLFEAISANPKSFIGHAVSCTGIEYCNLALVETKERLRKIAEYLDTQIALDVPVRIHMVGCPNSCGQRQIADIGLQGVKMKTKEKGIVEAFEIYVGGTLLDGGAYNQKLKGKIDGEDLPDVLASFISYFKENKLPAETFYDFVGRVGVETLQTALNNVLEEVIAS

SEQ ID NO: 27083 - protein, 562 aa, Arabidopsis thaliana
MVLTLIFIIRYEQSDHTHTVDDSSIEGESVHEPAKKPHFMTLEDLDYLFSNKSFFGEEEVSNGMLVWSRMRPFLERPDALPETAQGIEEATLAMKGLVLEINREKRAYSSGMVSKEIRRICPDFVTAFDKDLSGLSHVLLELPCGLIEDSSITLVGIPDEHSSSFQIQLVGSGLSGETRRPIILRYNVNFSKPSIVQNTWTEKLGWGNEERCQYHGSLKNHLGSPFTAALWFGLEGFHMTINGRHETSFAYREKLEPWLVSAVKVSGGLKILSVLATRLPIPDDHASLIIEEKLKAPSLSGTRIELLVGVFSTGNNFKRRMALRRSWMQYEAVRSGKVAVRFLIGLHTNEKVNLEMWRESKAYGDIQFMPFVDYYGLLSLKTVALCILGTKVIPAKYIMKTDDDAFVRIDELLSSLEERPSSALLYGLISFDSSPDREQGSKWFIPKERLIYGFLFVKEWPLDSYPPWAHGPGYIISHDIAKFVVKGHRQRDLGLFKLEDVAMGIWIQQFNQTIKRVKYINDKRFHNSDCKSNYILVHYQTPRLILCLWEKLQKENQSICCE

SEQ ID NO: 27084 - protein, 343 aa, Triticum aestivum
MAEVSNKRVILKRYVTGFPSEEDMELVPATARLAVPPGSAAVVVKNLYLSCDPYLRSRMSGNDEPSHVPDFVQGEVLTTLGVSKVVESGHQDYKPGDLVWGLTGCEEYTLITDLQSHFKINHPELPLSYYTGVLGMPGLTAYVGFFDVAKAKKGDYVFVSAASGAVGQLVGQLAKISGCYVVGSAGSDEKVNLLKTKFGFDDAFNYKKEQDLDATLKRCFPEGIDIYFENVGGAMLDAVLLNMRMHGRVSVCGMISQYNLEQREGVRNLFCIITKRIRMEGFIVRDHYGSYRKFEEEMAGYLKEGKITYVEDVAEGIESFPAALIGLFYGRNIGKQLVAVARE

SEQ ID NO: 27085 - protein, 328 aa, Dehalococcoides ethenogenes 195
MTAYRLEAIGLGAVHVDHIYTVEQILHDGECVVTESASFPGGSGANTIHGLSRLGLKCGFIGAVGNDPDGNLLISDFENAGIDNRYLLVKNEAQTGSVVSLSESSGRRSTYVNPGANNYLDLSDVNLEYLSQAKLVHMSTFFNQNEFALCHEIAERLAPDILFSFSPGSLFAAQGIKKLAPILSRTNALFTNQQDIEKMTQKNYQRATDMCIRSGCEHVVVTLGESRRFQRKGKITLQTYIRDKDHECHMESTVSLRKDIRTVVDTIGAADAFTTGFLFGLMEEKPIEECGLLGDISARFCIGKLGARSGLPDLEALKERFGMHYFTS

SEQ ID NO: 27086 - protein, 381 aa, Aspergillus oryzae
MATKPFQHLLHDKKHVIHAPEETSKVKVENCIGFVKVPVGIAGPLLVDGPNATNEQVYATLATTEATLVASCARGCKAFNACGGLQFDILGEGMSRAPVFKFPTPRHAIKFAKKVPELQSQFTTVAESTSRHLRLQKMVPHIVGSSVHLIISYYCGDASGQNMVTIATQKACQMLVSSQWGSEYGIVGFQLDGNMSSDKKPSWGNVKMTRGIEVMAWGTLTNSACEKILGTSSYNLYSTLLTGKEGGIRNGQFGCNANTSNIIAAIFIATGQDAACVAEGCWSHLVPEYDFDTKDLKISLYLPSLPVGVVGGGTAYETQNECLQIMKCLGPGMKGRFAGLIASFALALDVSTCSAVANHTFSQSHQRLARTSQQRTPKSNL

SEQ ID NO: 27087 - protein, 250 aa, Prochlorococcus marinus str. NATL2A
MSIFVGNLPFRAEQEDVMELFSPFGEVSNCSLPLERDTGRKRGFAFVEMADEAVEASAIESLQGAELMGRPLRINKAEPRGSAPRRGGGGYGGGGQGGYGGGGQGGYGGGQGGYGGGQGGYGGGYGGGGQGGYGGGGQGGYGGGGQGGYGGGGQGGYGGGGQGGYGGGGQGGYGGGGQGGYGGGGQGGYGGQADQSAQDRPSGAKGWEDRSHGNASQDVNDFDQGRSRRRRGASPEGGADSTADYGGAES

SEQ ID NO: 27088 - protein, 353 aa, Aspergillus oryzae
MAEFNRSEVLGSVFDTTNRYVNVRPVGLGAFSLVCSAYDLVRGQAVAIKKLLNPFATTANAKQTYREIKLLKQLRHENLIGLCDVFISPRTDVYLVTELLSTDLARLLEAGPLEPQFVQYFAYQILRGLKYLHSAGVVHRDIKPSNLVIDENCDLKICDFGLSRPQDHRMTGYVSTRYYRAPEVMLTWQRYGVEVDIWSAGCVIAEMFNGKPLFPGQDPINQFYLILDVLGNPSDKFISRICTTNTVEIIRSLERREPRPLQSVIQNLDDSARSLLERMLTLDPQERISAEEALQHPYMKMYHDPTDEPIAEERFDWMFNGGEFDKEMLKEMIPAYNLASCYHDIFNQNDLLQ

SEQ ID NO: 27089 - protein, 313 aa, Oryza sativa (japonica cultivar-group)
MAANFWTSSHCEGSKQLLDQEDVDKVPQADSDRGITLEEFRLVKIHMSFLLQIKANHLMISDIWRLAQQVKVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQCFDFRLLQDAGITDLTQFACCTCADLVAATLPQKANLKTQKTEQQTSTSKSKHLIQGYVNNYGEKVRLEDAAAAARSSFGTSNEPAFDEIRSSLECQKIWPQIVVEGSSNLFQHTGQLKTGSFALGGSLLVFTALFQNRKCNQC

SEQ ID NO: 27090 - protein, 175 aa, Pseudomonas syringae pv. syringae B728a
MTTANTAISALVVMGVSGCGKSAVGAEIALNSGGRLIEGDAFHPPANIEKMSAGTPLNDEDRAGWLTRLGEEMAAALAKGEHPVLTCSSLKLIYRQRLRDAVPGLGFVFLELSKELAAERCSHRPGHFMPASLVDSQFATLEPPYGEPLTLIVDASQPIDVIGKQAAAWWKGSHA

SEQ ID NO: 27091 - protein, 597 aa, Dehalococcoides ethenogenes 195
MTINNRKSHLKDLDPGLMKDWEIAEKAEEFLKPSKMLAEELGLTEDEIIPHGKYVAKVDFAGVLTRLKDRPNGKYIDVTAITPTPLGEGKSTTTMGLVQGLGNLGKKVTGAIRQPSSGPTFNIKGSAAGGGRSQCLPLSPFTLGLTGDIDAVTNSHNLAMVALQARIQHEANNTDEFLSSRSLKRLDIDPARVELKWAIDFCAQSLREIIMGIGGKTDGYQMHSGFGISVSSEVMAILSVFTGLADLRERMSKIIVAYRQNGEPVTTADLEVDGAMTALLLRAVNPNLLQTIEGQPVFVHAGPFANIAIGQSSIVADRLALKLADYHVTESGFGADIGFEKFWNIKCRLSGLKPDCAVIVATVRALKMHGGGPKVTPGAPLDPAYTTPNAALVEKGCQNMLAHIQTVKTAGINPVVCINHFAADTAQEIDIIRRTAEQAGARVAVSYHWANGGEGAAELAEAVIDACNEPNDFHFLYPEDMPLRERIYTIARKVYGADGVSYTQTALEKLARLENTGNTQFMPSCMVKTHLSLSHDPALKGRPGGFTLPIRDILTYMGAGLVVPVAGDIKLMPGTSSDPNFRRIDIDTHTGKVKGLF

SEQ ID NO: 27092 - protein, 226 aa, marine gamma proteobacterium HTCC2207
MDQNQLKLAVAAAAVEYTLSKINPDSIVGIGTGSTANCFIDLLAEHKNSFQAAVASSDASAERLRGHGIEVIELNAAAEITIYIDGADEANPHLELIKGGGAALTREKIVTAVANEFVCIADESKWVDFLGQFPLPVEVIPMARSHVARELVKLGGDPVWRENVITDNGNQILDVHHLYPVASAQALEEKINQITGVVTNGFFALKAADVLFLATQQGIVTHYPKA

SEQ ID NO: 27093 - protein, 397 aa, Dehalococcoides ethenogenes 195
MENLTIRDLDFSGKKALVRVDFNVPINAETGSINDDSRIRAAIPTIDYLLDHQAKVILCSHLGRPDGKVVESMRLAPVAKRLSEILRQEVLTASDCIGDEVTAKVNALEDGQVLLLENLRFHPEEEANDPAFARKLADLADIYVDDAFGTAHRKHASIVGVAKYLPAVAGLLLEKELNALGKVLEHPPRPFMILLGGAKVSDKVGMLENVMDKVDTILIGGGMAATFLKAQGLEIGDSLIDDSLDTAKMLMDKAKSKNVKIVLPDDVLITFDKIGPDAKAENVSVENIPPTAKIVDIGLLTITLFTKQLEKCKTVFWNGPMGIYEIPQFSEGTRAMVNTMTRLHGTTIIGGGSTAEIVTELNIASKMSFVSTGGGASLKFLSGEKLPGVEVLAKKHE

SEQ ID NO: 27094 - protein, 184 aa, Oryza sativa (indica cultivar-group)
MQLEISPRQRSQQQKEEEGEHQQRAGEEAVGAVFSIEPWVDAAAVLVPPLNFAEVNDGIFRSGFPAADNFAFLLSLKLRSIVYLCPEPYPEENTRFLEQNGIKLHQFGIDGSKELLVNIPEEKIREALKVILDVRNQPVLIHCKRGKECAYVQQQKIFFWCKNYLLTGWIALNTRYPSLLCPDF

SEQ ID NO: 27095 - protein, 506 aa, Polaromonas sp. JS666
MLYSAPGTTGANIAYKARYDNFIGGEFVAPVEGEYFDVITPITGKPYTKAARSGAKDVERALDAAHAAADKWGRTSPTERSNILLKIADRLEANLELLAYAETVDNGKPIRETLNADIPLTIDHFRYFAGCVRAQEGGLSDIDGDTVAYHFHEPLGVVGQIIPWNFPILMAAWKLAPALGAGNCVVLKPAESTPISILIMAELIADLLPPGVLNIVNGFGREAGMPLANSKRIAKIAFTGSTATGRQIAQAAASNLIPATLELGGKSPNIFFADVMDKDDGFLDKAIEGMVLFAFNQGEVCTCPSRALIHESIYDRFMERVLKRVAAITQGNPLDTDTMMGAQASKEQMSKIMSYMDVGKQEGAQLLMGGKQARLGGDLESGYYVQPTLFKGHNKMRIFQEEIFGPVLAVTTFKDEADALAIANDTLYGLGAGVWSRDGNVAYRMGRAIKAGRVWTNCYHAYPAHASFGGYKESGIGRETHKVMLDHYQQTKNLLVSYSESKLGFF

SEQ ID NO: 27096 - protein, 1573 aa, Schizosaccharomyces pombe 972h-
MSNESNIITVPILGKDTVRVGFGIHQYICTEILENFKSSTYVVITDSNIAPLYLEKIESTFNKSIKDAKAEARLLTYVIPPGESSKCRAMKAEIEDWLLTQSCTRDTILIAMGGGVIGDLVGYVAASFMRGIRFIQMPTTLLAMVDSSIGGKTGIDTPLGKNLVGAFWQPLRVYVDMVFLHTLPPRQVINGLSEIIKTAAMWNENDFQLLENNSAVLLDALNKPSVPGEYKFDSIKPLLQKIILSSIRTKCEVVTLDEHEGGLRNLLNFGHSIGHAYEAILYPQILHGECVAIGMVKEAELARYLGILKPNAVGRLTKCLVSYNLPISVNDPKVKKYASFKHCPVEKLIEYMAVDKKNQGSKKRIVILKAIGETYEKHATVVSDDDIRFILSRDVKVDEFTKSSWDVVVTPPGSKSISNRALVLAAMGNGTCRLTNMLHSDDTQFMMSALESLGAATFSWEDGGETLVVKGNGGKLAVPKEELYLGNAGTAARFLTGIAALVSSKDGAKVVLTGNHRMKVRPIGPLVDALRANGCEINYLEKQGSLPLDLSSKNGLKGGIIELAATVSSQYVSSILMCAPYASQPVTLKLVGGKPISQLYIDMTIAMMASFGVNVTKSTTEENTYNIPCGKYQNPPHYEIESDASSATYPLAIAAITGTKCTVPNIGSASLQGDARFACDVLRPMGCTVEQTATSTTVQGPPKGTLKPLESIDMETMTDAFLTASVVAAVACNVSEGDPVTRITGIANQRVKECNRIAAMVHELAKFGVRTGELEDGIYIFGKNYKELKKPEEGIYTYDDHRIAMSFSVLSLICPSRTLIIDKACVEKTWPYWWDVLHQSFGVKLTGATSVASDPLKGSISKNASIILIGMRGAGKTTIGKIIAKQLNFKFLDLDELLEDYLEMPIAEVIFRMGWDAFRLEEHKVLRKFITEHPEGYVAASGGGVIEMDESRNLLSNFVKEGGIVLHVHRNLEHIKSYLSEDQTRPTYKDQESIDDVYKRRHVWYRECRSHYFISPVLSNQVIDEKIQYSMSRFLDVVTGSSQVLQKFKTKKRSTFLTLNYPRIEDALPTLRDVTVGCDAIEVRVDYLKDPKSSNGISSLDFVAEQISLLRCSTTLPIIFTIRTISQGGLFPNDKEEEAKELMLSAMRYGCDFVDVELGWSSETINILYQHKGYTKLIMSWHDLSGTWSWARPHEWMQKVELASSYADVIKLVGMANNLNDNLELEEFRTRITNSMDIPLILFNMGRFGQLSRILNKFMTPVTHPLLPSKAAPGQLTVKQLNEARVLIGEILPEKFFLFGKPIKHSRSPILHSTAYELLGLPHTYEAFETDTVDEVQKVLNLPDFGGANVTIPYKLSVMKFMDELSDEARFFGAVNTIIPIRIGDKLVLRGDNTDWRGIYDTFANALDGVSLRDTNGLVIGAGGTSRAAIYSLHRLGVSRIYLLNRTLANSYRVQDVFPPDYNIHIIDSDNIPSEELSSVTLSAVVSTIPADIELPEKVASVIKALLANKADGGVFLDMAYKPLHTPLMAVASDLEWKCCNGLEALVRQGLASFHLWTGMTAPFDAVYQKVIE

SEQ ID NO: 27097 - protein, 431 aa, Pseudomonas putida KT2440
MTHRIVIVGGGAGGLELATRLGKSLGKRKQAEITLVDTNLTHIWKPLLHEVAAGSLNSSEDELNYVAQAKWNHFNFQLGRMSGLDREGKQIQLAATLDEEGRELLPARTLGYDTLVIAVGSNTNDFGTLGAAQHCLFLDTRKQAERFHQQLLNHYLRAHAGDVASEKISVAIVGAGATGVELAAELHHAAHELAAYGLDRIQPKDMHITLIEAGPRVLPALPERISVPVHKTLEKLGVKVMTNAAVSEVTEDGLKTKDGEVIQASLKVWAAGIRAPGFLKDIDGLETNRINQLVVRPTLQTTRDDNIFAFGDCAACPQPGSDRNVPPRAQAAHQQASMLAQSLKARLENKALPTYEYKDYGSLVSLSRFSAVGNLMGNLMGSVKLEGWLARMFYVSLYRMHQMALYGFFRTALMMLGSKIGRGTEPRLKLH

SEQ ID NO: 27098 - protein, 326 aa, Oryza sativa (indica cultivar-group)
MASVASFPVINMENLETEERGAAMEVIRDACENWGFFEMLNHGIAHELMDEVERVSKAHYANCREEKFKEFARRTLEAGEKGADVKGIDWESTFFVRHRPVSNLADLPDVDDHYRQVMKQFASEIEKLSERVLDLLCENLGLEKGYLKKAFAGSNGPTFGTKVSSYPPCPRPDLVDGLRAHTDAGGIILLFQDDQVSGLQLLKDGEWVDVPPMRHAIVANIGDQLEVITNGRYKSVMHRVLTRPDGNRMSIASFYNPGADAVIFPAPALAAAEAERADAAAAAYPRFVFEDYMNLYVRHKFEAKEPRFEAMKSAAEVVHAAPIATA

SEQ ID NO: 27099 - protein, 277 aa, Bradyrhizobium sp. BTAi1
MPLGWSARYPIYEAAAEEQNMTPNPFNLAGQVAVITGSSRGIGRASAELLAQLGAKVVISSRKAEACEEVANGIRAHGGEAHVIPCNISRRAEVDALIDGAVKQYGQVDILVCNAAVNPYYGPLLDISDEAFDKIMTSNVKSNLWLCAKAIPPMAARGKGSVIIVSSIGGLRGSTVIGAYGISKAADFALCRSLAGEWGPQGVRINCVAPGLIKTDFARALWEDEARLKQRCATTPLRRIGEPHEIAGAVAYLASDASTFMTGQTIVVDGGVTTAAV

SEQ ID NO: 27100 - protein, 329 aa, Schizosaccharomyces pombe 972h-
MSFLFNKRPKSTQDVVRCLCDNLPKLEINNDKKKSFEEVSKCLQNLRVSLCGTAEVEPDADLVSDLSFQIYQSNLPFLLVRYLPKLEFESKKDTGLIFSALLRRHVASRYPTVDYMLAHPQIFPVLVSYYRYQEVAFTAGSILRECSRHEALNEVLLNSRDFWTFFSLIQASSFDMASDAFSTFKSILLNHKSQVAEFISYHFDEFFKQYTVLLKSENYVTKRQSLKLLGEILLNRANRSVMTRYISSAENLKLMMILLRDKSKNIQFEAFHVFKLFVANPEKSEEVIEILRRNKSKLISYLSAFHTDRKNDEQFNDERAFVIKQIERL

SEQ ID NO: 27101 - protein, 244 aa, Arabidopsis thaliana
MASFVMGYFLLFAVAFMCLDARTDKTQDYTSFQYHKGALLTGDVSINLIWYGKFKPSQRAIVTDFVASLSSSRRSTMAQNPSVATWWKTVEKYYQFRKMTTTRGLSLSLGEQILDQGYSMGKSLTEKNLKDLAAKGGQSYAVNVVLTSADVTVQGFCMNRCGSHGTGSGSGKKGSRFAYIWVGNSETQCPGQCAWPFHAPVYGPQSPPLVAPNNDVGLDGMVINLASLMAATATNPFGDGLPRA

SEQ ID NO: 27102 - protein, 192 aa, Triticum aestivum
MPAYNSVFNSDPNVPRIIGNFPLLPLRTKTRGPAYTLPAPSPPLPANESPDPDSDSYDILDEVLALFRANTFFRNFEIQGPADRLLVYGIWFVSDCLTKIRPHASLRDAQKDVMNLALDLNFAIPGDPGWPLNQMYEAPKDRQEAEQLKQYMSQVRQELAARLLARVYDEDETKPSKWWLSFTKRKFMGKSL

SEQ ID NO: 27103 - protein, 531 aa, Mycobacterium smegmatis str. MC2 155
MHGLMQDRPLSLPLLMSGLDGRFSHKTVTTNHPDAPTVATYGAVAQRVRRLAGVLDALAVPVGARVGSFGWNTQRHLELYLAVPCTNRVLHTVNHRLFADDIVYIVNDAADDVLFVDRSLLDVVWPLVGRFTTVRHVIVMNDGSGPQIPDGAHDYEHLLAEARPVARFEVSDERTAAALCYTSGTTGRPKGVLYDHRSIVLHAMSLLMADAFGIGEADVVMPIVPMFHVNAWGLPYAAVMSGASLVLPGPAMQPASLAETLDTAGVTFAAAVTTVWRNVLPHLSGRSLPSVRRLVSGGGPLPESLSRRYASEIGVPLCSSWGMTETSPLVCSARIPTGHSGDEVETLCLPGVSIPLVQLRLQRDDGSFAPHDGKSSGELQVAGPTIASGYYGATDGSAAFTEDGWLRTGDVATIDAHGLVRIVDRIKDLIKSGGEWISSVELENAIMTCPAVAEAAVVGAPHERWGERPLAFVVPAAGHDATPDLVRDHLQQRVARWWIPDDIVIVDELPKTATGKISKRALRQNLCAPAG

SEQ ID NO: 27104 - protein, 344 aa, Nostoc punctiforme PCC 73102
MKVGINGFGRIGRLVLRAGLDNPNIEFVGINDLVPPDNLAYLLKYDSTHGQLKHKVEAKEDGILIDGHFIPCVSMRNPAELPWGKLGADYVVEATGLFTDYEGAANHLKAGAKRVVISAPTKDPDRVTTLLMGVNHHLFDPGKDIIVSNASCTTNCLAPIAKVINDNFGLTEGLMTTVHAMTATQPTVDGPSKKDWRGGRGASQNIIPSSTGAAKAVALVLPELKGRLTGMALRVPTPDVSVVDLTFKTAKATSYKEICAAMKEAAAGSLAGILGYTDEEVVSTDFQGDTHSSIFDAGAGIELNSNFFKVIAWYDNEWGYSNRVIDLMLSISQKEKLASTVAVV

SEQ ID NO: 27105 - protein, 376 aa, Prochlorococcus marinus str. NATL2A
MADFYDLLGVSRDADADTLKRAYRQQARKYHPDVNKEAGAEDKFKEIGKAYEVLSDSQKRARYDQFGEAGIGGAAGMPDMGDMGGFADLFDTFFNGFGGASSAGGSRPQRRGPQQGDDLRYDLTIDFDKAIFGQEKEITVPHLETCDVCRGTGAKKGTGPVTCSTCSGAGQVRRATRTPFGSFTQVAECPTCGGTGQVIKDPCNACGGKGVKQVRKKLKINIPAGVDSGTRLRVSGEGNAGLKGGPSGDLYVFLKVKNHPNLKRDGLIILSEVNISYLQAILGDTIEIETVDGPTKLQIPAGTQPNSILNLENKGVPKLGNPVARGNHQVSVKIKLPTKLSDSERNLLEELAGHYSARGPQHHYHKSGLFSKLFGK

SEQ ID NO: 27106 - protein, 251 aa, Dehalococcoides ethenogenes 195
MRQIIIAGNWKMNTTLSEACTLVQGMKYELDQISGIQKIVCPPFISLAPVKTILDGSSIHLGAQNLFYEEKGAYTGEISPLMLQDICPYVIIGHSERRAYFGETGQVVNRKIKAALQAGIMPIVCVGEKLEENENGQTRQILETQMKEALAGINPSSIIIAYEPIWAIGTGKAATAAEANNTISYIRKVLGDIWGNTASRITPILYGGSVNEKNTAELLCQSDIDGALVGGASLKAESFVSICRQAADVRK

SEQ ID NO: 27107 - protein, 388 aa, Dehalococcoides ethenogenes 195
MKLSKRIENLPPYLFVQISKKIAEKRAKGEEVISFAIGDPDLPTPKHILAELCKAAEDPANHRYPETEGLPVLRKAMAEWYEKRFGVKLNPDTEVLPLIGSKEGIGHAAWCFLDPGDVALVPDPAYPVYAISSQLAGAEVFYMPLNKENNFLPDFNAIPQDVLSKAKILWINYPNNPTGAVAGLDFFKEAAEFAAKHNLAVCHDGPYSEIAFDGYRPVSFLEADGAKEVGIEFHSLSKSYNMTGWRIGMAVGNAKMIDALRRFKSNLDSGIPQAIQLMAIAALNGSQDVISQNCAVYQRRRDRLVEALRNIGMEVTAPKASLYIWAPVPEGYTSASFATELLDKTGVVVTPGTGYGTSGEGYIRLSLTVPDEQLEKGIAKLANFKSQA

SEQ ID NO: 27108 - protein, 306 aa, Pseudomonas syringae pv. phaseolicola 1448A
MQAKIVIVGSLNMDLVIRAQRLPRPGETLSGETFDTVPGGKGANQAVAAARLGGSVAMIGCVGADAYGEQLRAALLAEHIDCQAVTVVEGVSTGIASIVVDASSQNAIVIVAGGNGRLTPALIERFDALLAGSGIVICQLEVPTETVFHTLTRARALGKTVILNPAPASEPLPANWYGLIDYLIPNESEAQTLTGVTVDSSAAAEEAAAAMLAAGARNVIITLGERGTLFASAAGVEHIPARRVQAVDTTAAGDTFVGGFAAALAAGQSESQAIRFGQAAAAISVTRAGAQPSIPTFEEVKEFDSL

SEQ ID NO: 27109 - protein, 340 aa, Prochlorococcus marinus str. NATL2A
MTLRVAINGFGRIGRNFMRCWLSRGANTNIEVVGINVTSDPKTCAHLLKYDSILGAIKDAEISHTDDTFQINGKTIKCYSDRNPLNLPWKEWGIDLVIESTGVFNTDVGASKHLQVGAKKVILTAPGKGDGVGTYVVGVNADSYSHEDFDILSNASCTTNCLAPIVKVLDQKLGINKGLMTTIHSYTGDQRILDNAHRDLRRARAAAMNLVPTSTGAAKAVALVYPQMKGKLTGIAMRVPTPNVSAVDLVFESGRKTSAEEVNSLLKTASQGEMKGIIKYGDLPLVSTDYAGTNESTIVDEALTMCIDDNMVKVLAWYDNEWGYSQRVVDLAEIVAQKWK

SEQ ID NO: 27110 - protein, 509 aa, Azoarcus sp. BH72
MRLLRLAKIITVSLRFGLDRMILDADASGRLGRIWHRVFFWRRFSEPRAVRLRKALESLGPIFVKFGQMLSTRRDLLPPDLADELALLQDRVPPFPTEQALAVLEGFYGRPVDAVFRDFERTPVASASVAQVHFARLPDGTEVAVKILRPGIERVIAHDLALMEVGAMLLDKAWPEGRRLKPREVVAEFSKYLRDELDLMREAANCSQLRRNFKDSPLLLVPEVYWDWCGRSVMVMERMHGVPISQTAAVTAQGTDLKALSRAGVEIFFTQVFRDGFFHADMHPGNIFVHADGRYIALDFGIMGTLNEVDKNYLAQNFLAFFKRDYKRVAMAHIEAGWVPAKTRVDEFEAAIRTVCEPIFDKPLKDISFGKTLLRLFQTARRFEMEVQPQLVLLQKTLLNIEGLGRQLDPELDLWKTAKPFLERWMNEQMGWRALVRGIKEEAPAWAGTLPQLPRLVHHNLVESSHHHVVHQAALASLAVTQRRQGRLLALLVIAAAALVALELHRLLG

SEQ ID NO: 27111 - protein, 191 aa, Schizosaccharomyces pombe
FNKRKFDYCIIDEASQIPLPICLGPLQLAEKFVLVGDHYQLPPLVKNSRTSKDGLSLSLFKLLSEKHPEAVTTLRLQYRMNEDINSLSSELIYGGNLVCGSKTISQKKLILPKAHLSDGLPDSSSSLHWVNKLINPSHSVIFFNTDDILGVESKTNNILENHTEAFLIEQAVSSFLERGVKQSSIGIISIY

SEQ ID NO: 27112 - protein, 455 aa, Prochlorococcus marinus str. AS9601
MSHEIFMPALSSTMTEGKIVEWLKNPGDKVARGESVLVVESDKADMDVESFQDGYLAAVLMPAGSTAPVGETIGLIVENEDEIASVQEQNKGNQPEVSSSDQLELVSNKTEEKPLVQTEIVEKQEKEVVLMSEKAAPSSNSDQINAATSNVSSRVIASPRAKKLASQMGVDLAKVHGSGPHGRIQADDILKANGQPVSIPWIGEGGSPASIPGVNLGVESKPEASGNSFGNPGETVQFNTLQKAVNKNMESSLDVPCFRVGYSINTDKLDNFYKKVKQNGVTMTALLVKAVAKTLKKHPQVNSSFSENGISYPENINIAVAVAMEDGGLITPVLKEPCNTDLFELSREWKDLVKRSRSKQLEPDEYSTGTFTLSNLGMFGVDRFDAILPPGTGAILAIASSKPTVVANSDGSISVKKIMQVNLTADHRVIYGADGASFLKDLASLIQDEPETLVS

SEQ ID NO: 27113 - protein, 361 aa, Xanthomonas campestris pv. vesicatoria str. 85-10
MSVSFASTRSPSPRSADELSVILAAPGFGLHFTDHMVAISWNNEQGWHDAQVRAYGPLQLDPAASVLHYGQEIFEGIKAYRHADGSIWTFRPQANGERLQRSARRLALPELPVDLFVESLRQLVAVDGNWVPSAPETSLYFRPFMIADEAFLGVRAAHKASYYVIASPAGPYFAKGVAPVSIWLSTEYARAAKGGTGAAKCGGNYAASLLPQQKAYAQACSQVLFLDPVEGKYIEELGGMNVFLVYKDGTLVTPELSGSILEGITRDSILQLARDRGMQVIERKVAIDEWKQGVASGEITEVFACGTAAVVTPIGELKGEGFAVGDLSAPAGEVTMSLRQELTDIQYGRVPDRHGWLVRLS

SEQ ID NO: 27114 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPRYYDGRYWTMWKLPLFGCTDSAQVLKEVEECKKEYPNAFIRIIGFDNTRQVQCISFIAYKPPSFTG

SEQ ID NO: 27115 - protein, 349 aa, Oceanobacillus iheyensis HTE831
MEALNLYGIEDLRYEDTPKPMIEKDDDVIIKVKSVGICGSDTSRYKKLGPYVEGMTFGHEFAGEVIEVGKSVTNFKSGDRVVACPTFSCGNCHYCREGHPTRCVELTVIGARNPGAYAEYTKLPEGHVKILPDSIDDDTAALVEPSAVVAHGFYRASITPGSSVAIMGVGSIGLLAVQWAKIFGASKVIAIDIDDHKLKIAQELGADIVVNPMKENAEGIVKQHTDELGVDLAVESAGSPITSEQVLALPKKGGEVVFLGIPYGDITLKRYYFEKIVRNELRILGSWNALSAPFPGKEWNATLHYMSTGQLNIKPMISHRLGLQAGPEIFHQITNKLSDAVKVIFHPGK

SEQ ID NO: 27116 - protein, 768 aa, Nostoc punctiforme PCC 73102
MEMNLQFPGINLISLKEAPIHISSQIQPHGVLLVLEEPELKILQVSTNTLKVFGIAPENMLHKKLEDLLDPFQIERIKTGLSGENLDFINPTKVWVRKKGDEYVVFDAIFHRNIEGFLILELEPAITQENIPFLSFYHLARASINQLEKTANLRDFCQVIVQEVRKITEFDRVMLYKFDDDGHGSVIAEEKLESLEPYLGLHYPESDIPKPARKLFAANSIRIIPDAYSQPVKLFPVNNPISDRPINLTNSILRSAASCHTEYLHNMGVGASLTISLIKDQKLWGLIACHHQSPKYVSYELRKACEFLGRVIFAEISAREETEDYYHRINLTHLQSILIEYMSQEENFIDGLVKNPQHLLDLASAQGAAVCFAGNCTVVGETPREEDLNFLVQWLKNNVEEEVFYTDSLPQIYPDAESFKNVASGLLAIPIAKRTYVLWFRPEVIQTVNWGGDPNKAFEVSQSEGNVRLCPRKSFELWKETVRLTSLPWKDVEVKAALELRKAIVNIVLRQADELAQLAQDLERSNAELKKFAYVASHDLQEPLNQVVNYVQLLEMRYSEELDEDAQEFISYAVQGVSLMQTLIDDVLAYSKVDMQAIAFQMNDVETALMRGLGNLRQRINETGATITHDPLPTVMADSTQLMQLFQNLIGNAIKFHSDQPPQIHVGAERIEDAWLFSVRDNGIGIDPKFSDRIFVIFQRLHTRDEYTGTGMGLAICKKIVECHRGRIWVESELGQGATFYFTIPVGGRELERRNGRKTQNHLFGRGQ

SEQ ID NO: 27117 - protein, 344 aa, Oceanobacillus iheyensis HTE831
MKALVKTELGHGNLHIQNVEEPSVSSHQVKIKVAYAGICGSDIHTYEGHYKVAAPVTLGHEFSGRIVEVGEGVTDFKVGDRVTSETTFSICGECRYCQTGDYNLCNHRKGLGTQQNGGFTNYLIAREESLHHLPDEVDDRSASMTEPLACTYHAIQKINIKPGDLVVVLGPGPIGLLAAQVAKSYGATVMMSGLDNDKIRLDKAKEVGIDYVINIQEEDIKEKIAALTDGYGVDVVLECSGSIHAANQGLDLLRKKGSYAQVGIFPDSHVKFDMEKVIQKEIHVVGSRSQKSADWEPSLQLMKEKKVDAKALVTHEFTIDQWDEAYQAIKDGEAIKVLLKPLQD

SEQ ID NO: 27118 - protein, 429 aa, Crocosphaera watsonii WH 8501
MKKVLAIILGGGAGTRLYPLTKLRAKPAVPLAGKYRLIDIPISNCINAEILKIYVLTQFNSASLNRHLTRTYNFTGFSDGFVEVLAAQQTAENPSWFQGTADAVRQYLWLFDEWDVDQYLILSGDHLYRMDYSDFVRRHQETGADITLSVVPIDERRASSFGLMKIDDSGRVVDFSEKPKGDALKQMQVDTSILGLNPEQAKESPYIASMGIYVFNKKALTDLLRNNPEQTDFGKEIIPGSAKDYNLQAYLFKGYWEDIGTIEAFYEANLALNRQPLPRFSFYNEKAPIYTRARNLPPTKVLNCNITESMISEGCMIKDCRINNSVLGIRSRIESDCVVEDSLLMGADFYESLDTRQSLLDQGKIPVGIGKGSTIRRAIVDKNARIGTNVNIVNKENIEESNREDDGFYIRNGIVVVIKNAVIPDGTVI

SEQ ID NO: 27119 - protein, 994 aa, Cryptococcus neoformans var. neoformans B-3501A
MVKSYMRHGPTQAFGIICSPTANSSYNGRLAYVPGWEDVLVWDTKRGEMVAMWHSTGLTSPVTYLIPAPTPYTSTSTTPVTFAVSYQDGSIRLWSYDPSTPDVEASETVTFNGHKKSVTTMTWDYDASRLASGGTEGEIVVWDRIGEVGLFRLKGHRAPITGLAFIPHPRGGHPGWLVSTSRDTYLKVWDLGTQHCVQTVVVGRGEVTSLAVREEAEESIIGQGEGEAEDEEEIKGRWTVVTGSGDGEAKVYTIEKSQLARGMAEDEKGELPALITSVCTLPLPSSTHPISQITWHPALPLLSLQTSDRGVAILRLRTEEEVSAKRARRKKRDREKKKKGKGDKQKEEDKQKEEDKEEDEKDEPVKWEERVAVWCMVRANAKVKSFAFADENVVSVKGGVSLLLALSNNSIESYTIPTPGSKSKLADGTTPEPTKTHSIELPGHRQDIRTISISSDDQVIASASSGTLKLWNARTTACIRTMECGYALCSTFLPGDRHVVIGTKGGELMLYDVAASSLLKTYKAHTGPVWSVSVRPDGRGLVSGSADKDVKFWDFEMREEGEGEKVVSRLGVETVYKTKQLALVHVRTLKMTDDILCLKYSPNGRFLAIALLDSTVKIFFSDTLKFFLSLYGHKLPVLSLDISLDSKLLVTCSADKNVKIWGLDFGDCHKSIFAHDEAVMGVMFEKEAGSHNFWTVGKDRMVKYWDGDKFELIQKLSGHHGEIWALSTSQSGQFVVTGSHDKSIRIWEKTDEPLFLEEEREKEIEAMYDSNLADTLNREPGEGEGEGDEAEAVQKQTAETLIAGEKIMEAIELADADRAATRQWQVDNAKSNIEIPRPPRNAELIARGDLEPDEYVLKVVQKLPAAQMEDALLVLPFRMVVSLMGYLDEWAMQGKEIILVSRILFFLLRTHSSQIVSNRIMRTPLLTLRHHLRDALAQQRDVMGYNLAALKFLKGRWEGERVAGLYEQEGLDEEAVRKRLEEGRGKRKRIEVRA

SEQ ID NO: 27120 - protein, 412 aa, Fusobacterium nucleatum subsp. vincentii ATCC 49256
MPYKKYSSSNDKNSADEIKEFKKLISSLHKNGIEVILDVVYNHTAEGGSGGKVYNFKAMDENTFYIKNKNNIFVNFSGCGNTLNCNHKVVKDMIIQSLLYWYLETGVDGFRFDLASVLGRDSNGQWAKHSLLHELIEHPILSHAKLIAESWDLGGYFVGAMPSGWSEWNGAYRDTVRQFIRGDFNQVPELIKRIFGTVDIFHANKNGYQSSINFICCHDGFTMWDLVSYNLKHNLLNGENNQDGENNNHSYNHGEEGLTENPQILSLRKQQIKNMLLILYISQGIPMLLMGDEMGRTQLGNNNAYCQDNPTTWVDWDRKKDFEDVFLFTKNMINLRKSYSVFKKETPLIEGEEVILHGIKLYQPDLSYHSLSIAFQLKDIETDTDFYIAFNSYSEQLCLELPILENSLVSSN

SEQ ID NO: 27121 - protein, 510 aa, Gracilaria tenuistipitata var. liui
MKSIILTILDGWGYSENKKGNAIQIADTPTIDKLWNSYPNTLLNASGRDVGLPEGQMGNSEVGHTTIGAGRIINQDLVRISKSIEDRSFFNNEAINSICQKINFYNTKLHLIGLCSNGGVHSHIKHLFALLDIAMRYKIQICIHAITDGRDTSPYGSKIFIEEINNQIQQFNHINICTISGRYYSMDRDCRWARTEKSYNTLLKNTLGFTKDPILMINEYYKKNISDEFIPPTRLHKGSIENNDGIIFFNFRPDRMRQLVHAFTKSTFKGFNTTSFHNLEILTLTQYDPSLDIEVAFPAKKNKNFIGEIIAKYGLKQLRLAETEKYAHVTYFFNGGIEEPFAGEDRQLIPSPKVETYDLDPEMSATKLTESAINAINKNTYKFIVINYANPDMVGHTGNLDATIHAIQKIDKCIKKIWLACQAMNSTLIITSDHGNADYMLDENNEPCTSHSTNPVPFILAEPTNIHTYHLRKNGNLADIAPTILQLLNLNIPNEMNGISLLETKAKNKI

SEQ ID NO: 27122 - protein, 262 aa, Azoarcus sp. BH72
MLTAAAAGSPRVFLTGASSGLGAALARHYAARGASLGLVARRADALHELVASLPGRHLALVADVADPAALRSAATRFEAAFGVPDIVIANAGVSVGTLTEYAEDLDAFERVLRTNLLGMAATFQPFVEAMRARGRGRLAGIASVAGIRGLPGAGAYSASKAAAITYLESLRVELHGSGVTVTTIAPGYVATPMTAVNPYPMPFMLPAAEAAARIARHIDTGRRYAVVPWQMALVAKLLRVLPDALFDRLFAHAGRKPRGLPL

SEQ ID NO: 27123 - protein, 389 aa, Mesorhizobium loti MAFF303099
MADTTTRPGVEQVAAVEPAIVIGAGAAGLAVAQALIKAGVPVAILEKESRLAEPWHRRHQQLHLNTHRDLSALPGLSYPGGTPAFPPKSVVIRHMNDFREANQLPVEFGVAVETLVFRGDHWAVRTSAGSRLARHVVVATGRDKEPFTPQWQGMQAFTGRIIHSADFGDAQSYAGKKVLVVGAGNSGFDALNHLAGVDTASLWLSARNGPALLPKRIGKIAVHRLSPLMARLPLRVADAVMAATQRLVFGDLTKFGMPPAPSGGASRLTSDYTAIAADDGAVDAIKSGKITVVPAIREFTRDGVILANGSLVDPDIVIAATGYRTGLERMVGNLGVLDGKGVPLFNGGQADPKLPGLWFTGMRPSIRGCFANAAILGKAIARRIAGAGR

SEQ ID NO: 27124 - protein, 243 aa, Mesorhizobium loti MAFF303099
MGAPAQSTEIRMHGSITARCRRLTLVSAAALALTIIPYRISLHGSAPGIDAASAQAAKGGNGGGNGGGNGGGNGGGNGGGNGGGNGGGNGGGNGGGNGGGNGGGNGGGNSGGNGGGDSGGNSGGNGGGNGGGNSDGNGGGDSGGNSGGNGGGNSGNSGGGNSGTEGGGETSGLGKGQVDKGVSHVNGTTGDKVEVSDNKITVTHPDGITEKIENGRFKMKDALGRTIIDRRATPADVSRLKAL

SEQ ID NO: 27125 - protein, 439 aa, Bordetella parapertussis 12822
MTQTPNTGSPHRVVIVGGGAGGLELAAKLGRAHGRERVTLVDSRPFHIWKPSLHEAAAGTLDIHQEGLSYLMLANMCNFTFAQGELQGIERERRQIQVGPVADPSGQQVLPPRELSYDTLVLAMGSTSNFFNTPGAAEHAVTLDTTENAEQFRLTMLKAMVQVDLRKVHDPSARLDLVIVGGGATGVELAVELIEASHVVSAYGLPNFRADRDLVITLVEGAPRILSALPEKISRAAHARLTELGVRVETDCRVAEVGADHVVTADGRRFEATMCLWAAGIEGPPLFRQLGLPLNRLGQLEVNERLESPDPHILALGDCCAAPWKDGRTVPARAQAAHQQADYLARKLTARLRNAAEPTEAYAYHDHGSLVSLGQGSGVGSLMGKLAGRGLFVSGTLARLMYMSLHLMHHRAVLGISRTATLALARLLMRRTRPRVKLH

SEQ ID NO: 27126 - protein, 732 aa, Arabidopsis thaliana
MQKSGVNRNPSLKVAIPQAQQSLRRLGFCSQIATGGSQQSSPIVFPEKRNKKVKASSRRGEVTNDPQVKPKPDEHRIDIGGGDEKSDLLGSLVYAGKLVLDKRKSASGKDATEIQQPAATDISIKKAVDAKLTSSALVWGSDMLQLNDVVSVTYNVGLRHFTVHAYPIGKGSCGLSCFTKPKRSRKDFRFVAPTVEEAVQWVASFGDQQCFINCLPHPLVAKKQASSELFSVPIDTPPELVFRCKSAPKMLVILNPRSGHGRSIKVFHNVVEPIFKLAGIKMEVVKTTKAGHARELASTVDINLCSDGIICVGGDGIINEVLNGLLTRSNPKEGVSIPIGIVPAGSDNSLVWTVLGVRDPISAALSIVKGGLTATDVFAVEWIHTGIIHFGMTVSYYGFVSDVLELSEKYQKRFGPLRYFVAGFLKFMCLPKYSYEVEYLPAQKEDAEGKIRLEKEAVDMQDLYTDVMRRSSREGFPRASSLSSIDSIMTPSVGELDTCSSTHASTEPSEYVRGIDPKMKRLSSGRRDVTAEPEVIHPQAQSTTPNWPRTRSKSRMDKGWMGLTSVQDPPTRCSWGNTGGQDREDISSTVSDPGPIWDAGPKWDTEPSAWDVENSIELPGPPEDIETGLRKQSITPIFEDKWVSRKGHFLGIMVCNHACRTVQSSQVVAPNSEHDDGTMDMLLVHGCGRLRLLRFFILLQTGRHLSLPYVECVKVNYLSYFLTLRNLQLAMC

SEQ ID NO: 27127 - protein, 521 aa, Neisseria meningitidis MC58
MTQDKILILDFGSQVTQLIARRVREAHVYCELHSFDMPLDEIKAFNPKGIILSGGPNSVYESDYQADTGIFDLGIPVLGICYGMQFMAHHLGGEVQPGNQREFGYAQVKTIDSELTRGIQDGEPNTLDVWMSHGDKVSKLPDGFAVIGNTPSCPIAMMENAEKQFYGIQFHPEVTHTKQGRALLNRFVLDICGAQPGWTMPNYIEEAVAKIREQVGSDEVILGLSGGVDSSVAAALIHRAIGDQLTCVFVDHGLLRLNESKMVMDMFARNLGVKVIHVDAEGQFMAKLAGVTDPEKKRKIIGAEFIEVFDAEEKKLTNAKWLAQGTIYPDVIESAGAKTKKAHAIKSHHNVGGLPENMKLKLLEPLRDLFKDEVRELGVALGLPREMVYRHPFPGPGLGVRILGEVKKEYADLLRQADDIFIQELRNTTDENGTSWYDLTSQAFAVFLPVKSVGVMGDGRTYDYVIALRAVITSDFMTAHWAELPYSLLGKVSNRIINEVKGINRVVYDVSGKPPATIEWE

SEQ ID NO: 27128 - protein, 248 aa, Neisseria meningitidis MC58
MSTQDLNGKIALVTGASRGIGAAIADTLAAAGAKVIGTATSESGAAAISERLAQWGGEGRVLNSAEPETIESLIADIEKAFGKLDILVNNAGITRDNLLMRMKEEEWDDIMQVNLKSVFRASKAVLRGMMKQRSGRIINITSVVGVMGNAGQTNYAAAKAGLIGFSKSMAREVGSRGITVNCVAPGFIDTDMTRALPEETRQTFTAQTALGRFGDAQDIADAVLFLASDQAKYITGQTLHVNGGMLMP

SEQ ID NO: 27129 - protein, 226 aa, Pseudomonas aeruginosa PAO1
MKRMRLKAVLFDMDGTLLDTAPDFIAITQAMRAAHGLPPVDEQRVRDVVSGGARAMVAAAFGLSLDSPEVEPLRQEFLDRYQEHCAVLSRPYDGIPELLAAIEKAGLIWGVVTNKPVRFAEPIMQRLGYAERSRVLVCPDHVTRSKPDPEPLLLACSQLGIDPSRVLFIGDDLRDIESGRDAGTKTAAVRYGYIHPEDNPAHWGADVIVDHPRELIDVLDRALCDC

SEQ ID NO: 27130 - protein, 409 aa, Methylomonas methanica
MNKPKKVAILTAGGLAPCLNSAIGSLIERYTEIDPSIEIICYRGGYKGLLLGDSYPVTAEVRKKAGVLQRFGGSVIGNSRVKLTNVKDCVKRGLVKEGEDPQKVAADQLVKDGVDILHTIGGDDTNTAAADLAAFLARNNYGLTVIGLPKTVDNDVFPIKQSLGAWTAAEQGARYFMNVVAENNANPRMLIVHEVMGRNCGWLTAATAQEYRKLLDRAEWLPELGLTRESYEVHAVFVPEMAIDLEAEAKRLREVMDKVDCVNIFVSEGAGVEAIVAEMQAKGQEVPRDAFGHIKLDAVNPGKWFGEQFAQMIGAEKTLVQKSGYFARASASNVDDMRLIKSCADLAVECAFRRESGVIGHDEDNGNVLRAIEFPRIKGGKPFNIDTDWFNSMLSEIGQPKGGKVEVSH

SEQ ID NO: 27131 - protein, 494 aa, Mycobacterium smegmatis str. MC2 155
MTTRWRTKSVEQSIADTDEPSTRLRKDLTWWDLTVFGVSVVIGAGIFTITASTAGNLTGPAISISFLIAAVACGLAALCYAEFASTVPVAGSAYTFSYATFGEFVAWIIGWDLILEFAVAAAVVAKGWSSYLGTVFNFGGGTMQIGGGLTLDWGALLIIAVVTFLLARGTKISAMVSLVITVIKVSVVLLVVFVGAFYINTANYTPFIPPAESGDGSGGGTGAEQSLFSLLTGAEGSHYGWYGLLAGASIVFFAFIGFDIVATTAEETRNPQRDVPRGILGSLAIVTVLYVAVSVVLSGMVSYRDLKTVDGESANLATAFAQNGVDWAAKVISIGALAGLTTVVIVLMLGQTRVLFAMSRDGLMPRQLAKTGPHGTPVRTTLIVGGAVAVAASVFPIGKLEEMVNIGTLFAFVLVSAGVLVLRRTRPDLPRGFRTPLVPVLPVAAILACVWLMLNLTGLTWIRFLIWMAIGVVIYFLYGRRRSVLATRDTTPTA

SEQ ID NO: 27132 - protein, 465 aa, Oceanobacillus iheyensis HTE831
MTEQNYQFPAGFWWGSATSATQIEGAANQYGKGQNIWDHWYNIQPERFYNQVGPEHTSDFYHRYKEDIALMKEFGHNSFRLSISWSRLIPDGVGEVNEEAVSFYHNVIDELIANDIEPFVNLFHFDMPLPLQEIGGWENREVIEMYRQYAKKAFELFGDKVKKWFTFNEPIVPVEGGYLYNFHYPNVVDAKRAIQVAYHTIIAHATAVQTFKELNIENGKIGIILNLTPSYPRSENTADQKAAHIADLFFNRSFLDPAVLGEYPEDLINLLKEHNHLPQTEDGDAGLIKENTIDILGVNYYQPRRVKAKDNLPNPYSPFMPDWFFDSYEMPGRRMNEYRGWEIYEKGVYDIMINLKENYHNIESFISENGMGVQGEEHFIENGQIQDDYRITFIKDHLKWLHRAIDEGCNAKGYHLWTTMDNWSWSNAYKNRYGFFSVNIDTMERTPKKSAYWFKQISEQNGFHA

SEQ ID NO: 27133 - protein, 258 aa, Magnaporthe grisea
MSAGKLDKSLDEIVSSQRRTAGRRGGAARRSTGRPAPAAPVGGIHKNPRAARSAVQKPAPAKASGAPGTSKVVVSNMPKDVSEAQIKEYFGQSVGPVKRVEISYGPGGVSRGIATVTFAHADGASKAFAELNGLLIDNKPVKVEVVVASADQIPAPKTLSQRVTQNKAQPKSAATDKRGATAGKGAGAGAQANGAKGAKKAAPRKGRNARPAKKTAEELDSEMADYFQGGETNTEAAPYGAAPAATNGGDAAMEDDIL

SEQ ID NO: 27134 - protein, 524 aa, Cryptococcus neoformans var. neoformans B-3501A
MRPTITLRHLLPLGIRSKHIMPTHAKLNVPSLGEVEVPVGLFINNEWVESTSRETFSTVNPATGQKLLDFAHAKKEDIDKAVIAARKAFKTTWGNNILAAERGVLLNKLADLMERDSDKLAALESINSGKGIRIAREADVADSVACIRYYAGLADKIHGQTVSSFGKEKFVYTLHQPIGVCGQIIPWNYPIMMWAWKIAPALAAGCTVVMKPSELTPLSALALCDLVKEAGIPAGVINTVPGLGATAGDAISRHMDIDKVAFTGSVSTGRRISIAAAESNLKKVTLELGGKSPVIVFDSADVEEAADWAALAIWFNSGQDCCAGSRLYVQEGIFDKFLAAMKKRAEACAIGQPHDEKTSFGPLISEGQRDKVLNYIVSGKEQGARVVTGGQKWPESNDGYWIEPTILADTTPDMTIVKEEIFGPVVVAAPFKTEEEVLEVANDTSYGLAAAVFTNDTRQATRVSAALDAGTVWINQYALLHPGVPFGGFKQSGIGRELGTYGLEAYMQIKAVHNNLTQTSPWPV

SEQ ID NO: 27135 - protein, 867 aa, Debaryomyces hansenii CBS767
MILVNQAMRGNKDKDLEATVGPQSPRGGDKKGTRFNFGGFLKKIPLPVNKRSSEEVKEGAEGQTDPVEISMSPTAKSSPSDEIGVGSSGGNVIEGNSNYTHEIIPVGDPSRNKLRYATFTAKCISLENSELTSQIDLDEQSIDEPQDSVFTQVAGPPPVIIDRKYTKKKSKNPKLRINSNQSVTSVVDNPNPRGEVFENYQHFDNFEAYKQDLAEEDDVVEYLSESESDLNINPHQEENANDYKVGGYHPVSKGEVYFSRDFPNREYIILRKLGWGHFSTVWLAKSRYNRELNPSTSEDASVDTNDYYVAIKFVKSSDSYMEAAEDEIKLLKTLDKPLVYGKHLEEQHKQFFENHKINKHNQPVGHPGYKHIMRLLDDFEVTGPNGKHICMVFEVLGENVLNLIFKSKTISKDLKQNTKSPIGSKDMKPENNKNFKLFKSKLSLGLINNPKKEVLTSATDDNLSGVGCIKNNSSDSLTKLIGVQKTYGGIPLTLVKQIVKQMFLAVDYMHHCGIIHTDLKPENILIEIKDINNVIKVIENEKITKFNAKYKNRKDSSISTVNINTDKIGLNRANSTNPKTRQDSVGYGLYRKSRNSVCCKCDSPVRSSKPLSSSINSDTTFQEVSFYGNGNQSRKSSICKINEGGISPTTMSILKPKVEKNKDDSELISIKIADLGNATFSHYHFTNQIQTRQYRAPEIILKHKTWGSSADIWSIGCIIFELITGDYLFDPHNGNNFDKDEDHMAQIVELLGEFPTPDYLNNCDLTSTFLKKDSAGKYSLRNINKLKYWSLHDVLVQKYKFDENDINLQLINDLILKCLTYDLTERYDCKSLANHPWLNNDLDLDNFDFETSTNIPKDHNDIPGFTS

SEQ ID NO: 27136 - protein, 267 aa, Salmonella typhimurium LT2
MAEPLTVSPELTANYAYFFDLDGTLAEIKPHPDQVVVPHKILQLLDRLAAHNAGALALISGRSMTELDALAKPFRFPLAGVHGAERRDINGKTHIVRLPEAVVREVEALLRSTLVALPGTELESKGMAFALHYRQAPEHEAALLALAQHVTQHWPQLALQPGKCVVEIKPKGTNKGEAIAAFMQEAPFAGRIPVFVGDDLTDEAGFGVVNHAGGISVKVGVGATQAAWRLESVPDVWRWLEQINYPQQEQQVMNNRRDGYESFSRSI

SEQ ID NO: 27137 - protein, 185 aa, Salmonella typhimurium LT2
MKKVAVLLAPGFEEAEAIVTLDILRRLHIDVETLACAESRAVVSYHDIPMVADSTLSERQQALFDAVVLPGGPQGSANLAANPAVIAFVARHDAAGKLICPICSAAARVLGAHGLLKGRRYVCSGDLWKAVPEGVYVDAPVVEDGNLISGKGLGHVFDFALTLSARLLGDDAPVREQAEHIYYPW

SEQ ID NO: 27138 - protein, 76 aa, Triticum aestivum
  misc_feature (2)..(2): Xaa can be any naturally occurring amino acid
  misc_feature (5)..(5): Xaa can be any naturally occurring amino acid
  misc_feature (15)..(15): Xaa can be any naturally occurring amino acid
  misc_feature (30)..(30): Xaa can be any naturally occurring amino acid
  unsure (1)..(76): unsure at all Xaa locations
EXNPXDQIVHKRKIXIAKAQGDMSLAVDYXNKYLELCHKQAAFCYEELILAQPTIPLYHLAYAEVSGPNTAFRGNK

SEQ ID NO: 27139 - protein, 470 aa, Streptomyces fradiae
MTVTLRANSSPGRPDGPPTSTTGDRTGVVLRHALAQGLLSAEQPVAGFLDVDHIRQQVASLRAAFAGAPDVLHTFAAKAASLVPVLRLLAEDGMGCEVASPGELRLALDAGFPPDRIVLDSPAKTRSEIAEALRLGVAVNADNLDELERIDALRPPGCSSVIGLRVNPQVGGGAIGAMSTATATSKFGVALRDEGARERVVEAFARRPWLTGLHAHVGSQGCPLELIAEGIAATHRLAEEINAVLGRRQVTGLDIGGGLPVNFTDDTVRPTYQDYTAALRTAVPGLFDGRYALVTEFGRSLLAKSGFIAARVEYVKEAGGRRIAVTHAGAQTATRTALMPDAWPLRVGAFDAEGHPKQTPPRVQDVAGPCCFAGDVVATGRELPLLEEGDHVVLYDTGAYYFSTPWAYNSLPRVGVHGYRTDGAQVRSAPVRDPQTLDEIAAESGARHAAGLVTLAARPATAETTGEERA

SEQ ID NO: 27140 - protein, 458 aa, Zea mays
MANGDAAVEVGGNGEQEVAARQASTFAELGICAELVEACDAMGWKEPTRIQAEAIPHALQGKDLIALAQTESEKTSAFALPILQELLSNRQAEQSFFACVLSPTRELAIQIAEQFEALGSAIGLRCSVLVGGVDRVQQVLSIGKRPHIVVGTPGRLLDHLTETKGFSLKKIKYLVLDEADKLLNVEFEKSLDDILSEMPKDRRTFLFSATMTKKVNKLQRACLRNPAKVEVSSKYSTVDSLKQEFYFVPADDKDCYLLHVLNERLESMIMIFVRTCESTRLLALMLRNLGLKAMSISGQMSQDKRLGALNRFKAKDCNILICTDVASRGLDIQGVDMVINYDIPMNSKDYVHRVGRTARAGRSGYAVSLVNQYEAQWFVLIEQLLGFAGKKIDQCKVDRDEVLILKGPISDAKRIALTKLKDSGGHKKRRNVGDDDEEVEDHSSHSRRPKSLKRSNRR

SEQ ID NO: 27141 - protein, 403 aa, Nocardioides sp. JS614
MSDPTVVIIGGGQAGAVATRALRRKGHAGRIVLVGEEPLRPYQRPPLSKEYLATGDASGLDLLPETWTEENDVEVRTGARALKISAADAGVLLDDGTTLPADRVLIATGGRPRRLADADGDRVRYLRTRADADALDDLMTPGGRLVVVGGGFVGAEVASTALARGLHVTVLEAAPVPMGRALGAELGARCGRLQVAAGVDLRLDAAVGRVRQEGDEVVVETSTGTVAGDCVLVGIGMVPNDEVARDSGIETGNGILVDEHCRTSLPNVFAAGDVANHHHPLFGTRMRVEHFDNASRQAAVAADNLLGRSTVFDDPHWFWSDQYGANLQFVGHAEGADQVVTRGDPESESWSAFFLREGRVRAAFALNQGEDVAVARELIALGIAVPPGTLADPDADLMEAFDE

SEQ ID NO: 27142 - protein, 545 aa, Candida albicans SC5314
MSSKIERIFSGPALKINTYLDKLPKIYNVFFIASISTIAGMMFGFDISSMSAFIGAEHYMRYFNSPGSNIQGFITSSMALGSFFGSIASSFVSEPFGRRLSLLTCAFFWMVGAAIQSSVQNRAQLIIGRIISGIGVGFGSAVAPVYGAELAPRKIRGLIGGMFQFFVTLGIMIMFYLSFGLGHINGVASFRIAWGLQIVPGLCLFLGCFFIPESPRWLAKQGQWEAAEEIVAKIQAHGDRENPDVLIEISEIKDQLLLEESSKQIGYATLFTKKYIQRTFTAIFAQIWQQLTGMNVMMYYIVYIFQMAGYSGNSNLVASSIQYVINTCVTVPALYFIDKVGRRPLLIGGATMMMAFQFGLAGILGQYSIPWPDSGNDSVNIRIPEDNKSASKGAIACCYLFVASFAFTWGVGIWVYCAEIWGDNRVAQRGNAISTSANWILNFAIAMYTPTGFKNISWKTYIIYGVFCFAMATHVYFGFPETKGKRLEEIGQMWEERVPAWRSRSWQPTVPIASDAELARKMEVEHEEDKLMNEDSNSESRENQA

SEQ ID NO: 27143 - protein, 162 aa, Glycine max
  misc_feature (22)..(22): Xaa can be any naturally occurring amino acid
  misc_feature (24)..(24): Xaa can be any naturally occurring amino acid
  unsure (1)..(162): unsure at all Xaa locations
GQLRRPPPPPHHYWLFHIRRNXTXPLSTTQITHTHTELQEKESEIPMATLDSDVPMVPAGEPSSSAGPSSKKPKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 27144 - protein, 393 aa, Arabidopsis thaliana
MKRPVTGKDLMIVNMGPHHPSMHGVLRLIVTLDGEDVVDCEPILGYLHRGMEKIAENRAIIQYLPYVTRWDYLATMFTEAITVNGPEQLGNIQVPKRASYIRVIMLELSRIASHLLWLGPFMADIGAQTPFFYIFREREFVYDLFEAATGMRMMHNFFRIGGIAADLPYGWIDKCLDFCDYFLTEVVEYQKLITRNPIFLERVEGVGIIGGEEAINWGLSGPMLRASGIPWDLRKIDRYESYDEFEWEIQWQKQGDSLARYLVRLSEMTESIKIIQQALEGLPGGPYENLESRGFDRKRNPEWNDFEYRFISKKPSPTFELSKQELYVRVEAPKGELGIFLIGDQSGFPWRWKIRPPGFINLQILPELVKRMKLADIMTILGSIDIIMGEVDR

SEQ ID NO: 27145 - protein, 181 aa, Candida albicans SC5314
MASASAKKLAVANTNILNQLLIISASINIIVFLIISIFHRPSSYKPWIIFSIPSIFLQYSLEKFGRPKYTNGNSLVSSGEDIRLSGSLYEYYFDVIYLTWGFDILMIIFGSNKVWYGYLIIPGFAIYKLSNFILPFIKKNKSNGSTPEEQQAETKQTNSATSKRQQKLQARREKGPAVKYR

SEQ ID NO: 27146 - protein, 132 aa, Cicer arietinum
MASKVNVASINISLILCLNLISLTMVKSNYVVPEVPVPIVDPYPKGTITCPINALKLGVCAKVLNLVKVKLGAPPTLPCCSLIQGLADLEAAACLCTALKANVLGLHLDVPISLSLILNNCGKNNSGFQCPL

SEQ ID NO: 27147 - protein, 501 aa, Nocardioides sp. JS614
MAGTEARPVEAAAAQHRHRVVVIGSGFGGLFGTKALRRVDVDVTMVAKTTHHLFQPLLYQVATGILSQGEIAPPTREVLSSQRNVTVLLGEVSGIDLAARTVTSQVLGRPTVTPYDSLIVAAGAGQSYFGNDQFAEYAPGMKSIDDALELRGRIFGAFELAELGAARGDHIDHLLTFVVVGAGPTGVEMAGQIAELAHRTLRKDFHHINTRTARVILVDAAPQVLPPFGAKLGAKTKTELEKLGVEVVLGAMVTDVDERGIEMKFKDGRVERVDTVTKIWAAGVQASPLGRTLSEQTGAPLDRAGRIAVNPDLTLPGHPEVFVVGDMIALDNLPGVAQVAIQGARYAAEEIERRLRSKPSQGPFKYFDKGSMAIISRFRAVAMIGRVRVTGVLAWLMWLGLHLVYITGFKSRVTALLHWAVSFVGRGRAERTTTEQQIFARSALGRLEHGAADLVSDPGAYDATRELLETTRRAELEAQALEEARLTDAGERGVRTGDRAG

SEQ ID NO: 27148 - protein, 128 aa, Brassica napus
MGPIKALKKRKRSAEKKADPNVLLAAASAATDSLHNDNHDSSQPSDWWDGFSRRISGPYSGSTDPKTFESVFKVSRKTFDYICSLVKDDFTAKPANFSDSNGKPLTLNDRVAVALRRLGSGESLSVIG

SEQ ID NO: 27149 - protein, 164 aa, Cucumis sativus
TQGDYEGKAVIISWVTPDELEPNSVQYGTSEGGYEFTAEGAVTNYTFYKYKSGYIHHCLIADLKYDTKYYYKIGSGDSAREFWFHSPPKVDPDASYKFGIIGDLGQTFNSLSTLKHYMKSGAQTVLFLGDISYADRYLYNDVGLRWDTWGRFVEQSTAYQPWIW

SEQ ID NO: 27150 - protein, 479 aa, Pseudomonas putida KT2440
MSVQTTTTRNASAHTFKQDMQTRHIVMLALGGVIGTGLFLTSGYTVNQAGPLGAVIAYILGAIMVYLVMMCLGELAVHMPEVGSFSSYATRYLGPGTGYMVAWMYWLTWTVAIGSEFTAAGILMVRWFPDTPVWMWSALFGAAVFISNIISVRSFAETEFWLSLVKVLAVIAFLVVGGGAILGGFEIQQAHSAGLGNFTREGLFPTGFWSIAMTLLAVAFAFSGTELIGIAAGETKDPEKNVPKAIRTTVLRLALFFIGTIFVLATLLPREQAGVIESPFVMVFAMIGIPYAADIMNFVIITALLSAANSGLYAASRMLWTLSDQGNMPRRYATLSRRGTPFNAIVLSMAGGMASLLSSVFAPDTIYLALVSISGLAVVVVWISIAASQIAFRRHYIASGGKLEDLKFRVRGYPFVPLGAIFCCVLACVGIAFDPAQRVALYFGLPFIAWCYLAYWLTCKYRSRRTAPLEIVAPGSEAA

SEQ ID NO: 27151 - protein, 140 aa, Glycine max
  misc_feature (16)..(16): Xaa can be any naturally occurring amino acid
  misc_feature (22)..(22): Xaa can be any naturally occurring amino acid
  misc_feature (31)..(31): Xaa can be any naturally occurring amino acid
  misc_feature (40)..(40): Xaa can be any naturally occurring amino acid
  misc_feature (54)..(54): Xaa can be any naturally occurring amino acid
  misc_feature (56)..(56): Xaa can be any naturally occurring amino acid
  misc_feature (61)..(61): Xaa can be any naturally occurring amino acid
  misc_feature (74)..(75): Xaa can be any naturally occurring amino acid
  misc_feature (78)..(78): Xaa can be any naturally occurring amino acid
  misc_feature (85)..(85): Xaa can be any naturally occurring amino acid
  misc_feature (87)..(88): Xaa can be any naturally occurring amino acid
  misc_feature (94)..(94): Xaa can be any naturally occurring amino acid
  misc_feature (96)..(98): Xaa can be any naturally occurring amino acid
  misc_feature (101)..(101): Xaa can be any naturally occurring amino acid
  misc_feature (103)..(103): Xaa can be any naturally occurring amino acid
  misc_feature (107)..(108): Xaa can be any naturally occurring amino acid
  misc_feature (110)..(110): Xaa can be any naturally occurring amino acid
  misc_feature (112)..(113): Xaa can be any naturally occurring amino acid
  misc_feature (115)..(115): Xaa can be any naturally occurring amino acid
  misc_feature (118)..(118): Xaa can be any naturally occurring amino acid
  misc_feature (124)..(125): Xaa can be any naturally occurring amino acid
  misc_feature (127)..(129): Xaa can be any naturally occurring amino acid
  misc_feature (131)..(131): Xaa can be any naturally occurring amino acid
  misc_feature (133)..(134): Xaa can be any naturally occurring amino acid
  misc_feature (139)..(139): Xaa can be any naturally occurring amino acid
  unsure (1)..(140): unsure at all Xaa locations
MEGSGSGVVTVYGNGXAITETXKSPFSVKVXLAQMLRGGXIMDVVDAEQARIAXEXGACAXMALERVPADIRGXXGVXRMSDPQXIXXIKRVVXTXXXMAXCXIGHXXKXQXXEXIGXTRGNKXXAXXXTXGXXHFNKXN

SEQ ID NO: 27152 - protein, 423 aa, Arabidopsis thaliana
  misc_feature (265)..(265): Xaa can be any naturally occurring amino acid
  misc_feature (276)..(276): Xaa can be any naturally occurring amino acid
  misc_feature (413)..(413): Xaa can be any naturally occurring amino acid
  unsure (1)..(423): unsure at all Xaa locations
MVSYRATTETISLALEANSSEAITILYQVLEDPSSSPEAIRIKEQAITNLCDRLTEEKRGEDLRKLLTKLRPFFSLIPKAKTAKIVRGIIDAVAKIPGTTDLQITLCKEMVEWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGILHAEEKDYKTGYSYFFEAFESFNALGDPRAVFSLKYMLLCKIMVSQADDVAXNNLLKGWTTVXVGPDLDAMKAVADAHSKRSLKLFENALRDYKAQLEDDPIVHRHLSSLYDTLLEQNLCRLIEPFSRVEIAHIAELIGLPLDHVEKKLSQMILDKKFAGTLDQGAGCLIIFEDPKADAIYSATLETIANMGKVVDSLYXPVCQNHVLRE

SEQ ID NO: 27153 - protein, 164 aa, Triticum aestivum
  misc_feature (52)..(52): Xaa can be any naturally occurring amino acid
  misc_feature (93)..(93): Xaa can be any naturally occurring amino acid
  misc_feature (102)..(102): Xaa can be any naturally occurring amino acid
  misc_feature (128)..(128): Xaa can be any naturally occurring amino acid
  unsure (1)..(164): unsure at all Xaa locations
MAPTVMASSATSVAPFQGLKSTAGLPVSRRSNGASLGSVSNGGRIRCMQVWXPIEGIKKFRDPVLPGHRSSTEALLQAGGTTWIRSKWVPCLXFNKVGFIFXVEHNASPWGTMNGRLLGQCWKLPMFXGATDATQVINEVEEVKEGYLTRTPHHRFDNMRQVHA

SEQ ID NO: 27154 - protein, 187 aa, Magnetospirillum magnetotacticum MS-1
MGGDIVPAFVEKGTAAVYDFIRNDVPGSTDRDRDYWRDVGTIDSYYDANKDLIAVTPVFNLYNEEWPLHTGYTGLPPAKFVHAGRGRLGHAADSIVSPGVIISGATAVGSVLSPGTYLHSWSSVSDSVLMDGVQVHRHAQVHRAIIDKNVVVGEQARIGLDPEQDRARGFTVTESGITVVPKGTVVE

SEQ ID NO: 27155 - protein, 779 aa, Burkholderia sp. 383
MTSRRKFLQQTATSGLAAAALSAFPPSIRRALAIPAFHETGTIKDVKHVVLLMMENRAFDSYFGTFKGVRGYGDRFAVPSPNGRNVFYQTYTKPAPATTVTPYHLDASQGNAQRAGGTPHTWADAQAAWDHGRMNRWPDAKTPLSMGYYDAAEVPFQRALADAFTLCDHYHCGMHTGTIANRLFYWSGTNGPNGISPADGSRVKIAALNNQFNGGNDIGPSSQGWTWTTYADRLQQAGVHWKVYQSLIDNFGCNEMMSFRHWRAAIEQMPPARRPAYVASTDITQPVTAAGAFYDPAIDDPLSPLAKGFGNTMPYGFLESFRDDIRNGTLPEVSWIIPPSVYSEHPGPSSPAQGGWYVQAVLDALTANPDVWSKTVLLINYDENDGFFDHLPSPAVPSRNADGTLAGGHTLRDADVAPEYHDFTPATSSQPAIDGRPYGPGPRVPMWVVSPWSRGGWVNSQVFDHTSTLLFLEKRFGVAEPQISAYRRAVCGDLTSAFNFRSPNNEPLPTLAGHTTKSQVDALSAAQQAAPKIVPPAAPSLPAQATGVRPSRALPYELHASARADAGNGTVTLKFANTGRAAAVFHVYDKLHLDRLPQRYVVEPGKTLHGDWAARADNGGKYDLWVLGPNGYHRRFTGDLGRLAGARAPHPEVRVGYAGASGNLHLKLRNHGGGTVRFTVKSNQVYGPLSGRGAHDDRGHGNEDGNSQGHGHGTGTTWTVTVRAGDQAELHWKLDSTGHWYDFIVTADSDASFSRRVAGRVETGRHSVSDPAMGLADRF

SEQ ID NO: 27156 - protein, 402 aa, Oryza sativa
MLAAVMDYFRSCWGPRSPAGHRVRGSDVAGRQDGLLWYKDAGQLVTGEFSMAVVQANNLLEDQSQVESGALSMAEPGPQGTFIGVYDGHGGPETARFINDHMFHHLRTRRGFATEHKCMSTDVIRKAFQATEEGFLSLVSKQWSLKPQIAAVGSCCLVGVICSGTLYVANLGDSRAVLGRFVKSTGEVVATQLSSEHNACYEEVRQELQASHPDDPQIVVLKHNVWRVKGLIQISRSIGDVYLKRPEYNREPLHSKFRLRETFKRPILSSEPAIAVHQIQPNDHFVIFASDGLWEHLSNQEAVDLVQNNPRNGIARRLVKVAMQEAAKKREMRYSDLKKIDRGVRRHFHDDITVIVVFLDSNAISKANWSRGPSVSLRGGGVTLPANSLAPFSTPTVLSSTY

SEQ ID NO: 27157 - protein, 364 aa, Medicago truncatula
MRRVCKNKLFSNKSLDASQYLRRGKIDELINYVSQCSLKGEAIDMGKLAFKTSINLLSNTVFSVDFANNKDLVMDMSETVGSPNMADFFPLLRLIDPQGIKRTYVFYVGKLFGIFDNIIDQKLKLREGDGFVTNNDMLDSLLAEENKKELDREKIQHLLHDLLVGGTDTTTYTLEWAMAELLHNPNVMSKVKKELEETIGIGNPIEESDVTRLPYLQAIIKETLRLHPIAPLLLPRKAKEDVEVNGYLIPKGAQIFVNVWAIGRDPKVWDNPNLFSPERFLGTKLDIKGQNFQLTPFGSGRRICPGLPLAMRMLHMMLGSLLISFDWKLENGMKPEEIDMEDAIQGLALRKCESLRVIPTKISN

SEQ ID NO: 27158 - protein, 377 aa, Fusobacterium nucleatum subsp. vincentii ATCC 49256
MRTLKFMKPEKQQSISKETLDIYAPLAHRLGMAKVKSELEDLAFSYLHHDEFLEIKKLVDNTKEERKDYIENFIRTMIRTLSELGIKAEVKGRFKHFYSIYKKMYQKGKEFDDIYDLMGVRVIVDDKATCYHVLGIVHSQYTPVPGRFKDYIAVPKSNNYQSIHTTIVGPLGKFIEIQIRTKDMDEIAEEGIAAHWNYKENKKSSKDDNIYGWLRHIIEFQNESDSTEDFIEGVTGDIDRGTVFTFSPKGDIIELPVGATALDFAFMVHTQVGCKCVGAKVNGRMVTIDHKLKSGDKVEIITSKNSKGPSIDWLDIVVTHGAKGKIRKFLKDENKETVTKIGKDNLEKEASKLGMTLKEMKMTLHLKNIWKKIIYLV

SEQ ID NO: 27159 - protein, 238 aa, Zea mays
MSQLAAETGALNLSQGFPDFNGPQALLDAVGKHIALGHNQYAPMTGLPVLRQQVAAKIARSYGATVNADSEVTITPGATEAIFCAIQAVIRTGDEVIVFDPSYDSYEPSVELAGGRCVHVQLSQNGFALDFERIKAALSPRTRMIILNTPHNPTGALISRAELDQLAELIRDRDIYLVSDEVYEHLVFDGVAHVSVLAHEELYQRAFVVSSFGKTYHVTGWKTGYVVAPPALTAELRK

SEQ ID NO: 27160 - protein, 170 aa, Fusobacterium nucleatum subsp. vincentii ATCC 49256
MDLKNYVATIENYPKEGILFRDITPLMNNGEAYKYATEKIVEFAKEHHIDIVVGPEARGFIFGCPVSYALGIGFAPVRKPGKLPREVIEYSYDLEYGSNKLCLHKDSIKPGQKVLVVDDLLATGGTVEATTKLVEELGGVVAGLAFLIELVDLKGRERLSKYPMITLMQF

SEQ ID NO: 27161 - protein, 352 aa, Pyrococcus horikoshii OT3
MNPMKVLILGAGNIGRAIAWDLKDEFDVYIGDVNNENLEKVKEFATPLKVDASNFDKLVEVMKEFELVIGALPGFLGFKSIKAAIKSKVDMVDVSFMPENPLELRDEAEKAQVTIVFDAGFAPGLSNILMGRIFQELDLKEGYIYVGGLPKDPKPPLYYKITWSPRDLIEEYTRPARVIRNGKVSKVDPLSEVKKVKIGKFEFEAFISDGLRSMLETINSERLEEWTLRWPGHLEKIKVLRELGFFKPENLDFTLRVIEPLMRYETKDFSIMKVVGKGEEGEMEFFLYDEEDSMFSSMSRVTGFTAAIISRIVAENTCTFGVIPPEILGMREDTFRRIIDELKERGISIEGT

SEQ ID NO: 27162 - protein, 293 aa, Thermus thermophilus HB8
MEKGTFQIKTGFAEMFKGGVIMDVTTPEQAVIAEEAGAVAVMALERVPADIRAQGGVARMSDPKIIKEIMAAVSIPVMAKVRIGHFVEAMILEAIGVDFIDESEVLTPADEEHHIDKWKFKVPFVCGARNLGEALRRIAEGAAMIRTKGEAGTGNVVEAVRHARTMWKEIRYVQSLREDELMAYAKEIGAPFELVKWVHDHGRLPVVNFAAGGIATPADAALMMHLGMDGVFVGSGIFKSGDPRKRARAIVRAVAHYNDPEVLAEVSEDLGEPMVGINLDQLKEEERLAKRGW

SEQ ID NO: 27163 - protein, 387 aa, Oryza sativa (japonica cultivar-group)
MLGAARRQLGSGPMLGQVLRRLRPATAAAADAARAYSAAAKEMTVREALNSALDEEMSADPSVFLMGEEVGEYQGAYKISKGLLDKYGPERVLDTPITEAGFTGIAVGAAYQGLRPVVEFMTFNFSMQAIDHIINSAAKSNYMSAGQISVPIVFRGPNGAAAGVGAQHSQCYAAWYAHVPGLKVLVPYSAEDARGLLKAAIRDPDPVVFLENELLYGESFPISAEVLDSSFALPIGKAKIEREGKDVTITAYSKMVGYALQAADILSKEGISAEVINLRSIRPLDRATINASVRKTNRLVTIEESFPQHGIGAEICMSVVEESFEYLDAPVERIAGADVPMPYAANLERMAVPQLSLEVLTIKKLVDDIVRAAKRACYRAVPMAATA

SEQ ID NO: 27164 - protein, 593 aa, Archaeoglobus fulgidus DSM 4304
MRVMEVPEFVKNRYWLERAWIEGVPADVEIPEKPLYEVIDEVCQKYADRTAIIFYGAEIKYGQLKEYTDRFATSLAKMGIKKGDVVAIYSPNCPQFVIAYYGAMKAGATVTALSPLFAPREVEYQLNDSGAKVLVTVEQLYPNFAAVRENTGVEEVLVANIAGGEAKVEGKFRDFREMLASPPEPPEVSWNVKDDVAVLQYTGGTTGLPKAAMLTHYNVVANMYELIPFTDLIRGWLKSHKVIREEGDYVIVDLDGKEYRTFRDYYYNDYSPRVAILPWYHIYGQTVDLNTGLATGDILVVFAQFEPEKILEAIERYRVATFMGAPAIFVFLANNPDLLKRYDLTSLLYVNNGAGPVPPEIIEKWDELLKDAGRGILVEGYGLSEASPVTHTTVGPPFRKRKIGSVGPPIPNTYAAIINPETMEFLPIGEEGELVIAGPQVMKGYWNRPRETEDVFFEAGGMKWLRTGDIAKMDEDGYFYIVDRLKDIIKYKGHSVYPREIEDIMYEHPAIKEVCVIGLPDEVAGETIKAFVVLHEDYRGKITEQDIINWCKERMAAYKYPRIVEFRDELPKSAAGKYLRRILREEELKKMKR

SEQ ID NO: 27165 - protein, 1274 aa, Candida albicans SC5314
MKEGASVLSISSENQVGVKVRNLTVSVKSQQQKTTKHTEDQEAQYEQGTSKILNNLSFDIECGQLVAIMGGSGSGKTTLLNTLSQRTNINNKNLGFSGSVTYETSSSNKHIKHAYLLQTDIFLPGLTVWETLSTQADLRLPSHVTKQEKIELIEYILDVLELSHLKNTYVASFSSNASTLSGGEQRRVSLAIQMLSKPAILFLDEPTTGLDTSSSLKLVHVLKKLASPEYGITIILSIHQPRPEIGQLFDKICLLTRGGRLVYFGNLANAEMYFNNLNFLGRDSDDHSKHILEYIMDLSVKDTTSVEKEQQTVERINKLVQTWSNNHQFQQQQEENRSSKESHQFKKNLTLFSKPKTDKISFWQEVNVLTKRTFKLTFRDYKRLLVFNVGIVIIGVTVGWMFYRPKHDLAGIRSLTSTLYVAMEIMGFVPMYFEIERLWETDGVFFYREYSENQVSIPGFLISRRLGKLFLEDLPMSLLFSIITFFMWGLRLGDGSHFGIYFVVVFLIELCCMGTAMFSFAIAPSYPISALLINLIYQIQNSACGYFVNAATMPVYVKWTKYLAYFWYAFGALTNNQFSGWHGKCPYNDINDPRCQEFSGDYQIKILGFPVGWVGAPIGYLVLWTVGFFVLSGILFYFKQHDVSMAKTKKNTIGEGEEDHEALHQKKTEREQDYITDKHDLEININNIHLDVTTSNLFGQTKSTKTLLDNVTASFQANKVNVIMGPSGSGKTTLLNYLSNRLSRNSKFIASGSIRLNGIQKISRDQLSKISAYVTQHDSSLIEQLTVRETLYYQAKLRLPLDQHKFIPTIINKLIRQTGLVDCADTLIGSEYVKGISGGEKRRVSIAIQLLSKPKVLFLDEPTSGLDSSTAETILTLLGELAKENNTTIILTIHQPSEQLFYKFGSLLLLGRGGKVIYDGTSVGIVEYLESLGYNNPEGHNIADYILDLISRGMNEDKMQSERRVAELISYWQANSIKKLCSTATFSQEIIDLPQYYYQRLPIFITFPAIFRRQLLTSYRAKDVVINRAGQTIFLAIVHTLYFTPLRNTQEGISNRLGLVQEVLNLYFAGLINNITLYPFERNLFYQEYRDGIYGVTEFGLSYLINELPTEVIPCFFFAALIVFACGLPRTPQMFFAMFGTGFVSINCGESLGIFVNSIFTHMGVATNVLSTFVSLAIFMGGTMSLHMPGFFKGINFISPMKYAVAICANLGFKNQSFKCNSEAADCLLTTGEDVLSYYNMKQNLGPMVGGLIGCLVIYRVVAILSIYVRVKWF

SEQ ID NO: 27166 - protein, 476 aa, Sphingomonas paucimobilis
MTAYPSLHMIIDGEAVTGGDRRTQTIVNPATGETLGELPLADTADLDRALETAQRGFQRWRNSTPQERAAVLSGAARLLMERQETLARIATMEQGKTLAESRIEVMMVAGLFNFYAGEVFRLYGRALVRPAGTRSTVTYEPVGPLAAFSPWNFPLGNPGRKLGAPIAAGCSVIMKSAEETPASALGVLQCLLDAGLPSDVAQAVFGVPDEVSRYLLASPVIRKLSFTGSTVVGKHLAKLAADDLKRTTMELGGHGPVLVFNDVDVDRVLEVMVGHKYRNAGQVCVSPTRFIVQEDVYETFRDGFAERAKALRVGNGLEDGIQMGPMANARRPDAMERLNRSAVDAGATLNAGGERIGNQGFFYAPSVLSDVPLDAEIMNEEPFGPVALINPYRTADEMIAEANRLPYGLAAYSWTNDVKMQRRIAREVETGMLGINSVAIGGADSPFGGVKWSGHGHEDGPEGVQACLVTKAVHEG

SEQ ID NO: 27167 - protein, 444 aa, Leptospira interrogans serovar Lai str. 56601
MELIGFFIIVLLIFANGFFVSAEFALVSIRPSRLEELIKENKPLAFITKRAAQKLNDMLSVCQVGITIASLLLGWVGEGYVSRWLIFLLEMFGYSANEATVHGLAITISFTIITFLHILLGELLPKTVAIQNTETIALFISIPLFFFYYLFYPITFFLNEMTSFLLKLIGIEANKSRMMHSPEELMIIIEEQNKQGKIDQEEFQIIQNTFQFSEHQAKDVMTHRLSIIGIPHDTSMDSLISIIAEHHFSRYPIYEGSTDKIIGIIHVQTYLTWLSNSKKGRKEKVTAIMQPPIFVPEGLSIEKVMQKLRENKQHMAIVIDEYGGVAGLLTLEDIIEEIFGQIRDETDDHETDPFPTQHSDSFTIDGEAELDDLKEILVGVQEEEIKDIRTIAGFILGRLEDMPEEGSTISLQTGTLTVEKMEGNKILSVRFTRVSLNNRAQSKK

SEQ ID NO: 27168 - protein, 221 aa, Zea mays
MSAPPPPASSDDDGKPADEEGVEIREVWANNLEAEFAVIRDIVDDYPYIAMDTEFPGIVCRPLGSFRSNDEYNYATLKANVDMLSLIQLGLTLSDENGALPARGTGGRPCTWQFNFRGFDPRSDPANADSIDLLRNSGIDFDRFTTEGADTGHFAELLMSSGVLLNAELQWVTFHSGYDFGYLLKLLTGRNLPDTMPGFFDLIRIYFPVLYDIKHLMKYCG

SEQ ID NO: 27169 - protein, 730 aa, Gibberella zeae PH-1
MATLSAPRTMLASHQLDSATAMATDKSTSPSPLRANQFQTSFSPRDISTDLTESIVLEEGGESGSETLEPVTPVSGRHSQDFTLESQDLQDLQSLQSYPAGSVTSSGVGPIAIPGANAGNNNKGGYLSQSASRPPTTPTTPRASEPEPGTSLTRQSTRGSISTASFKRTMSSFFRRSNSQARNDYTPSEPPTPSVVSAPTEPQTNGQPRAAARRRFSMNRSSATTRSNSPPSPSDNGLEMNLPHRERGVDKSLPSQGDFKKHRASTGFTLRNRINFVGANPNGRGNGNKRPEYNRRASSYDGSRPSTPLPPPVEGDETMYPPERSVWPLPPESGTGAKARRMSLSLPDDFAVDVAELQNEFEYQRKFLGRHGKHLGKGAASKVTLMMRKGYPEELYAVKEFRGKSHRESQQDYENKIKSEFSIGKSLHHPNIVETFRLCTDHGRWNHVMEYCSEGDLFSLVQKGHLKGDDRKKDRMCLFKQLIQGVYYLHVNGIAHRDIKLENLLITKDSKLKITDFGVSEVFCGTHPGLREAGGQCGRNMGGEIRLCSPGICGSEPYIAPEVLAKKESYDPRALDVWSSAIVMIYLTFGGAIWSRAEPGELHYDKLVTGWNKWYAKHPENDASISDSDYPKCYALDVGMSPPALRRLVLQMLNPEPSKRISIDEVINNRWLKNVECCQLESYDDPALLIDATKKDNSIQGNKKIFCHNHLPPKGTGSHSLGKMPGQAGY

SEQ ID NO: 27170 - protein, 525 aa, Chromobacterium violaceum ATCC 12472
MDKILILDFGSQVTQLIARRVREAHVYCELHSFDMPIEEIQAFAPKAIILSGGPNSVYESDYQADPKLFELGVPVLGICYGMQFMAQTLGGKVESGDKREFGYAQIKARHHSKLLEGLQDQIDDAGNGFLDVWMSHGDKVTQLPAGFQVIAETPSCPYAAMADEARGFYGVQFHPEVTHTKRGTEMIHRFVLHVAGCKPSWTMPNYIDEAVKKIREQVGDEEVILGLSGGVDSSVAAALIHRAIGDQLTCVFVDHGLLRLNEGKMVMEMFAQNLGVKVVHVQAEADFMAKLAGETDPEKKRKIIGAEFIEVFDRESGKLTNAKWLAQGTIYPDVIESAGAKTKKAHTIKSHHNVGGLPEDMNLKLLEPLRELFKDEVRQLGVALGLPHDMVYRHPFPGPGLGVRILGEVKKEYADLLRQADAIFIEELRNTVDEKTGKNWYELTSQAFAVFLPVKSVGVMGDGRTYDYVVALRAVVTSDFMTAHWAELPYSLLGRASNRIINEVRGINRVVYDVSGKPPATIEWE

SEQ ID NO: 27171 - protein, 331 aa, Pseudomonas aeruginosa PAO1
MNNDNKRSAGGLGLVGDIGGTNARFALWRGQRLESIEVLACADYPRPELAVRDYLARIGESVANIDSVCLACAGPVGAADFRFTNNHWVINRAAFREELGLDHLLLVNDFSTMAWAASRLGADELVQVRAGSAQADRARLIIGPGTGLGVGSLLPLGGGRWEVLPCEGGHVDLPVTSPRDFALWQGLQARYGHVSAERALSGNGLLALYEISCALDGVAVRASSAAEVGALAMAGDAQADAVLEHFFLWLARVAGNAVLTVGALGGVYITGGIVPRFLERFIASGFAEAFASRGKTSGAYLQDVPVWVMTAEHPGLLGAGVALQQALDAEG

SEQ ID NO: 27172 - protein, 467 aa, Micromonospora echinospora
MTRPADPSAERRTMVPSKFIFGLSPVGSAALRAAPPSRRPPLAPGGSGLGVRAVVIGSVATASLAAGLAAAAGTALRHGRPAGRRRFAREVARTVARLGPTFIKAAQVLGTRRDVVPALLCDELSMLQDDVPPMDAAQSRAALREVYGDRLDTVFASVEETPVASGSIACVYRATLPDGATVAVKLRRPGIGPQMAADLGLLRRGASVVARLPMFRGVPVREVVDSLCESVLGQLDLGREGRDLDRLREDLGGVPRVRVPRVHAAASRPAAIVMDFIPDLAVDTGARCPRAMRRTFAASTLTVVYQMLFINGFVHCDLHPGNLYFTRSGQVVVLDAGFSVQLSDKMRGLFADFFLNMSIGRGDRCAAIVLESAIGVADDADVPAFTEGVKDLVARSYRLSAKEFSLIAFAGELFDLQRRYGVAASPELVFPLLSLLVVEGTVRSLDPDIDFQETAKPVLNRALFGIR

SEQ ID NO: 27173 - protein, 256 aa, Chromobacterium violaceum ATCC 12472
MELGSVATFSLYPDLYARFRPSYPEELYDWLLPLCPGRQRAWDCATGSGQTAVRLGESFSRVDATDISSSQLSAAEPHTQVYYRECPAEVTPFDDDCFDLICVSQALHWFHLPSFWPEMQRVLKPGGIFAAWGYHHCVVSPEVDRACSVLWSIIEPFWSSRCQLLWDDFRGSGCPLPLLKAPSFTISSDWALDHFLGFLNTTSASKLCKQALGESILDDACQRITRAWGPRNQVRRVDLPLHLMVARKDDAGGYAG

SEQ ID NO: 27174 - protein, 379 aa, Cryptococcus neoformans var. neoformans JEC21
MISRPELTLLEQLEATGVKIDTDSMDPKVAANLPIKAHDMTSNQLLTDEQLKNPENKELVEKTIRELKGANWFDVQTVLTARFAKRVIPYIQGRVLAQTTPTKAFDKDAIISHARAYDKAFQAEGISRDRYCVKVPATTAGVQAAKILNEEGIRTLGTSLFSLAQAIACSQAGMLSISPYYNEVRAHVDSSLWPDVADPATQHPMSFRVRHIRETYDRLAKETGKVQPLIKGASYITAREVMAMPELGVEHVTLLVGPMEDLCSTSRLPEYRKGGEWQVRVRSELDKPNVKWATWSAPEPSASKKRMAEMAKSDPYSDLMQKHWKMASTDVDYLADGVLDKYNEEDEVTKVRLRDALELFKGGEAESKVEIERLQKLYA

SEQ ID NO: 27175 - protein, 344 aa, Glycine max
MAGSNELNPNDSKMVVPLNMWVLISNFKLAYNLLRRPDGTFNRDLAEFLDRKVPANANPVDRVFSFDVVVDRETNLLTRIYRPTEGEERSVNILDLEKPVSSEVVPVIIFFHGGSFAHSSANSAIYDTLCRRLVGICKAVVVSVNYRRAPENRYPCAYDDGWTALKWVSSRSWLQSKKDKKVHIYLAGDSSGGNIVHHVALKAVESGIEVFGNILLNPLFGGQERTESEKRLDGRYFVRVKDRDWYWRAFLPEGEDRDHHACNPFGPKGKSLEGITFPKSLVVVAGLDLVQDWQLGYAKGLEKAGQEVKLIFLEQATIGFYLLPNNEHFSPVMDEIKYFVSSDC

SEQ ID NO: 27176 - protein, 489 aa, Candida albicans SC5314
MSIRLYSKQSLNTFKKATFIPLTTTATAITTTQFRYFHDTPNKQNVTVNNMMPRVTKPTPTNTFTTSPQLPSTEYLKAFNNKELISFFMIGLATLNKPILQLCIKLFPYVPMSIIKALVYRIYCGGETIDQVKKTGLRLHERGINNMMISLTIEACDGNDNVDPKYIVEETAKSIETILVPHTVAMIEQATDDINDIPPGYVALKPTGFAKDAANVLKNYNTTMIKEFDELVDKAIIVCQKIYDSNKELSQKYPERVSPFVVGVIDAEKHELQEGVYELQRRLYQKFNKLNQPISIVGTLQMYLSDSANLLTKEENLANENNYRLGLKLVRGAYIHSEKNRDIVIHKTKQDTDNNYNSGISYCIDSILNQNQNQNGSTIGHLVVASHNAESMRLASDKVYNPMNESNKNKTNVVLGQLLGMADNVTYDLITNNKIGNVIKYVPWGPPLETKEYLLRRLEENGDAVKNDNGWPLVKASFKMLTKRLFGSG

SEQ ID NO: 27177 - protein, 724 aa, Oryza sativa (indica cultivar-group)
MAGAVLVAIAASIGNLLQGWDNATIAGAVLYIKKEFNLQSEPLIEGLIVAMSLIGATIITTFSGAVADSFGRRPMLIASAVLYFVSGLVMLWAPNVYVLLLARLIDGFGIGLAVTLVPLYISETAPTDIRGLLNTLPQFSGSGGMFLSYCMVFGMSLMPQPDWRIMLGVLSIPSLIYFALTIFYLPESPRWLVSKGRMAEAKRVLQGLRGREDVSVSHVELTVQEKWPFSLKGWLQIQRRSTVCPEEGLSWVARPVHGQSALGSALGLISRHGSMVSQGKPLVDPVVTLFGSVHEKMPEIMGSMRSTLFPNFGSMFSVAEQQQAKGDWDAESQREGEDYGSDHGGDDIEDSLQSPLISRQATSVEGKEIAAPHGSIMGAVGRSSSLMQGGEAVSSMGIGGGWQLAWKWTEREGADGEKEGGFQRIYLHEEGVTGDRRGSILSLPGGDVPPGGEFVQAAALVSQPALYSKELMEQRLAGPAMVHPSQAVAKGPKWADLFEPGVKHALFVGIGIQILQQFAGINGVLYYTPQILEQAGVGVLLANIGLSSSSASILISGLTTLLMLPSIGIAMRLMDMSGRRFLLLATIPILIVALAILILVNILDVGTMVHASLSTVSVILYFCFFVMGFGPIPNILCAEIFPTTVRGICIAICALTFWIGDIIVTYTLPVMLNAIGLAGVFGIYAVVCILAFLFVFMKVPETKGMPLEVITEFFSVGAKQAKED

SEQ ID NO: 27178 - protein, 361 aa, Pyrococcus horikoshii OT3
MQAVLLAGGKGTRLLPLTVYRPKPMIPFFNKPLMEYMLMNLIGIGVEEIIVLVGYLKEKIIEYFGRGDKFGVEIKYSNGENIKLGTAGALKKAEKFIDDTFIVASSDVLTNLSFDSFIRFHREKGGIATMALTKVEDPTPYGVAVLDNENRILYFKEKPKREEAPSNLVNAGIYIFEPEILDLIPRGKAFDFSLDLFPKMLEEGIPIYGFPFDEYWNDVGRPSTYLQATEDVFLGKLRLPQINVGRDKGNIERGGSLFTGSKCLIRNPKIVGFAVLGNNVKVGRDVKIERSVIFSNVTIEDEVEIREAIIGENVYIGRGAVIEPGSVIGDNSVIEEYSKIGANVKIWTDSKVGRESIVLPD

SEQ ID NO: 27179 - protein, 639 aa, Rhodopirellula baltica SH 1
MCGITGFWNPSRTNERELRFALDPMLDVLDHRGPDERGSRFFQERGLAMGHTRLSIIGLACGHQPIETDDGDYAVTVNGELYDYKRIRTALACENYECNGKSDSAITLPLYLKHDLAMVDHLRGEFAVVLYDDRKERLVLIRDRFGVKPLYYAVNDNGFIWGSEVKSILQHPDVEPRLCPKAAVHQMMQVMVPGSTAFEGVDALLPGHMLVVQRNGDSLEVQTKRWWDFEFPESHDENADPEPFIQGVQDRLIDAVAARLEADVPVGCYLSGGIDSCSILGLANTLQQSPVKAFTIAFDSDEYDESNIAKRMAERTGAEQELLRLTEKELYGPAFERATWHAERTFYNTLAVAKWHMSRRVRACNYKAVITGEGSDELFGGYPFFKRDWLGRDDEGGIFAGAILAEEDLKHSAWQDLCGFTPSWIQPWMLVLKRFEPILSSSLTDLLQEYDPVGEVAGAIDPAQVRGRHRLDVSQYTWSKTMLEGQILTWGGDRMDMANSMEARPAFLDHHVAEYATTIPPNIRIRNGVEKWVLREAMVNVLPRELYERKKFAFMAPPAHTDPVKRAAVQEMIDHWLTPSRVESVGFFQHDKLMQFIDDAWKESDGTIARRNDIVMNHVLQLHMLHGQYVEGLPLPAVD

SEQ ID NO: 27180 - protein, 334 aa, Pseudomonas aeruginosa PAO1
MTIRLAINGFGRIGRNVLRALYTGHYREQLQVVAINDLGDAAVNAHLFQYDSVHGHFPGEVEHDAESLRVMGDRIAVSAIRNPAELPWKSLGVDIVLECTGLFTSRDKAAAHLQAGAGKVLISAPGKDVEATVVYGVNHEVLRASHRIVSNASCTTNCLAPVAQVLHRELGIEHGLMTTIHAYTNDQNLSDVYHPDLYRARSATQSMIPTKTGAAEAVGLVLPELAGKLTGLAVRVPVINVSLVDLTVQVARDTSVDEVNRLLREASEGSPVLGYNTQPLVSVDFNHDPRSSIFDANHTKVSGRLVKAMAWYDNEWGFSNRMLDSALALAAARD

SEQ ID NO: 27181 - protein, 465 aa, Phaseolus vulgaris
  misc_feature (242)..(242): Xaa can be any naturally occurring amino acid
  unsure (1)..(465): unsure at all Xaa locations
MDLSAILLLGARGLFFFLFRRLIKSFRSFGSHFPLLPGTMVCPYFGETFQMYSQDPNVFFATKIKRYGSMFKSHILGYPCVMISNPEAAKFVLHKAQLFKPTFPASKQRMLGTQAIFFHQGAYHATLRKLVLRSFTTEAIKNVVSDIESIAQTCLKSWEGKFITTFLEMKTYTFNVALLSIFGKDETLNAEDLKRCYYTLERGYNSMPINLPGTLFHKAMKARKELAEILAQKISTRRKMKXRTHDLMGSFMNEKAGFTDEQIICYIIGCIFAARDTTASVLTWMVWYLGRNPSVLETATEEEKCILETKGGSGEDQGQKPNDTDKMPLSSRVFQYTKQFFSIPCLWFCVAVVDIISSGYLIPKGWKVLPLFRNIHHSPDNFKEPEKFDPSRFEVAPKPNTFMPFGNGVHSCPGNVLAKLEIFVLLHHITTKFWCSIMGANNGIQYGPFSLPQNGLPSTLYLKKQ

SEQ ID NO: 27182 - protein, 485 aa, Phaseolus vulgaris
MAELVLFVSVPAAVLAFGVPAFFKVCTSEYRWRDVGLHGGRDWRKKTKLRFPPGSMGWPYFGETLQLYSQDPNVYFSTKHKRFGEIFKTNILGCPCVMLISPEAARFVLVTQAHLFKPTYPKSKERLIGPFALFFHQGDYHTRLRKLVQRSLSFEALRNLVPHVEALVLSGMNSWGDGQVINMFKEMKRISFEVGILTTFGHLEPRSREELKKNYRIVDAGYNSFPTCIPGTQYKKALLARKRLGKIISDIICERKEKKLVERDLLSCLLNWKGEGGEVLSDDQIADNIIGVLFAAQDTTASAMTWVVKYLHDEPKLLESVKAEQKAIHKSNEGNIPLSWDQTRNMRITHKVVLESLRMASIISFPFREAIADVEYKGFLIPKGWKAMPFGNGVHHACPGNEPQKCNPSRFYVAPKANTFMPFGSGGHACPGYELAKLEMLIMTHHLVTKFRWEAEGSNSGIQYGPFPVPVRGLPARFRKESTNF

SEQ ID NO: 27183 - protein, 276 aa, Candida albicans SC5314
MYRNWLYFGRDSIDNLLNNYSFLLPRIRKTRQLKLNMDSKSTCVSIGKFPFDYTEEQVRDIARSVGPVLDVKLLFDELTGKSKGYAIINYGDNETASSAVRNLNYMTLPNGRFLKCSFVTDYDMSSKESVKLPPLPLGIQIHPNQNASQVISTILSNIDSNSALQILKEIKVMSIDNPKSTKVLLERFPQLSLALVELGLLSNTTNQELIELTLNKRPVDLTELSLDHVRLLQSVEKLTDEEIDELDESQQEIVRKVKEEIAKGTYGEVSAVKDNA

SEQ ID NO: 27184 - protein, 459 aa, Glycine max
MASEEAECISNLFKPIYLKEVAELRQYVPNLQSRPNPLDHNPYFDTRQLQQQQGFYLTESDVLLRQIGNDLSPSPRFAYHRAGPRKNIYFDPSIVRVAIVTCGGLCPGLNTVIRELVVGLWQLYGVRHIFGITAGYRGFYSSVPLPLNPKLVHHWHNVGGTLLQTSRGGFDLHNIVDAIQTHAFNQVYIIGGDGTMRGAVKIFDEIKHRKLEVAVVGIPKTVDNDVGIIDRSFGFQTAVEMAQEAISAAHVEAESAVNGIGLVKLMGRSTGHIALHATLSSRDVDCCLIPEIDFFLEGKGGLLEFLGQRLKENGHAVLVVAEGAGQDIIPRTDSQKDERDESGNPVFLDVGVWLKSELNKWWKREHPNELFTVKYIDPTYMIRAVHANATDNLYCTLLAHSAIHGVMAGYTGFVAGPINGNYAYIPLEDVARANNPVDTQDHKWSWVRSVTNQPDFVRR

SEQ ID NO: 27185 - protein, 548 aa, Chromobacterium violaceum ATCC 12472
MTNNVKNEAVLDSAHVGDIRGAFGTIRHGDVAARNGLWQRLRTLLAILGPGLIVMVGDNDAGAFSTYAQAGQNYGTSLLWTLILLIPVLYVNQEMVLRLGAVTGVGHARLILERFGKFWGAFSAIDLFLLNALTIVTEFIGITLGLQYLGLPKAWGVIAAAGLVMAAAGTGDFRRFERFSLILVVFSLLLVPVFMMVHPPMSQIGHDLFVPGMPAGGKLSDVMLLIIGIVGTTVAPWQLFFQQSYVIDKRITPRFIKYERADLWLGIVLVLIGAVAIIGMAAALFAGKPEFGNFQDAGAVAAGLGKYHSHLAGVLFAVALIDASLIGASAVSLSTAYALADVLNMKHSLHRKPSDARAFYLVYFLLIAGAASLVLIPGVPLGLLTNAVQTLAGVLLPSASVFLLLLCNDKDVLGPWVNGRWTNLFTGLVAAVLVLLSVILTASVLWPDISSQTIVNVLVGGGIVGGIVVIAAHVVKLRRDAETGADLQEEAKPSKLYMQTWRMPPLAQLKPMALSRSNRMWMAVLRGYLVVAVIMVVYKVTQVALLGQ

SEQ ID NO: 27186 - protein, 195 aa, Azotobacter vinelandii
YRDNGIDLRLGCKVVDIDRENREVTRSDGSHAQYDRLLVATGSSPFILPIPGKDLQGVIGYRDIADTRAMMETARSHRHALVIGGGLLGLEAANGLRLRGMEVTVVHLGDWLLDRQLDRTAGKLLQNAGGTRASRFRLNTNTAPCSTMPGRVASAHFSDGEECPADLVVMRAGIRPNVELAERAGLECDRGIRVD

SEQ ID NO: 27187 - protein, 390 aa, Burkholderia sp. 383
MSETKDAAAPAAAGAFKPKKSVALSGVTAGNTALCTVGKTGNDLHYRGYDILDVAESCEFEEIAHLLVHGTLPNLTELAAYKNKLRALRGLPNALKAALEQIPASAHPMDVMRTGVSVLGTVLPEKDDHNLPGARDIADRLMASLGSMLLYWYHFSHNGKRIETETDDDSIGGHFLHLLHGKTPSKSWVEAMHTSLILYAEHEFNASTFTGRVIAGTGSDIYSAITGAIGALRGPKHGGANEVAYEIQSRYSSPDDAEADIRRRVENKEVVIGFGHPVYTISDPRNKVIKGVAHKLSKEAGDLKLYNIAERLESVMWDAKKMFPNLDWFSAVSYHMMGVPTAMFTPLFVISRTSGWSAHIMEQRIDNKIIRPSANYTGPEDLQFVPIEKR

SEQ ID NO: 27188 - protein, 381 aa, Micromonospora echinospora
MSGMRFDTRLVHGGRRPSAGTGDVVPPIHVSTTYERRAQDEPRYFYGRGENPTREELEECLAGLERAPFATVFSSGQAAAATLLSLVRPGQCVVSTDDVYAGTDGLFDLAARQGVRVRYADLTTPEGIAAALAEPDLALVWIETPTNPLLTVVDVAEVSRRAHERGARVVVDNTFASPVLQQPLALGADVSLYSTTKSIAGHADVLGGALVYRDADLHAAVRAYRTTAGNVPGALDCFLVRRGLHTLSLRVHRQVATARVLVERLRASPVVGAVHYPGLPEHPQHAVVKAQMSAPGAIVSFDYLGGPAERLLDRFTLFTCGVSLGGVHSLVECPALMTHRPLSAEARARRGIGESLIRLSVGIEDPQDLAEDLSRALAGGT

SEQ ID NO: 27189 - protein, 312 aa, Burkholderia sp. 383
MDTLHLVDREIRPLLVAWPTVTLSADTLAQSRERVLPLPPPDLAGSTLERRAVPGPAGAPDVPVLVYRPDAGVRPLPAIVHMHGGGYVRGAAKDLEAVHRSVVTELGCALISIDYRLAPETVFPGAIEDCYAALAWVFRQADALGIDPARIGVAGESAGGGLAAALALLARDRGEYRLAFQHLIYPMLDDRTCTRAPHPHAGEFVWHAANNRFGWSALLGHAPGLDGVSPYAAAARATQLEGLPPAFLSVGSLDLFLDENLDYAQRLLRAGVPTELHVLPGGVHGFDIVPGARVAETARRLSHDALRRFLHG

SEQ ID NO: 27190 - protein, 546 aa, Glycine max
MAPSPQEIIFRSPLPDIPIPTHLPLYSYCFQNLSQFHDRPCLIDGDTGETLTYADVDLAARRIASGLHKIGIRQGDVIMLVLRNCPQFALAFLGATHRGAVVTTANPFYTPAELAKQATATKTRLVITQSAYVEKIKSFADSSSDVMVMCIDDDFSYENDGVLHFSTLSNADETEAPAVKINPDELVALPFSSGTSGLPKGVMLSHKNLVTTIAQLVDGENPHQYTHSEDVLLCVLPMFHIYALNSILLCGIRSGAAVLILQKFEITTLLELIEKYKVTVASFVPPIVLALVKSGETHRYDLSSIRAVVTGAAPLGGELQEAVKARLPHATFGQGYGMTEAGPLAISMAFAKVPSKIKPGACGTVVRNAEMKIVDTETGDSLPRNKHGEICIRGTKVMKGYLNDPEATERTVDKEGWLHTGDIGFIDDDDELFIVDRLKELIKYKGFQVAPAELEALLIAHPNISDAAVVGMKDEAAGEIPVAFVVRSNGSEIAEDEIKKYISQQVVFYKRIGRVFFTDSIPKAPSGKILRKVLTARLNEGLVVAN

SEQ ID NO: 27191 - protein, 432 aa, Triticum aestivum
  misc_feature (56)..(56): Xaa can be any naturally occurring amino acid
  unsure (1)..(432): unsure at all Xaa locations
MLCTRSANFIRTGRASAIAEALDNNTASRTAEADRLHTMLLAMADARAVLIKLADXMRTLEALPLVKQQRFAKETMEIFVPLANRLGIASWKDQLENLCFKHLNPEEHTKLSSKFAETFDEALITSAVDTLDEGLREAGISYHNLSGRNKNLYSVYSKMQKKNLTMDEVHDIHGLRLVVDKEEDCYRALDVVHKLWPQVTGRFKDYISRPKLNGYRSLHTVVMSDGDHTFEVQIRTKEMHLQAEYGFAAHWRYKEGSCRHSFVLQMVEWARWVLTWQCEALNKEHSSSQVKSDSIKPPCPFPLHSEECPYSYTRQCNHDGPLFVILLEHDKMSVQEFPAGSTVMDLMHRVGANSPRWSPYSIPMKEDLRPKVNHEPISDLGRALSMGDVVELTPALPDKSLTEYREEIQRMYDRGGFALAATRSGSGGSRRR

SEQ ID NO: 27192 - protein, 73 aa, Glycine max
LCFYTTQEQLKKLFSPFGLVTQADLALDPITKRPKGFGFVSFKSEIEAEKALRAMNGRIVSGRLILVELANEK

SEQ ID NO: 27193 - protein, 179 aa, Glycine max
  misc_feature (25)..(25): Xaa can be any naturally occurring amino acid
  unsure (1)..(179): unsure at all Xaa locations
PDICKDTSSVWTCPSDTVFYDASVXWGLIGPRRIFGDLGTYEKVNWFFLGGAIAPLLVWLAARSFPQQEWIRLINMPVLIGATGMMPPATAVNYTSWIIAGFLSGFVVFRYKPEWWKRHNYVLSGALDAGLAFMGVLLYLCLGLEDISLNWWGNDLDGCTLAHCPTAKVVEVQGCAVFT

SEQ ID NO: 27194 - protein, 392 aa, Oryza sativa (japonica cultivar-group)
MAGKENAAAAQPRLTRAAAKRAAAVTAVAVAAKRKRFALSELPTLSNNKAVVLKPQPAPRGGKRAASHAAEPKKPAPPPAPAVVVVVDDDEEGEGDPQLCAPYASDINSYLRSMEVQAKRRPAADYIETVQVDVTANMRGILVDWLVEVAEEYKLVSDTLYLTVSYIDRFLSAKSINRQKLQLLGVSAMLIASFTHQFKNRYLLRIGLVDPGKYEEISPPNVEDFGYITDNTYMKQEVVKMERDILNVLKFEMGNPTTKTFLRMFIRSSQEDDKYPSLPLEFMCSYLAELSLLEYGCVRLLPSVVAASVVFVARLTLDSDTNPWSKKLQEVTGYRASELKDCITCIHDLQLNRKGSSLMAIRDKYKQHRFKGVSTLLPPVEIPASYFEDLNE

SEQ ID NO: 27195 - protein, 486 aa, Pseudomonas syringae pv. phaseolicola 1448A
MTSQSLNSHRVDPDTAQKFYIDGRWSAPLNPASIAVINPATEEVVAHVASGSAADVDRAVAAARAAFASWSGTSVHARAEIIGRIHELILERKEQLAQAISLEMGAAINSARAMQVPLAAEHVRVARDLLATYRFKSVESGTAIEREPIGVCGLITPWNWPLYQITAKVAPAIAAGCTVVLKPSELSPLSALLFAQLVHDAGLPPGVFNLVNGSGPEVGGAMAAHPDIDMISITGSNRAGALVAQAAAPTVKRVTQELGGKSPNILLPDADFAKAVPPGVMAAFRNVGQSCSAPTRMIVPRNRLAEVEALAAETAKAIIVGDPQREETVLGPIANEAQFHRVQAMIDAGLSEGAKLVCGGPGRVQGHEQGFYTRPTVFSEVDSSMRIAREEIFGPVLCLIAYDTVDEAVAIANDTVYGLGAHVQGQDLEQARSVASRIRAGQVHLNYPAWNPMAPFGGYKRSGNGREYGVHGFEEYLETKAIVGFG

SEQ ID NO: 27196 - protein, 134 aa, Aspergillus niger
DTAGQEDYDRLRPLSYPQTDVFLVCFSVTSPASFENVREKWFPEVHHHCPGVPCLIVGTQTDLRDDPAVREKLARQKMQPIRKEDGDRMAKELGAVKYVECSALTQYKLKDVFDEAIVAALEPAPKKSKKCVLL

SEQ ID NO: 27197 - protein, 418 aa, Oryza sativa (japonica cultivar-group)
MHGCALHPAAYRRIFHNPRSTRSHGLVAAASPPLHQPAAACGETHRIIQMHALFAVARDTAFSSSPAADEHLPNEHPGGHLWNQSVLSREEEHGSNDDSFRESLVSLLDNTRDYVMAPEVFEGVPVACDYLKGMDSDGMAASAVAAYSLDNNGQHASVSSIEHGIASSPLLAYQLGKNSAVVQRSIQQQEVGSPMAAFLQQLIPTSVLDQSGIGFGGVCLDGSALEASFCMRTSPDVSSFSGHRSATAEELMSTDTREQEITRLARSCSSSGSDRNKKKLSEVRGGGKAKKFKSETSHSTSSPKHQSPKVKLGEKITALQQIVSPFGKTDTASVLLETITYIKFLHEQIQLFSQPYMTNSTNKGHIHWGGEGKRKAGLEHDLRGRGLCLVPVSWTSQEYCDSILPECWAPAYRNYFYR

SEQ ID NO: 27198 - protein, 277 aa, Oryza sativa (japonica cultivar-group)
MNSRRSRSVKLVSTRAKPLEVEIAKEDERMSSSADNTVYCCIAKGRKIIYCYNSKDGDPHMETTAALCLENAPSYHRHYIHTAGSRSYGYLMADGHTFFAIIDPSVGNVGALQFLERVREVFRTVNRSGFHDSLVPAVQRLVASLEKMPHATFDLEESVEKGEPSDSSSCTSSKVPLLGRSGSRKDKKKAKEKAASAAVCEDEQHGTRGVRIDVPPEEVGGMSLERSASQSRLRRQHSSRSLWVRHVKIIIVVDAIICILLFAAWLAVCKGFQCVSS

SEQ ID NO: 27199 - protein, 194 aa, marine gamma proteobacterium HTCC2207
MNKTALIPIAEGSEEIELVTIVDVLRRAGVEVTVASANSGEKLQICASRGTHIVADAMLDDCANKHYDLIAVPGGLPGSEHLAKHAVLDVLLRDQAAQDKLFAGICAAPALVLATKGLLLDKAVTCHPSFQKSLEAKEVDGAARVVVDGNCITSQGPGTALDFALELVEQLCGIVKREEVGAPMVLTTTPTAYY

SEQ ID NO: 27200 - protein, 509 aa, Candida albicans SC5314
MITKRLYSTIESSKKVLGTLSNPNLVKTEAYINGKWVPSSSGETFTVTNPALYPNPESELATMQSMSEEDFNSAIESADIAFNKFKKTTGRYRSELLLKLYNLMISNKDDLAKLVVLENGKPYADALGEVNYAASFFQWFSEEAPRIYGDIIPSANGTNRILTFKQPIGVCGILTPWNFPLAMITRKLGAAIATGCTAVIKPASETPLSATALAFLAEEAGFPPGVINVLPSADASGSGKYLTEHPLIKKVSFTGSTPVGKILMNQSASTLKKLSFELGGNAPFIAFDDVDVDKAVNGAIASKFRSSGQTCVCANRIFVHEKIYDEFAKKFVDKLKNETVLGNPLASGVTHGPVIHDRSMKKVRQHIEDAVDKGATILLGGSKRPDLGENFHDLTVLGDVTTEMLITQEETFGPVAPLIKFKTDDEVIKMANDTTVGLAGYFYANDVAKVFKIAEALNVGMLGVNTGAISEAALPFGGVGESGFGREGSKFGVEDYLVIKSAVLGGIEN

SEQ ID NO: 27201 - protein, 239 aa, Zea mays
YSESEREAASRRQGEMGKGAQGSDAAAAGGEVEDNMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGAMCEPLSVGVHTCRRAGVGPETGVLVVGARRISKRLLVEAGIIGEHGVVVADDDDHHLVTG

SEQ ID NO: 27202 - protein, 786 aa, Gibberella zeae PH-1
MALVLTSEGAFEVGVTDDSSSNVASATSTPPTTVADEASLHSESPKRDVVHVALDIESPEVTLTTSNLIEPTDSISLAEPPPPAPTRSRRSRVSAPVYNLVQLSGTAGHGKRRAKGDIVADRRRRRRTVSGPVLPGYGSTSSSPAQGATPETVRSGIDALGVTQSASKLDSPRTRRQRILEEELPSKRPSTRRSSTIAPAAVTPVNKKSKVTKRSRKSLESETPLSRELRRLQDTKEFSHIDEKPVIQSVWSNGKFVDPKAPAPPPKKKSEPEPAAEEPKDTEPEPMNRFRNRKPKKYLVKGLYAGQDTPTDIIKALSGVDKKTIAQVPDLIPNGRVNKTMPMPIFTGLRTLIDGRDFKLPYQVCHPLPPGQPKPDEWKKMTKNRFIGESKDYWRKSPHFHDYSSKCVCKPEDGCGESCQNRIMLYECDEQNCNAGKKYCTNRAFANLTARRNRGGKYRVGVEVIKTSDRGYGVRSNRCFRPNQIIMEYAGEIITEEECERRMTEVYKDNECYYLMSFDQNMIIDATTGSIARFVNHSCNPNCRMIKWIVSGQPRMALFAGDKPIMTGDELTYDYNFDPFSAKNVQKCLCGEPNCRGVLGPKPREVKQPKADLKNAVKGAVKAGKRKLKELVGDEADSGNNAKKRKVQPAKGVKRAISNASSKVAKGAASAIKKGVSTVAATAKKAALGSKPPAKQRVSAGAILKKTTTKRVIQTYSRTPQKRAAGRASNVGLVAASKAKGASVKKVNTKSTTKIGSIKRKPFPTPMPRTTMNISQLAEIMVAADD

SEQ ID NO: 27203 - protein, 188 aa, Triticum aestivum
MGSGSFLKVLVSNLDVLAGPIVSLAYPLYASVRAIETKSPIDDQQWLTYWVLYSFITLFELTFAAVIEWLPFWSYGKLFFNCWLVLPYFNGAAHVYEHFVRPMIVNQQVVNIWYLPKKEGSDKPDDVISAAQKYIEQNGSKAFETLVNKFKTTNARRSILEEVEAERRARAERELEARDVNPFFHPNY

SEQ ID NO: 27204 - protein, 600 aa, Oryza sativa (indica cultivar-group)
MASMDEPLYPIAILIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKESDIVDWFVPVVKRLAAGEWFTARVSSCGLFHIAYPSAPDQLKAELRTIYGQLCQDDMPMVRRAAASNLGKFAATVEQNYLKTEVMSIFDDLTQDDQDSVRLLAVEGCAALGKLLEPQDCVAHILPVIVNFSQDKSWRVRYMVANQLYELCEAVGPEHSREQLVPAYVRLLRDNEAEVRIAAAGKVTKFCRILSPQLAIQHILPCVKELSSDSSQHVRSALASVIMGMAPVLGKEATIEQLLPIFLSLLKDEFPDVRLNIISKLDQVNQVIGIDLLSQSLLPAIVELAEDRHWRVRLAIIEYIPLLASQLGVGFFDDKLGALCMQWLEDKVFSIRDAAANNLKRLAEEFGPEWAMQHIIPQPSGSQFVIVISWKVLEKINNPHYLYRMTILQAISLLAPVMGAEITCQQLLPVVINSSKDRVPNIKFNVAKVLQALIPILDQSVVEKNVKPCLVELSEDPDVDVRYYANQALQACDQIMMSS

SEQ ID NO: 27205 - protein, 463 aa, Oceanobacillus iheyensis HTE831
MIQDKKISSKFIYFFGAFGGILFGYDIGVMTGALPFLQSDWNLQNDPTAIGWITSSLMLGAIFGGALSGQLSDRIGRRKMILIASIIFALGSIMAGISPHNGILFMIVSRIILGLAVGAASALVPAYMSEMAPARLRGRLSGINQTMIVSGMLLSYIVAFVLKDLPETMAWRLMLSLAAVPALILFFGVLRLPESPRFLIKNNKINEARKVLSYIRPKEKIESEISQIQASTKYEEKASQKTSWGTLLSGKYRYLVIAGLGVAAFQQFQGANAIFYYIPLIVENATGNAASSALMWPIIQGIILVLGSLLFLLIADKFNRRTLLTLGGTVMGLSFILPAILNIVIPNASPMMIVVFLSIYVAFYSFTWAPLTWVIVGEIFPLVIRGRSSGLASSFNWIGSFLVGLLFPVMVASMAQEAVFAIFGAICLLGVLFVRLCVPETRGRSLEEIEKIGESKQLHKKTV

SEQ ID NO: 27206 - protein, 682 aa, Medicago truncatula
MLQTLIPFLLFFFVPVLSQVDQLLYTGFKDVGPKNLTLNGIAEIEKNGIIRLTNETSRLLGHAFYPQPFQIKNKTTGKVFSFSSSFALACVPEYPKLGGHGMAFTIVPSKDLKALPSQYLGLLNSSDVGNFSNHLFAVEFDTVQDFEFGDINYNHVGIDINSMRSNATITAGYYSDDDMVHNISIKGGKPILVWVDYDSSLELISVTLSPTSNKPKKPILTFHMDLSPLFLDTMYVGFSASTGLLASSHYVLGWSFKINGPAPFLDLSKLPKLPHPKKKHTSLILGLSLGSALIVLCSMAFGFYIYRKIKNADVIEAWELEVGPHRYTYQELKKATKGFKEKQLLGQGGFGKVYNGILPKSKIQVAVKRVSHESKQGLREFVSEIASIGRLRHRNLVMLLGWCRRRGDLLLVYDYMANGSLDKYLFEDSEYVLSWEQRFKIIKGVASGLLYLHEGYEQVVIHRDVKASNVLLDFELNGRLGDFGLARLYEHGANPGTTRVVGTLGYLAPELPRTGRATTSSDVFAFGALLLEVVCGRRPIEPKASQDELVLVDWVWERFKEGRAFEVVDPKLNGDFVETEVMMVLKLGLICSNDVPTIRPSMRQVVRILDGEVELPNEMRKPGGIDSQEGFDEFLNSLGTSNSFDQMSSSSYNGKRDIDNTSFITFGNSPQSSLLNARGETR

SEQ ID NO: 27207 - protein, 480 aa, Neisseria meningitidis MC58
MKQLAMYINGRFENDFNGEWRDVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 27208 - protein, 361 aa, Streptococcus pneumoniae R6
MKPSIHSLAHQTMQEWVLEQGEKKFRADQIWEWLYRKRVQSFEEMTNLSKDLIAKLNDQFVVNPLKQRIVQESADGTVKYLFELPDGMLIETVLMRQHYGLSVCVTTQVDCNIGCTFCASDLIKKQRDLNNGEIVAQIMLVQKYFAERGQDERVSHIVVMGIGEPFDNYNNVLNFVCTINDDKGMAIGARHITVSTSGLAHKIRNFADEGVQVNLAVSLHAPNNELRSSIMKINRAFPIEKLFAAIEYYIETTNRRVTFEYIMLNEVNDSVEQALELAELLKNIKKLSYVNLIPYNPVSEHDQYSRSPKERVLAFYDTLKKKGGNCVVRQEYGTDIDAACGQLRSNTMKRDRQKAVAEVNP

SEQ ID NO: 27209 - protein, 375 aa, Oceanobacillus iheyensis HTE831
MIYDIAVIGAGSMGLSAGYYLSKAGKTVALIDSNDPPHSEGSHHGETRIIRHAYGEGAAYVPLALRSQELWNDLNQTFNQDIFHQTGVLNIGGDNSVFLQNVIQSVRQYRLQAEILSAKQINSRWHGFRLPDHLMGVYETNSGVLMSEKVLQSYRDLATALGASFYTNAYIHHLDVTNQHITIQLSSDTIKAKQLIITAGKGTNQILSLLGYELPLFPVRKTFSWFKTDESIYHSDAFPAWSFDNGNEKYYGFPSIDNAGIKIGRHDGGHPVKADEALKTFGTYREDKEDVSQFVHRYMSPNIQHSQGKVCTYTNTPDGDFIIDRLPNYQHVLVACGFSGHGFKFSSAVGELLSQLAIRGETSLDISPFSLNRFV

SEQ ID NO: 27210 - protein, 428 aa, Bacillus cereus ATCC 10987
MVAEKGTQTKTQQQREQHFELLNSTQIVISEALEKLGYPNEVYELLKEPVRMMTVKIPVRMDDGTVKIFTGYRAQHNDAVGPTKGGIRFHPNVTENEVKALSIWMSLKCGIVDLPYGGGKGGIICDPREMSFRELERLSRGYVRAISQIVGPTKDIPAPDVFTNSQIMAWMMDEYSRIDEFNSPGFITGKPLVLGGSHGRETATAKGVTICIREAAKKRDIDIKGARVVVQGFGNAGSFLAKFMHDAGAKVIAISDAYGALHDPNGLDIDYLLDRRDSFGTVTKLFNNTISNKELLELDCDILVPAAIENQITEENANDIKAKIVVEAANGPTTLEATKILTDRGILLVPDVLASAGGVTVSYFEWVQNNQGYYWTEEEVEQRLEKVMVRSFDSIYETAQVRKVNMRLAAYMVGVRKMAEASRFRGWV

SEQ ID NO: 27211 - protein, 558 aa, Magnaporthe grisea 70-15
MSHSNPPTGASGGPGSASASAAPARGYYSLKRSIQTAFNGYGLLGWEVPDLASTSHLCPPGTQSYVNLSAIEQELAQRFRQQSLGLEALLFGFCLRHTDPLDRGLGPPAYQSKVRVMDKYQVIGFISSGTYGRVYKARGRQGQPGEFAIKKFKPDKEGEQITYTGISQSAIREMALCSELRHPNVIRLVETILEDKAIFMVFEYAEHDLLQIIHHHTQQPKHPIPPQTIKSIMFQLLNGCQYLHTNWVLHRDLKPANIMVTSSGEVKVGDLGLARIFWKPVRTLMQGDKVVVTIWYRAPELLMGSHHYTPAVDMWAVGCIFAELLSLRPIFKGEEAKMDNTKKGGSRDMPFQRHQMQKIVDIMGMPTKERWPLLTSMPDYDKLPLLQPPLSASGYSQQPAHSHHHHQHYNQGPQYGGRAGGPTSSSSANSSSAAAAASQSHLDKWYYHTVSQGQTAGPMPHAPPGSLASLGVEGYKLLAGLLEYDPEKRLTAAAALQHNFFSTGDRVSANCFEGCKAEYPHRRVSQEDNDIRTGSVPGTKRSGMPDDSMGRPGKRVKE

SEQ ID NO: 27212 - protein, 388 aa, Fusobacterium nucleatum subsp. vincentii ATCC 49256
MVRNYMAIIYLAENKENISPLTKVRALASIPVGGSYRIIDFSLSNVVNAGIRNVGLFCGNEELNSLTDHIGMGAEWDLARKKDGIFIFKQMLDSNFSLNQSRIRKNMEYFFRSTQKNIVVLNAHMVYNLDIADLIEKHEASEKEITMVYKKVKNANEHFNHCSSVKIDENNRVIGIGQNLFFKEEENISLDAFVLSKELMLKLLVDSIQEGKYNILSEIIARNLPSLNINAYEFKGYLQCINSTREYFDFNMNLLNQEVRDDVFGLKSGRKILTKVKDTPSTFFKETADVENSLVSNGCIIEGTVKNSILSRGAIIEKDVVLEECVILQDCHIKKGAHLKNVIVDKNNIIHENEKLSASREYPLVIEKSMKWNTKQYQDLMDYIRNKE

SEQ ID NO: 27213 - protein, 384 aa, Fusobacterium nucleatum subsp. vincentii ATCC 49256
MRMKKKRIIAMILAGGQGTRLKELTEDLAKPAVAFGGKYRIIDFTLTNCSNSGIDTVGVLTQYEPRILNNHIGRGSPWDLDRMDGGVTVLQPHTRKNDKKGWYKGTANAIYQNIKFIEEYDPEYVLILSGDHIYKMNYNKMLQFHIQKEADVTIGVFKVPLKDAPSFGIMNTNDDMSIYEFEEKPKEPKSDLASMGIYIFNWDLLKEYLDEDEKNPNSDNDFGKNIIPNMLNDGRKLFAYPFKGYWRDVGTIQSFWDAHMDLLSEDNELDLFDKSWRVNTRQGIYTPSYFEKGSKVQNTIIDKGCLIEGEIKHSVIFSGVKVGKNTKIIDSIIMADTEIGNNVTIRKAIIANNVKITDNINIGDGEKIAVVGEKKIIDSQSLVK

SEQ ID NO: 27214 - protein, 764 aa, Sinorhizobium meliloti
MPGIDKTDRAMTSVTAQEALDFHSQGRPGKLEISPTKPMATQRDLSLAYSPGVAVPVKAIADDPATAYDYTARGNMVAVISNGTAILGLGNLGALASKPVMEGKAVLFKRFADVDSIDLEVDTENVDEFVNCVRFLGPSFGGINLEDIKAPDCFIIEQRLREVMDIPVFHDDQHGTAIIAAAGLVNALTLTGRDFKTAKLVCNGAGAAAIACIELIKAMGFNPENIIFCDTKGVIYKGRTDGMNQWKSAHAVETDRRTLAEALDGADVFFGLSAKGALSADMVRSMGARPIIFAMANPDPEITPEEVALIRDDAIVATGRSDYPNQVNNVLGFPYIFRGALDVRASTINDAMKIAAAEALANLAKEDVPDDVAAAYQGNRPRFGPQYIIPVPFDPRLISAIPMAVAKAAMETGVARKPIEDLKAYGQQLSARRDPIASTLQRIVERVRRQPKRIVFAEGEEVQMMRSAIAYANQQLGTALLLGREEVMRETAEREGIDLDRAGIQIVNARLSKRVGAYTDFLYSRLQRKGYLFRDVQRLINTDRNHFAASMVALGDADGMVTGLTRNYSTALEDVRRCIDPKPGHRVIGVSIALCRGRTVLVADTAVHKHADLRGAGAMLAYSTFGHPSGERSERVREAVKILDRRRVDFEYDGEMAADVALNARVMEQYPFCRLSGTANVLVMPAFHSASISTKMLQELGGSTVIGPLLVGLDKSVQIASMSAKDSDLVNLAAIAAYNAGTRRGSAESRKTAGTSSVAASPDG

SEQ ID NO: 27215 - protein, 393 aa, Saccharomyces cerevisiae
MGQLLSHPLTEKTIEYNEYKNNQASTGIVPRFYNCVGSMQGYRLTQEDAHLIRNENSVVYVRFFNPFIDKYETLSLNVFAVFDGHGGDDCSKFLSGGRHHRDGNGSSNGNGEPNAGLIKWIAYSFENHHYTSTTNNDSSKFKRSFNTLEGLVSQIFKDAFILQDEELYRHFANSSCGSTAVVACIINEESLYVANCGDSRCILSSKSNGIKTMSFDHKPQHIGELIRINDNGGTVSLGRVGGVLALSRAFSDFQFKRGVTYPHRRTKLTNITQNLTYGTPPQEAQVTVEPDVLMHKIDYSKDEFLVLACDGIWDIYNNKQLIHFIKYHLVSGTKLDTIITKLLDHGIAQANSNTGVGFDNMTAIIVVLNRKGETLQDWFNKMKTRLERERGLV

SEQ ID NO: 27216 - protein, 944 aa, Cryptococcus neoformans var. neoformans JEC21
MSSLASAPPTASIPASDSYNSPVQSSGPGLSNGNSTPSKWKSVFKLGRTATIGRGKENRSALGGESFVLDNKEQQSFAGEVSPAVPTEPYLPPRKTQLRAHTDPYPPKSPSVKNNPGSVSVEHFDSKVLHEEGMPKTREEGSSESFNVHLNSSNGNLQTTSTSGEQSRPYSSVTDSASASTTERTSHSSGGHFLPGDGSLHGVASSNTYGTASTRSPTGGPLGIGNLKSRFFSAPLSAPAGKNKHDKSKSEKYRGLGKVATDFPQSTAPPSSAGGASSSGGGRKKSDGSSSLSSRGAASPRTPAKSKREPSANSSRRMPFGQTNDNGSNSGSVAARFLRRVVSAPNTKALFSNNLFSNAPDVPPLPAPKNQPNSSTSSKEKSSSPVVIVGNSGGHIDLTSSPDSDHPPSISPLSNSSTMYTSQTSHTPSASASATPTPSPLKQKNHFLSPTASPSPGQGSGLSAKGTRASRSLTTGTAPVLKNIRQLQGYSGSSPGGGGYMDGESRHKQVFKRTYSSNSIKTKQVEVTASSFQKIKLLGKGDVGKVYLVREKKTDKLFAMKVLSKKEMIKRNKIKRALAEQEILATANHPFIVTLFHSFQSQDYLFFVLDYCMGGEFFRALQTRPGKCLSEEHAKFYAAEVTAALEYLHLNGYIYRDLKPENILLHQSGHIMLSDFDLSKQSGEAGGAPAAIRHGGPNGQTILVDTRSCIADFRTNSFVGTEEYIAPEVIKGHSHSSAVDWWTLGILVYEMIFATTPFKGPNRNATFANVMKNEVLFPESVPVSSNCKSCIRKLLIKDENKRLGSASGASEVKQHKWFASVNWGLLRNMTPPIIPEESNGIDTINFRPLRESKSIDFDRDDITTDIIHAKAGSPSVSGNSTPGMLTPKELVQTTSSSSPIGGGAGGTSGHSSSAMPIPGSMRGYDKEKNPFGEFSSVTRDFGEC

SEQ ID NO: 27217 - protein, 199 aa, Aspergillus niger
MATGPATQSLKCVVTGDGAVGKTCLLISYTTNAFPGEYIPTVFDNYTASVMVDGRPISLGLWDTAGQEDYDRLRPLSYPQTDVFLICFSIVSPPSFDNVKAKWFPEIEHHAPNVPIILVGTKLDLRDDRGTIDALRQRKMEPVSYEQALAVAKEIRAHKYLECSALTQRNLKSVFDEAIRAVLNPRPAAKPKNKKCVIL

SEQ ID NO: 27218 - protein, 393 aa, Bordetella parapertussis
MSSALANIYARLPVSFTHGRGVWLWDTGERRYLDALAGIGVSCLGHGHPGLVAAISEQAARLIHTSNIYEVPQQAALARRLAELSGMSEVLFSNSGSEANEAAIKLARYYGYKQGNTHAHIITMDSSWHGRTLATLAATGSDKARQGFGPMPSGFIQVPYNDLPAIRAAGEAEPRVTAVLLEVLQGEGGIRPSDMAFLRGVRQLCTERGWLLMIDEVQSGIGRTGKWFAHQWADIRPDVMTLAKGLAGGVPIGAMLAAGPAAGVFAPGSHGTTFGGGPLACAAGLAVIDAIEQEGLLANAHEVGAHLHAALASELAGVPGIIEVRGHGLMLGIELDRPCGILATRAMEAGLLINVTRERVVRLLPPLILSGEEADQIVRILVPLIKQFLAQQQ

SEQ ID NO: 27219 - protein, 552 aa, Oryza sativa (indica cultivar-group)
MSAQTQPTHHHPRTRRGRSEYFSKLLSSHCMGCCGSSLRVGSHAPEKPPRRARPPPPPPQPHHPRRPSFTLNAHQAAASSSAASAAPAPAFAEFSLAELREATGGFAAANIVSESGEKAPNLVYRGRLQGAGGGGRAIAVKKFGKLAWPDPKQFAEEARGVGKLRHRRMANLIGYCCDGDERLLVAEFMPNDTLAKHLFHWENKAIEWAMRLRVAYNIAEALEYCSNEERPLYHDLNAYRVLFDENGDPRLSCFGLMKNSRDGKSYSTNLAYTPPEYLRNGRVTLESVVFSFGTILIDLLSGKRIPPTLALDMIRSRSIQAIMETNLEGKYSIEEATTLVDLASKCLQYEPRDRPDIKKLVSILQPLQTKSEVPSYVMLGVPKPEEVPKAPPAPQHPLSPMGEACSRMDLTAIHQILVSTHYRDDEGTNELSFQEWTQQMRDMLDARKRGDFAFRDKNFKQAIDCYTQFVDVGTMVSPTVYARRSLCHLMCDQPDAALRDAMQAQCVYPDWPTAFYMQAVALSKLNMQSDSLDMLNEASQLEEKRQKSIKGP

SEQ ID NO: 27220 - protein, 371 aa, Candida albicans SC5314
MSIPVSMKAIVFYAPYDVRTEERPTPKIKDPKDVIVKVRYSGLCGTDLHSYRGHIKGPVGTIIGHEFVGTVVATGDNITKFSIGDDVISNFSIECGECWYCKHGYSGQCNVTNTFGKVGLDGGQAEYVRVPYAETTLTKKPSTTNSNDDVDDSVYVLMADIFTTGYYGVKKIKDFLSISAAEGIKPQSFEETTILQLGAGPVGLCALRILKYFGFGKVVVVDNVPSRLEEAKRLGATKVINFETEPDGIKKYITEETDGVGFDAVLEVVGSAAAHKTSFDAVRRNGFISSIGMGHEPFPFNGLDVYLKNINMSFGRCHSWSLFPESLAIFEEMKGDLASFIDYKAKLEDSKEAFDMFDKHKVKKIVFDLTS

SEQ ID NO: 27221 - protein, 519 aa, Ipomoea nil
MATLTLIFCTLVFAIFLYFLILRVKQRYPLPLPPGPKPWPVLGNLPHLGKKPHQSIAAMAERYGPLMHLRLGFVDVVVAASAAVAAQFLKVHDSNFSNRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGGSKSDPKAEEFKSMVEEMMVLAGSFNIGDFIPVLGWFDVQGIVGKMKKLHARFDAFLNTILEEHKCVNNQHTTLSKDVDFLSTLIRLKDNGADMDCEEGKLTDTEIKALLLNLFTAGTDTSSSTVEWAIAELLRNPKILNQAQQELDLVVGQNQLVTESDLTDLPFLQAIVKETFRLHPSTPLSLPRMGAQGCEINGYFIPKGATLLVNVWAIARDPNVWTNPLEFNPHRFLPGGEKPNVDIKGNDFEVIPFGAGRRICSGMSLGIRMVHLLVATLVHAFDWDLVNGQSVETLNMEEAYGLTLQRAVPLMLHPKPRLQPHLYTLN

SEQ ID NO: 27222 - protein, 290 aa, Burkholderia thailandensis E264
MSAAVEPLVRDRYAVIGNPVAHSKSPFIHARFAEQTGEAIEYTHLLAPLDGFAATVREFTAQGGRGVNVTVPFKLEAYALADTLSPRAAAAGAVNTLRFDADGIFGDNTDGVGLVRDIETNLGVSLTGARILLLGAGGAARGVVLPMLERGPASLTIVNRTASKAEELVGQFTQAAHDAGCVLAGGGPERVAREPYDVIVNATAGSLDAALPECDAAAFCPATLAYDMMYGARPTVFMEHAATLGARTADGLGMLVEQAAESFYLWRGVRPDGAPVLAALRAALAASAAH

SEQ ID NO: 27223 - protein, 522 aa, Ipomoea tricolor
MATLTLILCTLVFAICLYFLILRVKQRYPLPLPPGPKPWPVLGNLPHLGEKPHQSIAAMAQSYGPLMHLRLGFVDVVVAASAAVAAQFLKVHDANFSSRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGSSKSDPKAEEFKSMVEEMMVLAGSFNIGDFIPVLGWLDLQGIVGKMKKLHARFDAFLNTILEEHKFVNNQDTTLFKDMDFLSTLIRLRDNGAAMDGEDGKVTGVTDTEIKALLLNLFTAGTDTSSSTVEWAFAELLRNPKILNQAQQELDLVVGPNRLVTESDLTQLPFLQAIVKETFRLHPSTPLSLPRMGAESCEINGYFIPKGATLLVNVWAIARDPNVWTNPLEFNPHRFLPGGEKPNVDIKGNDFEVIPFGAGRRICSGMSLGIRMVHLLVATLVHAFDWGLVDGQSVDTLNMEEAYGLTLQRAVPLMLHPKPRLQPHIYTLN

SEQ ID NO: 27224 - protein, 678 aa, Medicago truncatula
MLNSPSSCSSNIINQSKNILVLFSLLLVLSYLPKTNSLLFNITNFDDPTVASNMSYQGDGKSTNGSIDLNKVSYLFRVGRAFYSQPLHLWDKKTNTLTSFTTRFSFTIDKLNDTTYGDGFVFYLAPLGYQIPPNSAGGVYGLFNATTNSNFVMNYVVGVEFDTFVGPTDPPMKHVGIDDNALTSVAFGKFDIDKNLGRVCYVLIDYNSDEKMLEVFWSFKGRFVKGDGSYGNSSISYQIDLMKKLPEFVNIGFSASTGLSTESNVIHSWEFSSNLEDSNSTTSLVEGNDGKGSLKTVIVVVAVIVPVILVFLIASIVGWVIVKRKRKNCDEGLDEYGIPFPKKFDLDKATIPRRFEYSELVAATNGFDDDRMLGRGGYGQVYKGALSYLGKIVAVKRIFADFENSERVFINEVRIISRLIHRNLVQFIGWCHEQDELLLVFEYMPNGSLDTHLFGDKKSLAWEVRYKVALGVANALRYLHDDAEQCVLHRDIKSANVLLDTDFSTKLGDFGMAKLVDPMLRTQRTDVVGTYGYLAPEYINGGRASKESDMYSFGIVALELATGRRFFQDGDFHVPLMNWVWGLYVEGNLMCAADEKLNMEFDVSEMKSLLIVGLWCTHSNDKERPKAYEVIKVLQLEMALPELPLDMHDRAPPIVPFRQSNGPSMAPPMTNSLITSGR

SEQ ID NO: 27225 - protein, 318 aa, Persea americana
  misc_feature (151)..(151): Xaa can be any naturally occurring amino acid
  unsure (1)..(318): unsure at all Xaa locations
DIIKNAAEIIAKTSFGMNHQYAERVFEKLKAMQVTLYRSGRLLGVPFGRLVYLKQTLEERKLGKEIDDLLLSIITARKASHIAEPPKDLLGLLLPDNHVNELLGKKLSPRELVDECKTFFFGGHETTALASLWTLFLLAKQPKWQTLLREXIMEVTGGEPLDFTMLPKLEKMGWVMNEVLRLYPPAPNVQRQVREDIQVGDTIIPKGTNIWIDLVGMHHDPALWGEDVNEFRPERFKEDVLYGGCKHKMGYLPFGFGGRMCVGRNLALMEYKTVLSLILTRFSMSLSPNYLHSPTHLLSLRPSCGMPLILQPITPNHP

SEQ ID NO: 27226 - protein, 420 aa, Erwinia carotovora subsp. atroseptica SCRI1043
MPHDLNDVTHALNAQSLRELPVRFGCPVWAYDAQTIVNRITQLRQFDTIRFAQKACSNTHILRLMHEQGVKVDSVSLGEIERALIAGFVPGTDAHEIVFTADLLDRPTLQRVSELNIPVNAGSVDMLEQLGQQSPGHPVWLRVNPGFGHGHSQKTNTGGENSKHGIWYGDLPLALAHIQRYQLKLVGIHMHIGSGVDYGHLEQVCEAMVQQVVELGQDIEAISAGGGLSIPYRHGEEAIDTEHYYGLWNAAREKIAAHLGHPITLEIEPGRFLVAESGVLVAEVRAIKSMGSRHFVLVDAGFNDLMRPAMYGSYHHVSLLSGDGRDISQSTLRDSVIAGPLCESGDVFTQQAGGGVETFSLPDAQVGDYLVFHDTGAYGASMSSNYNSRPLLPEVLFENGEPRLIRRRQTLEELLALEAL

SEQ ID NO: 27227 - protein, 739 aa, Mangifera indica
MESCNCIEPQWPADELLMKYQYISDFFIALAYFSIPLELIYFVKKSAVFPYRWVLVQFGAFIVLCGATHLINLWTFSMHSRTVAIVMTTAKVFTAAVSCATALMLVHIIPDLLSVKTRELFLKNKAAELDREMGLIRTHEETGRHVRMLTHEIRSTLDRHTILKTTLVELGRTLALEECALWMPTQTGLELQLSYTLHQQNPVGYTVPIQLPVISQVFTSNHAVKISPNCPVARLRPLAGKYMPGEVVAVRVPLLHLLNFQINDWPELSTKRYALMVLMLPSDSARQWHVHELELVEVVADQVAVALSHAAILEESMRARDLLVVQNIALDRARREAETAICARNDFLSVMNHEMRTPMHAIIALSSLLQETELTPEQRLMVETILKSGNLLATLINDVLDLSRLEDGSLQLQLGTFNLHAVFKEVLNLIKPIASVKKLLVALNLAPDLPEYAVGDEKRFMQTLLNVVGNAVKFTKEGNILITAFVAKSESFLDSRTPEFFPVPSDNHFYLRVQVKDSGSGISPQDIPKLFTKFAQNQSIATRNSHGSGLGLAICKRFVNLMEGHIWIESEGLGKGCTAVFVVKLGIPESSNESKLSFMPKMSGPQTNFTGLKVLVLDDNGVSRSVTKGLLVHPGCDVMTVGSSEECLHVVSQEHKVVFMDVGIPGIDGYEVAVHIHQKFTRRHERPLIVALTGNTDKITKENCMSVGMDGVILKPISLEKMRSVLLGLLEHRVLFEAI

SEQ ID NO: 27228 - protein, 448 aa, Streptococcus pneumoniae R6
MREYDIIAIGGGSGGIATMNRAGEHGAQAAVIEEKKLGGTCVNVGCVPKKIMWYGAQIAETFHQFGEDYGFKTTDLNFDFATLRRNRESYIDRARSSYDGSFKRNGVDLIEGHAEFVDSHTVSVNGELIRAKHIVIATGAHPSIPNIPGAELGGSSDDVFAWEELPESVAILGAGYIAVELAGVLHTFGVKTDLFVRRDRPLRGFDSYIVEGLVKEMERTNLPLHTHKVPVKLEKTTDGITIHFEDGTSHTASQVIWATGRRPNVKGLQLEKAGVTLNERGFIQVDEYQNTVVEGIYALGDVTGEKELTPVAIKAGRTLSERLFNGKTTAKMDYSTIPTVVFSHPAIGTVGLTEEQAIKEYGQDQIKVYKSSFASMYSACTRNRQESRFKLITAGSEEKVVGLHGIGYGVDEMIQGFAVAIKMGATKADFDATVAIHPTSSEEFVTMR

SEQ ID NO: 27229 - protein, 429 aa, Arabidopsis thaliana
MVNPEENNRNLVVKPITEILQDDDKRSRKFGVEMKRQNRRALGVINHNLVGAKAYPCVVNKRRGLSQRKQESCDKKKLDSLHPSISRSQEETKKLKPSGNEFGDCIFIDEEEEKNEEVTLDQPMPMSLEEPYIEFDPMEEEVEMEDMEEEQEEPVLDIDGYDANNSLAAVEYVQDLYDFYRKTERFSCVPLDYMAQQFDISDKMRAILIDWLIEVHDKFELMNETLFLTVNLIDRFLSKQAVARKKLQLVGLVALLLACKYEEVSVPIVEDLVVISDKAYTRTDVLEMEKIMLSTLQFNMSLPTQYPFLKRFLKAAQSDKKLEILASFLIELALVDYEMVRYPPSLLAATAVYTAQCTIHGFSEWNSTCEFHCHYSENQLLERCRRMVRLHQKAGTDKLTGVHRKYSSSKFGYIATKYEAAHFLVSDSH

SEQ ID NO: 27230 - protein, 443 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVRQACKRGGKETKQIEEDGLVDVDGEKSKLAEDLSKIRMVESLDASASKELVDCAEEDRSDVTDCVQIVDIDSGVQDPQFCSLYAASIYDSINVAELEQRPSTSYMVQLQRDIDPTMRGILIDWLVEVSEEYKLVSDTLYLTVNLIDRFMSHNYIEKRKLQLLGVTCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNKTLQHYTRYETSALKNAVLAMEDLQLNTSGSTLIAIRTKYNQQKFKRVATLTSPERVNTLFSR

SEQ ID NO: 27231 - protein, 311 aa, Rhodococcus sp. RHA1
MTLDPDMAVLLDKLNDWDAAAGAQTTIEGARKRIEEMRALYFEPELLEVREVENVTVPGPAGGIPARIYRPDTEESTLPTVLYLHGGGWVMGGLDSHESHARRVCARTGSVVVAVDYRLAPEHPFPAGYDDCLVSLHWIHDTIDQLGGDASRVAVAGDSAGANLAASVALAARDAQLPLRAQLLLYVPVHFAKRYPSMDELADGYFLRMPANEDMGAGYLEDRRLSSDPRVSPIEGDLTGVAPAIVCGAECDPLRDHAPAYAAALEAAGVPVRLRISPGMLHGYWSMGVVPRANDLANQLCEELAELLTPE

SEQ ID NO: 27232 - protein, 486 aa, Oryza sativa (indica cultivar-group)
MGRRSGGRKLPFFASNASTSSSTKRTRSARRLPSLTRPRASSSPSPASPSPPPPSASHPAPPSPPLAVSPAGAGKVGKKKAGARLWMRLDRWGVSETLHLDKGSIIRRAGLPPRDLRILGPVFSDSSSILAREKAMVINLEFIRAIVTADEILLLDPLTIDVIPFVEQLTHHLPLKNLVCGNGQPGGDDHGEKHDDSPGDQVPRLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWGSNHPEAAVCLLCREIADESLNFMDNTE

SEQ ID NO: 27233 - protein, 341 aa, Mesorhizobium loti MAFF303099
MPSVSDTDTSLRFPILIGDIGGTNARFSIVLDANSEPTEPQIVQTANFNTIDEAIQAAVLDRSSVRPNSAVLAVAGPVDGDEIELTNCPWVVKPRQMFANLGLSDIVVLNDFEAQALAVVALGEEHMEKIGGGTPEPNAGRVVLGPGTGLGVAGLVYALRHWIPVPGEGGHMDIGPRTPRDFEVFPHIEKLEGRISGEQILCGRGLVNVYRAVAKADGKPAPFTTPAEITGAALAKTDPVAEEALETFVTCLGRTAGDLALVFMSRGGVFLTGGIAQKIVPALKEGNFRAAFEDKAPHSALMRTMPVYVITHPLAALLGLAAYARNPSLFGVQTAGRRWQA

SEQ ID NO: 27234 - protein, 298 aa, Oryza sativa (indica cultivar-group)
MLPYATAAEAEAALGRAMTAAESLWFRYSAGIPDYVLFWHNILFLFVVFTLAPLPVALLELRAPAAVGPFKLQPKVRLSREEFFRCYRDVMRLFFLVIGPLQLVSYPTVKMVGIHTGLPLPSLGEMAAQLLVYFLVEDYLNYWIHRLLHGEWGYEKIHRVHHEFTAPIGFAAPYAHWAEVLILGIPSFVGPALAPGHMITFWLWIVLRQMEAIETHSGFDFPFNLTKYIPFYGGAEYHDYHHYVGRQSQSNFASVFTYCDIYMEPTKYHKAYQAKMKALGQTEGEKADSNGLSYAKLD

SEQ ID NO: 27235 - protein, 512 aa, Arabidopsis thaliana
MCGILAVLGCSDDSQAKRVRVLELSRRLRHRGPDWSGLYQNGDNYLAHQRLAVIDPASGDQPLFNEDKTIVVTVNGEIYNHEELRKRLKNHKFRTGSDCEVIAHLYEEYGVDFVDMLDGIFSFVLLDTRDNSFMVARDAIGVTSLYIGWGLDGSVWISSEMKGLNDDCEHFETFPPGHFYSSKLGGFKQWYNPPWFNESVPSTPYEPLAIRRAFENAVIKRLMTDVPFGVLLSGGLDSSLVASITARHLAGTKAAKQWGPQLHSFCVGLEGSPDLKAGKEVAEYLGTVHHEFHFSVQDGIDAIEDVIYHVETYDVTTIRASTPMFLMSRKIKSLGVKMVLSGEGADEIFGGYLYFHKAPNKKEFHQETCRKIKALHKYDCLRANKSTSAFGLEARVPFLDKDFINTAMSLDPESKMIKPEEGRIEKWVLRRAFDDEERPYLPKHILYRQKEQFSDGVGYSWIDGLKDHAAQNVNDKMMSNAGHIFPHNTPNTKEAYYYRMIFERFFPQVRVL

SEQ ID NO: 27236 - protein, 332 aa, Oryza sativa (japonica cultivar-group)
MAASTSQHALVSVKSLCTGANFGFEKRTSKVRFVLVGRCCSGTRKLGLVCASNSHSSVMEPAQLPLSPESGNTPKKSSESALILIRHGESLWNEKNLFTGCVDVPLTPKGVDEAIEAGKRICNIPVDVIYTSSLIRAQMTAMLAMMQHRRKKVPIVVHSESEQAHRWSKIYSEETKKQSIPVITAWQLNERMYGELQGLNKQETADRFGKEQVHEWRRSYDIPPPNGESLEMCAERAVAYFKDQIVPQLVAGKHVMIAAHGNSLRSIIMHLDKLTSQEVISLELSTGIPMLYIFKEGKFIRRGSPAGPSEAGVYAYTRSLAQYRQKLDNMFQ

SEQ ID NO: 27237 - protein, 213 aa, Nicotiana tabacum
KVLQKKFPGSKRVGRLEAMLLEARGLWSEAENAYSSLLEENPFDQVVHKRRAAMAKAQGNTSAAIDWLNKYLDLFMADHEAWRELAEIYVSLQMYKQSAFCYEELILSQPTVPLYHLAYADVLYTLGGLENLQMAKKYYASTIDLTGGKSTRALFGICLCTSAIAQLSKGRSKEDKESSELQSLSAMALEKDYKQRAPSNLSVLSSTLRSLKI

SEQ ID NO: 27238 - protein, 131 aa, Oryza sativa
MDHAAEAQRTDLMTITRHVLNEQGRHPESRGDFTILLSHIVLGCKFVASAVNQAGLAKLIGLAGDTNVQGEEQKKLDVLSNEVFVKALVSSGRTCVLVSEENEEAIIVDAPLRGKYCVCFDPLDGSSNIDC

SEQ ID NO: 27239 - protein, 94 aa, Oryza sativa (indica cultivar-group)
MRLTSHCSFCFRELNEKGSPLPKFGEWDVNDPASAEGFTVIFNKARDEKKTGGNSQGQDLAAKSEQPSGQGLYPAKPNSSKKWFCCMQPTAAES

SEQ ID NO: 27240 - protein, 371 aa, Pseudomonas putida GB-1
MAAPREWIEESMSKQILILPGDGIGPEIMAEAVKVLELANDKFQLGFSLAHDVIGGAAIDKHGVPLADETLERARQADAVLLGAVGGPKWDKIERDIRPERGLLKIRSQLGLFANLRPAILYPQLADASSLKPEIVSGLDILIVRELTGGIYFGAPRGQRELEGGERQAYDTLPYSESEVRRIARVGFDMARVRGKKLCSVDKANVLASSQLWREVVEDVAKDYPDVELSHMYVDNAAMQLVRAPKQFDVMVTDNMFGDILSDEASMLTGSIGMLPSASLDADNKGMYEPCHGSAPDIAGLGIANPLATILSVSMMLRYSFNQSAAAEAIEKAVSLVLDQGLRTGDIFSEGCRKVGTQEMGDAVVAALRNL

SEQ ID NO: 27241 - protein, 679 aa, Streptococcus pneumoniae R6
MLEKQVSFAWKGKIMSEKNFYITTPIYYPSGKLHIGSAYTTIACDVLARYKRLMGYDVFYLTGLDEHGQKIQQKAEEAGITPQAYVDGMAVGVKELWQLLDISYDKFIRTTDDYHEKVVAQVFERLLAQDDIYLGEYSGWYSVSDEEFFTESQLAEVFRDEAGNVTGGIAPSGHEVEWVSEESYFLRLSKYQDRLVEFFKAHPEFITPDGRLNEMLRNFIEPGLEDLAVSRTTFTWGVPVPSNPKHVVYVWIDALLNYATALGYAQDEHGNFDKFWNGTVFHMVGKDILRFHSIYWPILLMMLDVKLPDRLIAHGWFVMKDGKMSKSKGNVVYPEMLVERYGLDPLRYYLMRNLPVGSDGTFTPEDYVGRINYELANDLGNLLNRTVSMINKYFDGQIPAYVEGVTEFDHVLAEVAEQSIADFHTHMEAVDYPRALEAVWTLISRTNKYIDETAPWVLAKDEALRDQLASVMSHLAASIRVVAHLIEPFMMETSRAVLTQLGLEEVSSLENLSLADFPADVTVVAKGTPIFPRLNMEEEIAYIKEQMEGNKPAVEKEWNPDEVELKLNKDEIKFEDFDKVEIRVAEVKEVSKVEGSDKLLQFRLDAGDGEDRQILSGIAKYYPNEQELVGKKVQIVANLKPRKMMKKYVSQGMILSAEHDGKLTLLTVDPAVPNGSVIG

SEQ ID NO: 27242 - protein, 520 aa, Oryza sativa (japonica cultivar-group)
MPGAVIVHHHTRYKTYPGEVTGFVFFCCLIASVGGCIFGYDIGLTAGLTSTESFLAMFFPVIFEQQQERVITNQYCKFDSQVLTLFGSSLFLSAMVAGIFASPMSRAFGRKWTLFVAAVAYLIGAILGAISFNFIVLLTGRLLLGVGVGVCIHASPLYISEMAPAQQRGMLNILFQLMITVGILSASLTTYWTSKIAGGWGWRVGLAFGTVPAAVIALGSLAIPDTPVSLIARGEGEAARATLAKIRGVDDVRAEFEDLTTASEESKAVAHPWRELFFGGRYKPQLAFAVLIPFFQQLTGINVIMFYAPVLFKTVGFRQDASLVSSVITGLVNVFSTFVAVMTADKVGRRALFLQGGTQMIISQILVGTFIGLQFGVSGTGAMSEQYAMCIVLFVCVYVAGFAWSWGPMGWLIPSEVYPLAVRSAAQSVTVAVNMFFTAFISQIFLTLLCHLRFGLFYFFGAWVLLMTVFIATLLPETKCVPLEEVAHVWRKHWFWRKFIVDSPDRGGAEMRKRIALEMS

SEQ ID NO: 27243 - protein, 208 aa, Oryza sativa
  misc_feature (139)..(139): Xaa can be any naturally occurring amino acid
  unsure (1)..(208): unsure at all Xaa locations
MAIATTTLPLAPLALAPPSSPISQCSLLLLRPRAPAALSLRPSARLLVAVAAREPELGGSGGGGAGDGSGSGGGGDSEKPRGGGGDEEGEGEEEKMGQGLSMSQKITLAYAALVGAGGAMGYMKSGSQKSLAAGGISAXLVLYFVHTQLPVRPVFASSIGLGISAALLSVMGSRFKKSGKIFPAGVVSLVSLVMVGGYIHGILRSTHA

SEQ ID NO: 27244 - protein, 234 aa, Gerbera hybrid cultivar
MEQQQVETRSASSSMRNDDNNGGNKGESLVLSSKFPLSFWEMAGASGVVLSFVVGLLGVYLTLPDSDYSFLKLPRTLEDLHILRYHLERYASDYTIQVLVGYCTVYIFMQTFMIPGTVFMSLLAGSLFGVLKGVALVVFAATTGASTCYLLSKLIGRPLILSLWPDKLVFFQDQVAKRPRMGCWNYMLFLRVTPTLPNRFINVASPIVDVPYHIFLMGTSLGINPAAYVTVRRE

SEQ ID NO: 27245 - protein, 431 aa, Bacillus cereus E33L
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPQFQGVDSILLAAGILGATVMPHAIYLHSALTQRRVVGTNDEQKKKIFRFEFIDIIIAMIIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGALVNHRITTFIAWIIAVLVIILNIFLLYQTFVG

SEQ ID NO: 27246 - protein, 318 aa, Rhodococcus sp. RHA1
MTAIATVDIALWRAGGPSAAAVARDVDEGLQRAGFLLVRGHGVTRELAADVRAAARRFFALPEEVKARYSAIVGERGWIGPGMEANGYAEGTETPPDLKETFAIGAETRTGDPVVDDVWFKPNVWPTEVADLRALLTTYTEAMRRLSDDLLALFSAALALPANPFDGLADRPTWTCNINHYPPMSSVGEPEPGQFRIGPHTDFGTVTVLDREPGAGGLQVYTDEGGWADAPYDADALTVNIGDLLEYWSGKRWPSGRHRVLPPQADAPEEDLVSLIYFYELNHDAQVTPLEPPIGTVAGLGPVTSADFIKTRLDAITL

SEQ ID NO: 27247 - protein, 456 aa, Arabidopsis thaliana
MCGILAVLGCSDDSQAKRVRVLELSRRLRHRGPDWSGLYQNGDNYLAHQRLAVIDPASGDQPLFNEDKTIVVTVNGEIYNHEELRKRLKNHKFRTGSDCEVIAHLYEEYGVDFVDMLDGIFSFVLLDTRDNSFMVARDAIGVTSLYIGWGLDGSVWISSEMKGLNDDCEHFETFPPGHFYSSKLGGFKQWYNPPWFNESVPSTPYEPLAIRRAFENAVIKRLMTDVPFGVLLSGGLDSSLVASITARHLAGTKAAKQWGPQLHSFCVGLEGSPDLKAGKEVAEYLGTVHHEFHFSVQDGIDAIEDVIYHVETYDVTTIRASTPMFLMSRKIKSLGVKMVLSGEGADEIFGGYLYFHKAPNKKEFHQETCRKIKALHKYDCLRANKSTSAFGLEARVPFLDKDFINTAMSLDPESKMVTTKLTSQTQYLPSQVNVEQIFYMGFSRSSQRKEGSRNGF

SEQ ID NO: 27248 - protein, 472 aa, Geobacter metallireducens GS-15
MHRIAFGTSGWRGILCEDFTFENVKVVTQAIADHVTSIGEKEKGIIVAYDTRFMGERFAKETARVLAGAGIKAYVCKRDTPTPVVSHEILRRKAAGAINFTASHNPPEYNGIKFSPSWAGPALPETTKDIERRANEMLGEVCYREVALDEAARAGLVEEIDPRETYLADIETKVDFTAIASLGTIAVNVLYGTARGYLDEPLMKHGAKIKTLNMHPDPYFGGFPPEPSEKYIQDFIGLVKSDPAVKLGIATDGDADRFGIVDADGSFIEPNYIIALLFDYLVRVRKMTGAVARSVATSHLIDAVAKKHGIEVIETPVGFKYVGELISQDRIIIGGEESAGLSIKGHVPEKDGILACFLVAEMVAREGLSVKALLERLYGEVGRFLTKRENITLSPVLEAGYADKQRQAPAEFAGLKVKDMVTVDGSKFILEDGSWLLFRKSGTEPVVRLYGEASSEEKLAAVMAAGKAFILG

SEQ ID NO: 27249 - protein, 263 aa, Triticum aestivum
MAAAGVSREQRWSLAGATALVTGGSRGIGHAIVEELVGLGARVHTCSENAAELEESRRRWEEMKLPVTVSVCDVSVRAEREKLIETATQTFDGKLDILVNNVGRNLAKASVECTAEEYSHLMSTNLEAAFHLSQLAHPFLRDASVAGGGSIVNISSVASSLGYSTLAVYCISKGGVNQLTRSLAAEWAQDKIRVNSVAPGGINTELQKSVDPEIVENTLSRTPMHRLGEPVEVASMVSFLCMPAASYVTGQVIYVDGGRTISG

SEQ ID NO: 27250 - protein, 424 aa, Mycobacterium sp. HXN-1500
MIHTGVTEAVVVVGAGQAGAQTVTSLRQRGFEGQITLLGDEPALPYQRPPLSKAFLAGTLPLDRLYLRPAAFYQQAHVDVMVDTGVSELDTENRRIRLTDGRAISFDHLVLATGGRPRPLACPGADHPRVHYLRTVTDVDRIRSQFHPGTRLVLVGGGYIGLEIAAVAAELGLTVTVLEAQTTVLARVTCPTVARFFEHTHRRAGVTIRCATTVTRIHDSSSTARIELDSGEYIDADLVIVGIGLLPNVDLASAAGLTCESGIVVDSRCQTSAPGIYAAGDCTQYPSPIYGRPLHLESVHNAIEQAKTAAAAILGRDEPFRQVPWFWSDQYNIKLQTAGVNEGYDDVIIRGDPASASFAAFYLRAGKLLAVDAINRPREFMASKTLIAERAEVDPTQLADESLPPTALAAAVNGPTRATSPTSL

SEQ ID NO: 27251 - protein, 201 aa, Cenarchaeum symbiosum
MDPGCSVYGEKLLDRAGTEYRLWDPFRSKLAACIYNGLERLPIIPGSRVLYLGASTGTTASHVSDIVGGRGAVFAVEPAGRVARDLLHRVASRRPNVIPIMQDSRRPGEYPGMYGAADVVYADIAQPDQTAMAVANCKMYLRAEGSLLLVIKARSIDSVRDPAGVIREETAKLEADFGISQAVDLRTYDRDHSLVHAVYPG

SEQ ID NO: 27252 - protein, 310 aa, Triticum aestivum
  misc_feature (186)..(186): Xaa can be any naturally occurring amino acid
  unsure (1)..(310): unsure at all Xaa locations
AYLGDTIEQVCTKKQAGTGPEFPGYRRPTRPATASSSVFLMTPRLLAASAVVGLMTGADNFLYAYGQAYLPVSTSSILISTQLAFTAAFALLLVRQRFTGSTVNAIVLLSVGAAMLGMGSGGDRPAGVSGAQYAVGFGMALGAAALYGLVLPVMELSQAWHAARAGSAALTYTLVVEIQGVSGLAXPAFCAVGMLANNDFQAIPGEARQSELGQAGYYLLLVGTAAVYQCFCLGIIGAIYYGSALLAGVIITVLLPVTEVLAVVFFHEPFSGTKGVALGLSLWGLASYFYGEVRNKAPEAEHRTSPVCGS

SEQ ID NO: 27253 - protein, 393 aa, Huperzia lucidula
MTMLATEKNPMIVSMGPHHPSMHGVLRLIVTLDGENVTNCEPILGYLHRGMEKIAENRTIIQYLPYVTRWDYLATMFTEAITVNAPEKLANIQVPKRASYIRVIMPELSRIASHLLWLGPFMADIGAQTPFFYIFRERETIYDLFEAATGMRMMHNYFRIGGVAVDSPYGWVDKCSDFCNYSLPKVNEYERLITRNPIFLKRVEGVGTIGGEEAINWGLSGPMLRASGVQWDLRKVDHYECYDESDWQIQRQEEGDSLARYSVRIGETKESVKIVQQALKVIPGGPYENLEARRLNRGKNSEWNDFEYQFISRKPSPTFKLPKQEHYVRVEAPKGELGIFLMGDDSAFPWRWKIRPPGFINLQILPQLVEGVKLADIMTILGSIDITMGEVDR

SEQ ID NO: 27254 - protein, 183 aa, Huperzia lucidula
MFSMVEGLQVYGQQTIQAAKYIGQGFMVTLDHMNRLPMTVQYPYEKLIPSERFRGRIHFEFDKCIACEVCVRVCPINLPVVDWEFEKNIRKKQLTSYSIDFGVCIFCGNCVEYCPTNCLSMTEEYELSTYDRHELNHDQIALGRLPLSVVEDSTIRVISGLTKLPKGTMDGHSASKNVTNFLH

SEQ ID NO: 27255 - protein, 177 aa, Medicago truncatula
MGMAAENQFHVLAVDDSIIDRMLIERLLKTSSFNVTTVDSASKALKFLGLVEDEMRTYDTHVASEINQDVDVNLIITDYCMPGMTGYDLLRKIKESKSFKDIPVVIMSSENVPSRINRCLEEGAEEFFLKPVQLSDVSKLKPHLLKSKVKEENEQPIKRKGMEETQSPDKTRPKVSI

SEQ ID NO: 27256 - protein, 184 aa, Streptococcus pneumoniae R6
MVKVAVMLAQGFEEIEALTVVDVLRRANITCDMVGFEEQVTGSHAIQVRADHVFDGDLSDYDMIVLPGGMPGSAHLRDNQTLIQELQSFEQEGKKLAAICAAPIALNQAEILKNKRYTCYDGVQEQILDGHYVKETVVVDGQLTTSRGPSTALAFAYELVEQLGGDAESLRTGMLYRDVFGKNQ

SEQ ID NO: 27257 - protein, 550 aa, Vibrio cholerae O1 biovar eltor str. N16961
MLKNINPTQTQAWKALTAHFESAQDMDLKALFAQDSERFAKYSARFGQDILVDYSKNLVNAETMQHLFALAKETDLQSAITAMFKGEAINQTEDRAVLHTALRNRSNSPVLVNGEDVMPAVNAVLAKMKAFSERVIGGEWKGFTGKAITDVVNIGIGGSDLGPYMVTEALVPYKNHLTMHFVSNVDGTHMAETLKNVDPETTLFLVASKTFTTQETMTNAHTARDWFLKAAGDEAHVAKHFAALSTNGKAVAEFGIDTDNMFEFWDWVGGRYSLWSAIGLSIILSIGYDNFVELLAGAHEMDQHFVNTPFESNIPVILALIGIWYNNFHGAESEAILPYDQYLHRFAAYFQQGNMESNGKYVDRNGNPVTYQTGPIIWGEPGTNGQHAFYQLIHQGTKLIPCDFIAPAVSHNLVGDHHQKLMSNFFAQTEALAFGKSAQAVQAELEKAGKSAAEIAALVPFKVFEGNRPTNSILVKQITPRTLGNLIAMYEHKIFVQGVIWNIFSFDQWGVELGKQLANQILPELADSAAVTSHDSSTNGLINAFKAFRA

SEQ ID NO: 27258 - protein, 502 aa, Pseudomonas fluorescens
MTRSLTMNSSLPAIDGLRLPHQMLIGGQWVNAQSDKTLNVYNPATGDTLTDVPDGDVEDVNAAVESAAATLQSDAWRRMPPSARERILLRLADLLEAHGDELARLETLNNGKLLIYSKMMEVGASAQWLRYMAGWATKLTGSTLDLSLPLPPDVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 27259 - protein, 382 aa, Cryptococcus neoformans var. neoformans JEC21
MHFDEPISPRSQPSNLPGFLPGFESRRAFSLPSITMPFNNYGNNNAPLLPLTRHSFSGHSSRRSAARRLSYGIKNRASQYPYSVTIGGILTLALFFFVYTSPGSDLGRYNSAASRLHIRTPNEDILPLPTSERVIHRPDSKMDNGVMLLTVDENELIAEDDLFWDTYTEAEPLSAEEAAAEAELQAHKQNVQAQNVAQSLRALVWWLAEGGVLPNDFEVPSKSHLKKIGSSGFEKLLSSIDAGEEDEIIFEDGWADFANKRYRIVVFSKTYCPYSKNAKSILGKYHLSPAPFIIELNQRSDMEALQGLLQRFTNRRTVPNVLLDFISIGGSDDITLLHSEGGLHRKFEEMGAFPGLVRRATSLLPDSEENRRDEFEDHEDRS

SEQ ID NO: 27260 - protein, 419 aa, Oryza sativa
MENMRSENFNQGVSMEGVKHAPEMANTNRRALRDIKNIIGAPHQHSTRSKRGLLDKPAAKNQSGHRPMTRKFAATLANQPSSAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCAAKSEPAVFLLKSVAL

SEQ ID NO: 27261 - protein, 111 aa, marine gamma proteobacterium HTCC2080
MSDVLAALQETLEARKSDGAENSYVASLYSQGLNKILEKVGEEATETVLAAKDYDGTDAARSAVIAETADLWFHSLVMLAHLDLRYDEVLDTLGNRIGTSGIEEKAARAKK

SEQ ID NO: 27262 - protein, 458 aa, Listeria monocytogenes str. 4b F2365
MAQTSTIQNDTKAAEEYAARVFETIKLRNPGETEFHQAVEEFLNSVIPALAKEPKYEANGILEQLTEPERLISFRVPWVDDSGTVHVNRGYRVQFNSAIGPYKGGLRFHPSVTGSIVKFLGFEQIFKNSLTGLPIGGGKGGSDFDPKGKSDSEVMRFCQSFMTELQKHIGPDTDVPAGDIGVGGREIGYLFGQYKRLRGAYDAGTITGKGLSYGGSLARTEATGYGLVYFTVEMLEAAGETIRGKKIVVSGSGNVAIYAIEKAHELGAKVVACSDSAGFVYDKEGIKVETVKQLKEVERKRISEYTTIHPSAEYYAGGDVWSVPCDIALPCATQNEINADQARALVKNGVIAVAEGANMPSTLDAVDIYHENKVLFGPAKAANAGGVAVSALEMAQNSTRMSWTFQTVDEHLQNIMKDIYKNSSNAASEYGAPGNLVIGANIAGFLKVADTMISQGII

SEQ ID NO: 27263 - protein, 370 aa, Halobacillus dabanensis
MNFVIIGGDAAGMSAAMQIVRNSEGHDITVLEQGEITSYGQCGLPYVLSGDVESTDDLIARKPETFRNKYGIDVRTKNMVTEVDCEQKLVYAKDSQGQVYELKYDRLLVASGAAPVMPPWKGSDLEGVYSLKTIPDIEEIINATTENVNHVTIIGGGYIGLEMAESFRQAGKQVRLIDRGPQLAKNFDEDMGELILEEAERNRVEVHLGESVEGFEGDGKVEKVITDQGKYETDLVLVAVGVTPNTSFMKGTGIYKGLNDAITVNAFMETSILDIYAAGDCAMQYHRIKKKDDYIPLGTHANKQGQIAGLNMVDKKRSFRGIVGTAILKFFNLTLARTGLSEREAEKERLPYNKITIDSTHAAGYYSKDV

SEQ ID NO: 27264 - protein, 298 aa, Saccharomyces cerevisiae
MSGELANYKRLEKVGEGTYGVVYKALDLRPGQGQRVVALKKIRLESEDEGVPSTAIREISLLKELKDDNIVRLYDIVHSDAHKLYLVFEFLDLDLKRYMEGIPKDQPLGADIVKKFMMQLCKGIAYCHSHRILHRDLKPQNLLINKDGNLKLGDFGLARAFGVPLRAYTHEIVTLWYRAPEVLLGGKQYSTGVDTWSIGCIFAEMCNRKPIFSGDSEIDQIFKIFRVLGTPNEAIWPDIVYLPDFKPSFPQWRRKDLSQVVPSLDPRGIDLLDKLLAYDPINRISARRAAIHPYFQES

SEQ ID NO: 27265 - protein, 103 aa, Listeria monocytogenes str. 4b F2365
MLNDLYEEIKLRKTQPREGSYTNYLFDKGLDKILKKVGEEATEVVIAAKNNEQELIAEVSDLTYHLLVLLAEQNIPLSKIQAELQNREGKLSTTRDRKEINDL

SEQ ID NO: 27266 - protein, 113 aa, marine gamma proteobacterium HTCC2080
MKPRWNAQGLIPAVAQDATSGEVLMLAWMNEQALQLTLTEGRAVYWSRSRAELWRKGETSGHIQRLVDIKLDCDGDTLLLKVEQTGAACHTGRYSCFFYDYEGDTWVAKGETP

SEQ ID NO: 27267 - protein, 816 aa, Ostreococcus tauri
MDRARALWIVLAALYLSVALACVHRVGRIAARAPEVGPTTQKVFFSLNALAFTSRACALFAFGGDATTTGGLVVRALAFATPTLAHALAHGTISLFWSDVLRGAARGARASAETGARVWHRIVAYGAVLVECIVLVSIGIERDGENGRTRALLRASRLTPACASFAVAVDFAIRGARLLAMLRAFPEELGATRKRKIREVATVALTCVGTFAARGGILVASAERSDAVAVSSSEALNLAYYAGLELAPSALVLYILRKLPPRRRTSDDDDDLRDPLVDDDDSGEEEDGHFSELSDISDLTARAPKHALKRTRFIRPLDARETCNNALYATAAPLRDASSPRRSCDRRRAYERVFTVLASMPELTAELAASRHIGDACALRACAITGVAPDALNRASTSSGRPIKRLDLTDNALTSLENLKSSDVTWFSCANNALSGDALVPLGRACPAVRILTCSGNDGLRSLKGVEKMRSIAAIVCSQCGIEDLESVRGLRELNTLALGSCAIRDVGDALSELPSLRKLNLSKQRDGIRKFGLEALKSSRGLRELRLSHNALKTVPACVQRTPNLRILDVGHNQIADWGDVSALSGLEKLEQLTMRGCPIASDPAYVQRIARMCPGLKLLDGRKMRDALRGEDREPTRDEDEDDGVEPNHREEETGEEKQEMKQKQEKKEKKEKKQKKERKKLSAEPSFLELMARNKGKILEGGGAEVDEDEEKDEKKRTGVIKIYENKELKRRGPCGSDALKTLFASRDAGSGQASAWDEEDDDKEDDERTKEPRKKKTKKENPSEKPSSKKELKEMTPEERKKQLRLQRKRGY

SEQ ID NO: 27268 - protein, 105 aa, Listeria monocytogenes str. 4b F2365
MTSVDFSKGLVPTIILDDQNGDVLMLAYMNEESYQKTLETGYTWFFSRSRNELWNKGATSGHTQKVKQIWTDCDNDTLLIRVTQIGPACHTGKKSCFFNLIKEDF

SEQ ID NO: 27269 - protein, 520 aa, marine gamma proteobacterium HTCC2080
MIRRVLTVWGVIRKQHLYELAPAQRQTKMGRLIFQSPGDVPKENRGQRLRVALEMLGPIFIKFGQLLSTRRDLLPDDIADELAQLQDNVPPFASEDAISCIEAAFGGSISDHFASFDQTPLAAASVAQVHAATLPTGEAVVVKVLRPEIESIIQKDLKLIRTLAWTVERLFKEGQRLKPQEVAADYQRTLLNELDLRREAGNASQLRRNFSDSGLVYVPEIHWALNAEKVMVSERIYGIPVTDVEALNQQGVDMKILAERGVEIFFTQVFRDSFFHADMHPGNIFVDATDPLNPSYLAIDCAIVGQLDEHDLYYLARNLLAIFQQDYRLVAKLHVECGWVPAETSIAEFESAMRTLCEPIFERPLADISFGHMLISLFRTAGQFEMPIQPQLVLLQKTLLNIEGLGRQLYPDLNLWDTAKPFLERWLADRYAPQSVLRRLQKEAPFWLETLPRLPDLIIKNLQEAPPQPPKSRAFSIKALALTVLGLGLVTTGSGALDQPIIFITGAGLLVLASFSHKHR

SEQ ID NO: 27270 - protein, 449 aa, Zea mays
SYVGPPPNDVVVVPEHTCAQQHQNQSPKLASSSFTSQNATPVLPAFVALLLLVTSIAPTALCHPLQGTNHTFRPNHELLKLRRVRAHLKKINKPPVKTIQSPDGDLIDCVLSHQQPAFDNPKLRGHKILDPPERPKGNHTNGEAERVIESFQLWSDSGEACPEGTVPIRRTTEEDILRASSIQRFGRKPRPVRRDSTGSGHEHAVVFVNGDQYYGAKASINVWAPRVTDEFEFSLSQMWVIAGSFGKDLNTIEAGWQVSPQLYGDNYPRFFTYWTTDAYQTTGCYNLLCSGFIQTNNRIAIGVAISPRSAFNRRQFDIGLMIWKDPKHGHWWLEFGSGLLVGYWPANMFSHLRNHASMVQFGGEIVNTRSRGYHTGTQMGSGNFAEEGFRKAAYFRNLQVVDWDNSLLPLRNIHQLADHSNCYNIRQGTNSVWGTYFYYGGPGRNVRCP

SEQ ID NO: 27271 - protein, 336 aa, Oryza sativa (japonica cultivar-group)
MAPLGDGAAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHYGSISLITEPCRSAHVAAMRAAKSAGILCSYDPNVRLPLWPSEDAARAGILSIWKEADFIKVSDDEVAFLTQGDANDEKNVLSLWFDGLKLLIVTDGEKGCRYFTKDFKGSVPGFSVNTVDTTGAGDAFVGSLLVNVAKDDSIFHNEEKLREALKFSNACGAICTTKKGAIPALPTVAVAQELISKAAN

SEQ ID NO: 27272 - protein, 329 aa, Oryza sativa (indica cultivar-group)
MSPRVRMSVARWLPSSPAHGKTKSRRSSSAVRPTLLVIAVTVIAVLLVAVVFGGAGRWTLSGGGDTSWVSAGARVVINAVSGQQRDGDDPVAAAVEPRNDRLLGGLLSPDFDDSSCLSRYRAGLYRRQSPHAVSPHLVASLRRYESIHRRCGPGTSAYERAVERLRSPPPSNTSDAECRRKAVLVVSLHGAYSERIKDLYYEHGAAGGESVSVFQPTHLDRQRSGEQLHNQKALAEMMLLSFSDVVVTSAASTFGYVGHGLAGLRPWVLMSPLDKKVPDPPCRLAATIEPCFHNPPNYDCRTRAKGDTGKIVRHIRHCEDFENGVQLVD

SEQ ID NO: 27273 - protein, 871 aa, Oryza sativa (indica cultivar-group)
MAAAAAAATVEAASAERASASASPGAGGRERERRPSVAAGQACRAKKGEDFALLKPACERLPAGGAPFSAFALFDGHNGSGAAVYAKENILSNVMGCVPADLSGDEWLAALPRALVAGFVKTDKDFQTRGTTVTFVIIDGYVVTVASVGDSRCVLEAEGTIYHLSADHRFDASEEEVGRVTECGGEVGRLNVVGGAEIGPLRCWPGGLCLSRSIGDQDVGEFIIPVPYVKQIKLSSAGGRIIISSDGVWDALTVDTAFSCARGLPPEAAADQIVKEAIASKGLRDDTTCIVIDIIPPEKISPTVQPAKKAGKGLFKNIFYKKATSDSPCHADKDQCTQPDLVEEVFEDGCPSLSRRLDSEYPVRNMFKLFICAICQVELESGQGISIHEGLSKSGKLRPWDGPFLCHSCQEKKEAMEGKRHSREFIMRDRCLHTILMVKVFKVMCFPRFDDMNKVRRTYAARVADADDSTEENARRVISSFRGCHTEASAMSPRVRMSVARWLPSSPAHGKTKSRRSSSAVRPTLLVIAVTVIAVLLVAVVFGGAGRWTLSGGGDTSWVSAGARVVINAVSGQQRDGDDPVAAAVEPRNDRLLGGLLSPDFDDSSCLSRYRAGLYRRQSPHAVSPHLVASFRRYESIHRRCGPGTSAYERAVERLRSPPPSNTSDAECRYLVWTPLEGLGNRMLTLTSAFLYALLTDRVLLFHHPAGEGLRDLFCEPFPGSTWTLPEGDFPFSGMQGFNARTRESLGNALRRGEGAAKDHPPPPPPWMYVHLRHDYNRNANDPRFFCDDGQDALRRVGWVVLLSDNYFVPGLFLVPRFERALSRMLPRRDAAFHHLGRYLLHPSNTVWGMVARYHASYMACANERVGIQLM

SEQ ID NO: 27274 - protein, 928 aa, Campylobacter upsaliensis RM3195
  misc_feature (174)..(174): Xaa can be any naturally occurring amino acid
  unsure (1)..(928): unsure at all Xaa locations
MKLNRRSFLKMAALSSLATPLLGRSEVLREAKESELSEAFEGSKKVRSVCTACSVGCGIIAEVQNGVWLRQEIAQDHPVSFGGHCCKGSDMIDMVRSHVRLKYPMKKENGEWKRISYEQALSEIGEKLAGYRKENPESVMFIGSAKLSNEQAYYIRKFAAFFGTNNIDHQARIXHSATVAGVANTFGYGAMTNHLGDIQKSKCIFIIGANPAVNHPVGFRHFLKAKEKGAKLIVVDPRFTKSAAKADIYAQIRPGTDIAFMYGMLKIIFDEGLEDIKYLDERVFGIDKIREEAAKWDAKEVENVTGIPEAKLREITFEVAKNKPTTLIWAMGLTQHTVGTSNTRLAPIVQMVLGNIGKFGGGVNILRGHDNVQGASDVACLSENLPGYYPLNEASWRYYAQIWGVDYEWLLGNFVSKEWMHKTGLSLARWWAAALNGKDDNDKIDNAGTALKALIVMGNGITSTAQQAKVKEGLEALELLVLADPFVNEAGIISERKDGIYLLPAATQFETSGSVTATNRSGQWRFKVVEPLYESKEDQEILFELAKKLGFYEDFTKTLRDENGKIVWPENATKEFAGAIRSIGLNGWSAERLKKHTLNWDKFDEITLEGKEGEVKGEYFGLPWPCWSEKHPGSPVLYNTDIEVAKGGMGFRNNFGLEYEGESLLAKNAPLNSPINTGYPQITKENIEKVLNITLSKEEKAKMGPTWALDASNIIATKCMQKGIVPYGNAKARAVVWTFKDQIPLHREPLHSPRNDLVQKYPSFEDQKALYRVDTKFISVQQAKDYSKEFPLNLVTARLVNLNGAGMENRASMYLTRLTPEMFCEINEALAKRENIKKGDMIWVHSPEGTKIKVRVKINNGVAKDMIFLPFHFTGVMQGVDLTHNFPEGTKPYASGESANTVTNYGYDIMCQIPETKGGLCRISKDGV

SEQ ID NO: 27275 - protein, 1292 aa, Arabidopsis thaliana
MQALQSSSLRASPPNPLRLPSNRQSHQLITNARPLRRQQRSFISASASTVSAPKRETDPKKRVVITGMGLVSVFGNDVDAYYEKLLSGESGISLIDRFDASKFPTRFGGQIRGFSSEGYIDGKNERRLDDCLKYCIVAGKKALESANLGGDKLNTIDKRKAGVLVGTGMGGLTVFSEGVQNLIEKGHRRISPFFIPYAITNMGSALLAIDLGLMGPNYSISTACATSNYCFYAAANHIRRGEADMMIAGGTEAAIIPIGLGGFVACRALSQRNDDPQTASRPWDKARDGFVMGEGAGVLVMESLEHAMKRGAPIVAEYLGGAVNCDAHHMTDPRADGLGVSSCIERCLEDAGVSPEEVNYINAHATSTLAGDLAEINAIKKVFKSTSGIKINATKFLLQSMIGHCLGAAGGLEAIATVKAINTGWLHPSINQFNPEQAVDFDTVPNEKKQHEVDVAISNSFGFGGHNSNLGVLYRLEEIKRAKQARRQETRLRHKRDFIQFLDSMYMEEIKALVHQKRHRLIINISDIHHHFREVASRILKNPNEYMQSFCDAATEATRAIDPKYLKEGELVLVGFEGYFVSRVVTPRELLSDFIGSMVCVEGIVTKCKLIIFTLFLCFSSVSFVFYVEDFEPLTHALLSGSLVRPKVVKSVHFCPSTGEFTNRDYRDITSHAGLPTGSVYPTRDDKGNLLVTEYGLCKYKDHQTLSIQEVPENAAPGQLPRSVDVIAEDDLVDSCKPGDRVSVFGIYKALPGKSKGSVNGVFRTILIANNIALLNKEANAPIYTKQDLDNIKNIARRDDAFDLLARSLAPSIYGHAWIKKAVVLLMLGGVEKNLKNGTHLRGDINMMMVGDPSVTKSQLLRAIMNIAPLAISTTGRGSSGVGLTAAVTSDQETGERRLEAGAMVLADKGIVCIDEFDKMNDQDRVAIHEVMEQQTVTIAKAGIHASLNARCSVVAAANPIYGTYDRSLTPTKNIGLPDSLLSRFDLLFIVLDQMDAGIDSMISEHVLRMHRYKNDRGEAGPDGSLPYAREDNAESEMFVKYNQTLHGKKKRGQTHDKTLTIKFLKKYIHYAKHRITPKLTDEASERIAEAYADLRNAGSDTKTGGTLPITARTLETIIRLATAHAKMKLSSEVTKADAEAALKLMNFAIYHQELTEMDDREQEERQREQAEQERTPSGRRGNQRRNNEDGAENDTANVDSETADPMEVDEPSVEQFSGTVSAARIETFERVFGQHMRTHRLDDISIADIETVVNNNGVGASRYSADEIMALLEKLQDDNKVMISDGKVHII

SEQ ID NO: 27276 - protein, 385 aa, Nocardioides sp. JS614
MLAHRLEGIPPTIFTEMSALAVRTRSVNLGQGFPDVDGPPAVIARAVAALEGGHNQYAPGPGVPALRQAIARHQLRHYGVELDPDAQVVVTTGCTEGIAAALLGLVDPGDEVVVLEPYYDSYTAMIQMAGGVRRPVTLRAPGFRLDPDELRAAVTPRTRFVLLNSPHNPTGTVLTRAELQAVADVAIEHDLVVVTDEVYEHLVYDDHEHVPLATLPGMFERTLTLSSAGKSYSFTGWKVGWATGPAELVGAVLAAKQWLTFTSGSPLQPAVAYALDEEPGFPTELAAELRAKRDLLCDGLARVGLDVRVPEGTYFASTDISALGWPDARSFCLALPERAGVVAIPTQAFYDSDAGRHLVRWAFCKDSEVIEEGLRRLAAADLTAS

SEQ ID NO: 27277 - protein, 291 aa, Bifidobacterium longum DJO10A
MTQNRAELNRNLAQMLKGGVIMDVTTPEQAKIAQDAGACAVMALERIPADIRAAGGVSRMSDPAMIKGIQEAVSIPVMAKVRIGHIAEARILQAIDIDYIDESEVLSPADDVYHIDKNQFDVPFVCGAKNLGEALRRIAEGAAMIRTKGEPGTGDVIQAVRHMRTMNKQIRELVALRDDEVYEAAKQLAVPYDLAKYVHDNGRLPVVNFAAGGVATPADAALMMELGAEGVFVGSGIFKSGDPAKRAAAIVKATANWQDADLLAKLSENLGEAMVGINEDEIQTIMAARGE

SEQ ID NO: 27278 - protein, 172 aa, Triticum aestivum
  misc_feature (164)..(164): Xaa can be any naturally occurring amino acid
  misc_feature (170)..(170): Xaa can be any naturally occurring amino acid
  unsure (1)..(172): unsure at all Xaa locations
MGAANSREDLDLTSSSGEEEEEDADEEYDPGSASGAKQRQDDPLRATTPASIEFLDAKLRALDLKYKQPDNAARLYLHVGGASADARWVPAERRATYAFLDKAVAVDDDDYYDDERRGRRSLSSASSRGPRWVLEVDPGRRVSAPVGQELQLKALPGQRRADFXAAGSVXGA

SEQ ID NO: 27279 - protein, 443 aa, Marinobacter sp. ELB17
MTTNASEQLQDSPHDVNSMPPLGRAIPLGIQHVLAMFVGNVTVPIIIAGAADLPADQTAFMVQAAMFVAGVATLLQSLGFGPIGARLPIVMGTSFGFVPVLIPIAIGLGVPAALGAALCGGVAMALVGLFLPRFRFLFPPVVTGTFVIMLGILLMPVGLAYAGGGFGAADFGAAHHTGLAALVLFVTIGLHQFARGIWCEVAPLVGLIIGYVVATAFGLVDFSKVGSADWFTLPTPLAIGLEFHLAAIIPVVLLSLVTVAESIGDIVGTTAGGLNREPTKKELSGGVMADGIASVFAAVFNAFPQISFSQNVGMVALTGVVSRYVVAIGGGFLVIAGLLPKLGNIISSIPNAVLGGAVLLMFGMIASAGIKMLSAVSFDKRNMVIIGASLTIAVGLPAQQGLYAELSANLQAMLESGLIPGAITAILLNLILPHGERPLAENL

SEQ ID NO: 27280 - protein, 700 aa, Chromobacterium violaceum ATCC 12472
MQRLACGLALTVIGAAVLSACGSAGGSASTSGVVTGSYFRHAKVCLDRNGNGRCDSTEISTYTDDNGAFSLNGQGDVVVEVGTDAVRYDPDAKTATPVTDPLVFRAPASAPGVVSSLSTEVADLMDGGMDLASARGAVAARVGVPADKLLGDHNKESDPDVKAALKAAINQNIDAIAGAMKEAGAGGDVKASLHKRMALSDIKNVVVIYAENRGFDNLYGLFPGANGVPGVNPASKGGYVAQKDFDNSVLPALPPTWGGLTAAGQPVTLSQAQTIGFANKPFQIDDPNGLNGTGVAVPQSVVTRDLVHRFYNNQMQINGGANDKFAAYSDAGSLSMGYYDGSKMAMWKLAQQYTLADNFFMGAFGGSFLNHQYLVCACAPQYPNADASPAKGSISAIDVDGNGNFIRLTPAANAPASVLSGPAKYLNDGNLTPKDAAGMYYAVNTMQPAFQPSGNAPASGDASGLYADPAKANTLPAQTQATIADRLDAKKVSWAWYAGGWAQSTADRSKIYNGSVPNFQAHHQPFNYYAGFDPSKQAAYRGQHLKDFDQDFLGAAAAGTLPQVAFYKPQGNLNQHAGYASVADGDAHIASVIAKLQQSPQWKNMLVVVTYDENGGFYDHAAVPKGDRWGPGTRIPAMLISPFAKKGYVDHTQYDTASILRFLTRRFGLQPLPGVTARDVALVRNGGKPMGDFTSALTFN

SEQ ID NO: 27281 - protein, 313 aa, Zea mays
MKLEVMPKPKQRVLEAQQREEAMEMSGLDLWKHEKPPRICPLPPSLPPPPPAFDEAALVPPLNFAVVDDGIFRSGFPGTANFRFLKSLNLRSIVYLCPEPYPGTNTEFLEKNGIRLHQFGIEGRKPNLSWDHYVATAQRFKTDCRYLSANGRAKQHTRFYLEMYRFIFSYIMIFEMYFHTNSGYPYVMSLCKNWISKHGRFEQLFLIRKHDLKGNIYLLDLFEPFVNIPDDKIREALKVVLDPRNQPLLIHCKRGKHRTGCVVGCLRKLQEWCLSSVLDEYHRFAAAKARITDQRFMELFDVSSLKHLTPSHC

SEQ ID NO: 27282 - protein, 144 aa, Glycine max
  misc_feature (18)..(18): Xaa can be any naturally occurring amino acid
  misc_feature (136)..(136): Xaa can be any naturally occurring amino acid
  unsure (1)..(144): unsure at all Xaa locations
LSRLSLITVVDEKTTMAXRLMLVAALLCAAAAAAAAQQANNVRATYHYYRPAQNNWDLGAPAVSAYCATWDASKPLSWRSKYGWTAFCGPAGAHGQAACGKCLRVTNPATGAQVTARIVDQCANGGLDLDWDTVFXKIDTNGVG

SEQ ID NO: 27283 - protein, 476 aa, Synechocystis sp.
MARTPQEVLKWIQDENIKIIDLKFIDTPGIWQHCSFYYDQLDENSFTEGIPFDGSSIRGWKAINESDMCMVPDPNTATIDPFCKEPTLSMICSIKEPRTGEWYNRDPRTIAAKAVEYLRGTGIADTVYFGPEAEFFLFDDIRFGPNGNSSYYFADSVEGRWNTGREEEGGNLGYKPGYKEGYFPVAPTDTAQDIRTEMLLTMAGLCVPIEKHHHEVASGGQNELGIKFDKFDKLVNSADNLIIYKYVIKNVAKKYGKTVTFMPKPIFNDNGSGMHVHQSLWKDGQPLFAGDKYAGFSQMGLWYIGGILKHAPALLAFTNPTTNSYKRLVPGFEAPVNLAYSQGNRSASVRIPLSGGNPKANRLEFRCPDATSNPYLAFAAIVCAGIDGIKNQIDPGEPLDVDIYDLSPEELAKIPSTPGSLEAALEALEKDHQFLTGTGVFSPDFVESWIEYKLDNEVNPMRLRPHPYEFSLYYDC

SEQ ID NO: 27284 - protein, 642 aa, Penicillium marneffei
MSLKKQQQQSDFSAAPARRPPTLQSYHTSPDPRGKQILRQSASFTALNNPRMDTALPQIQDAPSNSKRNSDEGFGTKPRRKNTFSSFVNSVLGSPRNIKISAPENPVHVTHVGYDNQTGQFTGLPKDWQRMLQASGISKKEQEQHPQTMVDIMRFYERNAAGAGDEEVWHKFDNAILRQGEYPDGMSPASATSPRFPQNHEGSFENPRAAPPPPKPSQSSPVPVLSSTIVPNRVAPKPPTVGLIPSRPPPQPPVVSNRAPAARPANEPVTTPPIPENEPVFVNAPPVVPSAIQSPVQYQQQQERAMAAAQQAIIDKQLDRSRSQPAAAVARPRPRTRQSTAFDVRAKLQAICTPGDPTKKYYNLNKIGQGASGGVFTAYETNTNKCVAIKQMNLDLQPKKDLIINEILVMKDSKHKNIVNFLDSYLHGLDLWVVMEYMEGGSLTDVVTFNIMSEGQIAAVCRETLSGLQHLHSKGVIHRDIKSDNILLSMDGEIKLTDFGFCAQINDSQNKRNTMVGTPYWMAPEVVTRKEYGRKVDIWSLGIMAIEMIEGEPPYLTESPLRALYLIATNGTPKIKDEQNLSPVFRDFLHLALRVDPEKRASAHDLLKHPFMSICEPLNSLAPLVKSARISRAQEKAQKGGA

SEQ ID NO: 27285 - protein, 522 aa, Xylella fastidiosa 9a5c
MTPNIHHDKILILDFGAQYTQLIARRIREIGVYCEVWPWDHSPEEILSFGAKGIILSGGPESTTSPGAPAAPQHVFDSDLPILGICYGMQTMAVHLGGATEAADKREFGHASVQVIYPDTLFSGLSDHPSEFRLDVWMSHGDHVSRVPPGFTITAATDRIPIAAMSREDKRWYGVQFHPEVTHTLQGQALLRRFVVDICGCQMLWTAANIIEDQIAHVRERVGCDEVILGLSGGVDSSVVAALLQKAIGSQLTCVFVDTGLLRWGEGDQVMAMFAEHMGVNVVRINAASRYFDALQGVYDPEAKRKIIGNLFIQIFEEEASKRKQAKWLAQGTIYPDVIESAGSKTGKAHVIKSHHNVGGLPEQMTLGMVEPLRELFKDEVRRLGVALGLPHAMVYRHPFPGPGLGVRILGEVKPEYAELLAKADAIFIDELHQADLYDKVSQAFAVFLPVKSVGVVGDARAYEWVIALRAVETVDFMTAQWAPLPYDFLSTVSNRIINELRGVSRVVYDISGKPPATIEWE

SEQ ID NO: 27286 - protein, 284 aa, Ostreococcus tauri
  misc_feature (1)..(1): Xaa can be any naturally occurring amino acid
  unsure (1)..(284): unsure at all Xaa locations
XEIPDGEFRTSKRLVPALGVVNTGMWPGTKVCLKQLHKHLNADEVAQAEFRLELKIMQQLHHPHIVQFLGTTTSTEGLTSIVSEFMGGGSLEQVFRNEELLSLKLATQMALDCARGMAYLHGRSPLPVIHRDLKPGNLMLTTNRTLKIGDFGLSKTLSVRNKLPQEMSQAFNMTGETGSYRYMAPEVFRHEFYGPAVDVYAASMIYYQLFSFQQPFSGRNPVDACRAARLHAPRSRRLVTRMWDPIVKKRPDFTEIIQILTPVAARYAAQPDASAAGPACCVVQ

SEQ ID NO: 27287 - protein, 577 aa, Vibrio cholerae O1 biovar eltor str. N16961
MSANQNPSVQEVLGEVLGPWSDNERLKRESHFLRGTIEQDLQDRITGGFTADNFQLIRFHGMYQQDDRDIRAERSKQKLEPLHNVMLRARMPGGIITPHQWLAIDKFATEHTLYGSIRLTTRQTFQFHGVLKPNIKLMHQTLNSIGIDSIATAGDVNRNVLCTSNPVESELHLQAYEWAKKISEHLLPKTRAYAEIWLDGEKIEGPDEEPILGSNYLPRKFKTTVVIPPHNDVDVHANDLNFVAIGENGQLVGFNVLVGGGLAMTHGDTSTYPRRADDFGFIPLEKTLEVAAAVVSTQRDWGNRSNRKNAKTKYTLDRVGVEVFKAEVEKRAGITFAPSRAYEFTSRGDRIGWVEGIDGKHHLTLFIENGRILDFPGKPLKTGVAEIAKVHQGDFRMTANQNLIVAGVPADQKPHIEQLAREHGLIDDGVSEQRINSMACVAFPTCPLAMAEAERFLPSFVTEVEGILAKHALPKEENIILRVTGCPNGCGRAMLAEIGLVGKAPGRYNLHLGGNRNGTRIPKMYKENITDTQILQEIDELVGRWASERLDGEGFGDFTIRAGIIEEVIISKRDFYA

SEQ ID NO: 27288 - protein, 194 aa, Listeria monocytogenes str. 4b F2365
MRTATKTRITAETSIELSINLDSQAESIISTGVGFLDHMLTLFAKHSRITLNVKADGDTYIDAHHTVEDIGITLGLCLKEALADKASINRYGSAYVPMDESLGFCALDLSGRSYLVFDAELTNPKLGDFDTELVEEFFQAVAFNTEMNLHLRVLYGKNTHHKIEALFKAFGRALREAITINPEIKGVNSTKGVL

SEQ ID NO: 27289 - protein, 464 aa, Listeria monocytogenes str. 4b F2365
MTYKFPENFWWGSAASGPQTEGAANVDGRKPSIWDHWYKIEPGRFFNDVGPTNTSNFYYQYKEDIALMKQTGHNSFRTSIQWSRLIPDGIGEVNPKAVDFYNRVIDEMLANDVEPFMNLYHFDMPMSMQEKGGFESREVVDAYATFAKTCFELFGDRVKHWFTFNEPIVPVEAGYLYDMHYPNVVDFKRATQVAYHTTLAHALAVKEFHALEIPEGQIGIILNLTPSYPRSQNPADLKAAHIADLIFNRSFLDPVTKGEFPADLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGSNCHGYHLWTFMDCWSWANAYKNRYGLVEVDLDNNFKRTIKASGHWYKELSENNGFED

SEQ ID NO: 27290 - protein, 396 aa, Nocardioides sp. JS614
MSTTDGFRADWAQKDFYAELGVTKNASAEEIKKAYRKLARANHPDSNPGDSADSKAKHDKFKAVAEAYDVIGDPEKRKKYDEMRELYGSGAFRGGFGGGGQGGGFNLDDLLRDRASGGGGGFGDMFGDLFGGGFGRGRQHQRPRAQKGQDVETTATISFTDAIDGVTISLRLTSDAPCPDCHGTGGKPGTKPHVCPECDGAGFVVSSAGGAFSINETCPRCGGRQLVYDEACPTCHGSGRGTSARSIQARIPAGVRDGQRIRLRGKGGAGENGGPAGDLFVTVKVSPHRLFGRKGDNLTLDVPVSFDELALGADLKIPTLGGAPVTLKVPAGTPNGRTFRVRGRGAPKSDGSRGDLLATVEVQVPAVLDTAAREAVQAYRDASAGKPLRSKLFEEA

SEQ ID NO: 27291 - protein, 583 aa, Zea mays
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKETDIVDWFIPVVKRLAAGEWFTARVSSCGLFHIAYPSASDQLKTELRTIYGQLCQDDMPMVRRAAASNLGKFAATVEQNHLKTEIMSIFDDLTQDDQDSVRLLAVEGCAALGKLLEPQDCVAHILPVIVNFSQDKSWRVRYMVANQLYELCEAVGPEPTRADLVPAYVRLLRDNEAEVRIAAAGKVTKFCRILNPQLSVQHILPCVKELSSDSSQHVRSALASVIMGMAPVLGKDATIEQLVPIFLSLLKDEFPDVRLNIISKLDQVNQVIGIDLLSQSLLPAIVELAEDRHWRVRLAIIEYIPLLASQLGVGFFDDKLGALCMQWLEDKVFSIRDAAANNLKRLAEEFGPEWAMQHIIPQVLEKINNPHYLYRMTILQAISLLAPVMGAEITCQKLLPVVINSSKDRVPNIKFNVAKVLQSLVPILDQSTVKPCLVELSEDPDVDVRYYANQALQACDQMMVSS

SEQ ID NO: 27292 - protein, 519 aa, Zea mays
MIKQFLGRLPKKPSKSGDKDPIGRPSPSVSHQPLGPRAGDRATNLSSHPPVISSSGLSYGSGMHVGNAYTKAHVNGDSAASAFRSLPSFKDVPNTEKQNLFNEKLNLCCAQFDFTDPTKNIKEKEIKRQTLVELVDYIASASGKFSEASMQEITKMVSANLFRTLSTPPRDNKVDGFDVDEEEPVMDPAWPHLQIVYELFLRFIQSQETDAKLAKRYIDHSFVLRLLDLFDSEDPREREYLKMILHRVYGKFMVHRPYIRKAINNIFYQFIYETEKHNGIAELLEILGSIINGFALPLKEEHKLFLVRALIPLHKPKCIAMYHQQLSYCITQFAEKDCKLADTVIRGLLKYWPITNSSKEVLFLGELEEILEATQPAEFQKCMVPLFRQIARCLNSSHFQVAERALFLWNNDHIESLIKQNSRVILPIIFPALERNASGHWNQAVQSLTLNVRKLFSDNDPGLFTESLRKYEEEKAREKEVKSKQEATWRRLEEMASAKATSGAAVLVSRPLSRQSSAV

SEQ ID NO: 27293 - protein, 1063 aa, Gibberella zeae PH-1
MKERDTQNMNGTQIELDSLPTTDSIKHEPPILYGAGNWINGFRRAEPRPGYLPTDAPERFYDLRAANAKTANTALARELKGRHLQMIAFGGSIGTGLFVASGGSLYRGGPASLLLSYVLIGGMQYCTMQSLGELCVAFPIAGSFSAFSTRFLDPSWGFAMGWNYCLQWLFVLPLEIIAGAFTIGYWDETIDRSVFVSVFLLTIVAINLFGVKTYGEAEFIFSIIKITAIVGFILLAIVINIAGEPEGHYIGGMYWRNPGAFKNGFKGFCSVLVTSAFSFTGTELIGLAAAETANPRKSLPTAIKQVFWRIMIFYLVALLLVGLLVPSDDSRLVGGDNVADATASPFVIAIEKAGTSLLPGIMNAIILIAVISVGNSAVFGSSRTLAALAEQSHAPHIFAYVDRQGRPLMAILFASCIGLLAFLADVKYHDAIFNWLLSISALSTLFTWGSICLCYIRFRAAWSHNAHTIEQLPFKSNVGVAGAWVALIGYILVLLSQIWIAASPVYAPDIVDGASGVAQNFFLKVLAIPIILLFYICHKAFVVQYMGDVHMKAMEASYATILWGVALAVVGFLSHRIIAIALRPHSSRFNGLPRPKGQQPFAGHALRILRGGGPNDVYLQWTRQWPDAPFIRCLSWLNEEILLVNSLEACREVLQTNAYFFAKPGFFHTLVGEFLGLGLLFSVGEQHKRLRRIIAGPLSRPSIRKLFPTFVTYSQKLNREIGEALERSKSGIVEIEDLIIRVTLDIIGVSLLGRELRDFRSESSPLSFEQCYNAILAQPLAGQIISFINPFIPLRWLPVSANLNFIRAKSALKTMMEGLIEQRTAEVGAAKLMNEDDKLSDDLLTRMIEASAEESQKLSKEELIDITMQVIAAGHETTASALVWTAYSLAKDPASQQSLRAEIHSLGTEMSAKGIDELPFLDNVIREAMRVHSPTLIIPWEAQKDMTIAGTHIPKGTTVQIVPAMIQLNPEIWGSDADVFRPGRWEDMGGNASSPYAMETFSNGPRMCPGKALALLNMKVLLVGLIRDFEMEIVDDGKEVELRNPSLTLKAKSLIQFKMRKVS

SEQ ID NO: 27294 - protein, 380 aa, Gibberella zeae PH-1
MATDRVKASVLHGEKDLRLEERELPKPSSNEVQVAVQSTGLCGSDLHYYNHFRNGDIIVREPLTLGHESAGTVVAVGSEVTHLKPGDHVALEVGLPCETCELCDEGRYNICRGMKFRSSAKANPHAQGTLQERINHPAKWCHKMPEHVTLDLGALVEPLSVAMHARDRASLPKGSTVLVLGAGAVGLLAAAVAKADQAKTVIIADILKDRLDFATSNGFADASVVVPMERPQTIEDKLAFAQKVAAMVKETQIDGEAIGEVTAVYECTGVETCVQTAIYATKPGGKVMIIGMGTPVLTIPMSAAALREVDIVGVFRYANTYKEIIELLSNPPANMPDVSRLVTQRYSGMDKIEEAFKMAGKVRDEQGNLVIKVVVDFSEK

SEQ ID NO: 27295 - protein, 432 aa, Enterococcus faecalis V583
MATKEIKMPHLGESVTEAAIVQWLVKPGDSVKRYDPLMEVVSDKVTTEVPSDFDGVVKEFLISLDTDVPIGTAVMTLETEETTEETEVATLAPVKEASAEQAQEHETAETTSTATSHQKNNGRYSPAVLKIAQEKKIDLTQVTGTGRDGRITRKDVTNFTPTQARTPEKTVSPGTSPSISEEPVASQNESAATASPTETSTDKIVSADPVRKAIAKKMVQSVNEIPHAWLMVEADVTNLVQLRNSLKDEFKQQEGLSLSFFPFFAKAVIQALKKNPKINTSWDDGSIIYHKDVNLSIAVTTDEHLYVPVIQQADNYSIAGLAKEINRLAQEVRQGTLASKEMQGGTFTLNNTGTLGSVQSMGIINHPQAAILQVESINKRLVPTADGGFKVADMVNLCLSIDHRILDGQQAGKFLRDVKDNLAKYNADTDIY

SEQ ID NO: 27296 - protein, 328 aa, Enterococcus faecalis V583
MAEMTYLEAINLGISEEMARDEKVVIFGEDVGGDKGGVFGVTKGLAAKYGDERCFNTPLTEGLIGGLAVGLGLMGYRAIGEFQFADYILPATNQLLSEARTMRYRTKGDWTAPIVYRTPYGGGVRGGLYHSQSTEKVFCGQPGLRVVTPSNPYDAKGMIKAAIRSDDPVIFYEHKRLYRLLKDEVPADDYIVPIDKANVVRTGSDLTVISYGMTLQLALAAAEKLAAEGIDAEIVDVRSLYPLDRETLVAAAKKTGKVLLVTEDNKEGSVMSEIAAMISEDALFDLDAPIQRLAGPDCPSMPYALPLEREFLINEEQVLAAMKELAEF

SEQ ID NO: 27297 - protein, 469 aa, Enterococcus faecalis V583
MAEQTDLLILGGGTGGYVAAIRAAQKGLNVTIVEKYKLGGTCLHKGCIPTKALLRSAEVFDTLKQAASFGIETEAASIDFSKIQQRKEGIIEQLHKGVEGLCKKNKIKILAGEGAILGPSIFSPVSGAVAVTFNDPTREEEIIVPKNVIIATGSSSKTLPNLPLDEEFILSSDGMLELEELPESIAIIGGGVIGVEWASLLNSLGVNVTIIEFLDRLLINESATISKELKKRLEQRGINILLGSKVQEAKVTGQKVQVEVAGQETLTVDKVMVAIGRQPNINKLGLQNTSVKYTDKGIEVNEFYQTTEGHIYAIGDCIDTLQLAHVAMKEGELAVQHLLGETVEPLNYTNVPRGVYTNPEIASVGYTRETLPAEKEVVIGTFNFNGNGKSLVYGETDGFIEVIRDKKTDDLLGVSMIGPHVTDLIAEASTAMYLDAAPIEIGEAIHAHPTMTEVLQEAALDTYGLAIHK

SEQ ID NO: 27298 - protein, 141 aa, Chromobacterium violaceum ATCC 12472
MAIERTLSIVKPDAVAKNVIGKIYDRFESAGLKIVAAKMKQLSRAEAEGFYAVHKERPFFKDLVDFMVSGPVMIQALEGENAVLKNRELMGATDPKKAEAGTIRADFAESIDANAVHGSDSVENAAIEVAYFFAASEISSR

SEQ ID NO: 27299 - protein, 207 aa, Vibrio sp. 12A10
VNGLFATGDYLVPLATTEAALVASYNRGSKLITACGGASAMLLNEGVTRTPGFAFQGLVEAGQFVAWAVTQYDQFKTLAESTTSHGKLTDININIEGNHVYLVFEFLTGDASGQNMVTIATNAVFEYIIENTPVKPDHAFLDGNLSGDKKANTQTLRSVRGKKVTAEVNISAELVAKYLHTTPEKMVQFGQMTTVGGALSGTIGINA

SEQ ID NO: 27300 - protein, 290 aa, Streptococcus pneumoniae R6
MKVINQTLLEKVIIERSRSSHKGDYGRLLLLGGTYPYGGAIIMAALAAVKNGAGLVTVGTDRENIPALHSHLPEAMAFALQDKQLLKEQLEKAEVVLLGPGLGDNAFGEDLVKQVFAGLKQNQILIVDGGALTILARTSLSFPSSQLILTPHQKEWEKLSGITIEKQKEDTTASALTSFPKGTILVEKGPATRVWQAGQSDYYQLQVGGPYQATGGMGDTLAGMIAGFVGQFRQASLYERVAVATHLHSAIAQELSQENYVVLPTEISRYLPKIMKIICQQERVSKDKLV

SEQ ID NO: 27301 - protein, 320 aa, Myxococcus xanthus DK 1622
MSPTQRRIPVVNLSHYRTGTPQERARFVQVFGDGIKEFGFVTVEGHGIDDGLIRRTYTDVERFFALPEATKAQYAQAGHGGQRGYIGYGQEHAKNRQVGDLKEFWHVGRELPPDHKYHALYGPNVWPTEVSTFREHTLSLFNALDGAAGVMLQALAEYFGVARDTFSGMATDGNSVLRLIHYPPLKERFIPGGVRAAEHEDINLITLLCEGTASGLELLTRDGEWLPVDTLRGQIVVDSGDMLSRVTNEIIPATTHRVVNPRSKEEDTVRYSMPFFVHPYADCVLQALPCTQTADTPARHAPITADAFLKQRLRENGLLK

SEQ ID NO: 27302 - protein, 214 aa, Vibrio sp. 12G06
GISGPLRVNGLFATGDYLVPLATTEAALVASYNRGSKLITACGGASAMLLNEGVTRTPGFAFQGLVEAGQFVAWAVTQYDQFKTLAESTTSHGKLTDININIEGNHVYLVFEFLTGDASGQNMVTIATNAVFEYIIENTPVKPDHAFLDGNLSGDKKANTQTLRSVRGKKVTAEVNISAELVAKYLHTTPEKMVQFGQMTTVGGALSGTIGINA

SEQ ID NO: 27303 - protein, 246 aa, Streptococcus pneumoniae R6
MNKKRFHSKIRTENDGGKSVENLKKMAGIKAAEFVSDGMVVGLGTGSTAYYFVEEIGRRIKEEGLQITAVTTSSVTTKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 27304 - protein, 156 aa, Cryptococcus neoformans var. neoformans JEC21
MFARTLRLAPTLLKTPFAHTLTTTSRMSAPYQVIATDKAPAAIGPYVQAVTYNGLIYSSGAIPLDPQSMEVVPGGIEAQATQVFKNISGLLTASGITPAQVLKTTCFLKDMNDFVAFNKIYAEFFGETKPARSCVEVARLPKDVLVEIEFIAVSKQ

SEQ ID NO: 27305 - protein, 335 aa, Shewanella oneidensis MR-1
MSKRTITVIPGDGIGPSIIDSALKILDKAGCDFEYEFADAGLAALEKQGELLPQRTLELIEKNRITLKGPLTTPVGEGFTSINVTLRKKFGLYANVRPVLSFKGTQARYENIDIITVRENTEGMYSGHGQKVSEDGSTAEATSIVTRQGAEQIATFAYELARKESRKKVTIVHKANIMKSTSGLFLKVAREVSLRYPDIKTEEMIVDATCMKLVMNPENFDVIVTTNLFGDILSDLCAGLVGGLGMAPGANIGRDAAIFEAVHGSAPDIAGKNLANPTSVILASIQMLEYLGMADKAAPIRKAVSAVIEEGDRTTRDLGGTHGTTDFTQAVLDRL

SEQ ID NO: 27306 - protein, 139 aa, Vibrio sp. 14D05
VTQYDQFKILAESTTSHGKLTDININIEGNHVYLVFEFLTGDASGQNMVTIATNAVFEYIIENTPVKPDHAFLDGNLSGDKKANTQTLRSVRGKKVTAEVNISAELVAKYLHTTPEKMVQFGQMTTVGGALSGTIGINA

SEQ ID NO: 27307 - protein, 368 aa, Oryza sativa (japonica cultivar-group)
MPSGEEADLEAFQAPFRGEPRRAPAWGGEEILSVAWIRRLLEAFILCQEEFRVFVAQARRRGALPAAGEKLVVEFHERAVKALDVCNAARDGVDQVRRWERLADIAASVLLAPGEIHEGQLRRARKALSDLSVLLVDDTAASGSGGVASFLASHRNRSFGRARASPSRASFAGATSSSHFRSLSWSVSRAWSASRQLQAIGAGLAAPRAHEAGLAAPVYAMGCVLHLVAWALVAAVPCPDRSTALQAHHLPAAPARAAFPWAPPLLTLQERLAEEGKRKDRRNSCGLLKEIHVLEKSTQKLTDAIDAAPIPLFGDREADVREAAAELAAVCAAMRDGLEPLERQVREVFHRIVRSRVEGLDSSMRNAD

SEQ ID NO: 27308 - protein, 153 aa, Vibrio sp. 12F04
GQFVGWVTTQYDVFKSLAQSTTAHGQLHDINVTLEGNHVYLVFEYLTGDASGQNMVTIATNAVFNFIMQHSPIAPEYAFLDGNLSGDKKANSHVLRSVRGKKVTAEVHLTADLVRKYLHTTPEKMVQFGHMTTLGGALSGSIGVNAHYANALA

SEQ ID NO: 27309 - protein, 409 aa, Oryza sativa (indica cultivar-group)
MEYGAATRGALLAAAPLAGARRSRLPLSPPPSPPSIQIQNRLYSMSSLPLKARGVRRCEASLASDYTKASEVADLDWENLGFGIVQTDYMYITKCGQDGNFSEGEMIPFGPIALNPSSGVLNYGQGLFEGLKAYRTTDDSILLFRPEENALRMRTGAERMCMPAPSVEQFVDAVKQTVLANKRWVPPTGKGSLYIRPLLMGSGAVLGLAPAPEYTFIIFVSPVGNYFKEGLAPINLIVEDKFHRATPGGTGSVKTIGNYASVLMAQKIAKEKGYSDVLYLDAVHKKYLEEVSSCNIFVVKGNVISTPAVKGTILPGITRKSIIDVALSKGFQVEERLVSVDELLEADEVFCTGTAVVVSPVGSITYQGKRVEYAGNKGVGVVSQQLYTSLTSLQMGQAEDWLGWTVQLS

SEQ ID NO: 27310 - protein, 269 aa, Myxococcus xanthus DK 1622
MRAMRGKTVVVTGASAGIGEALAVVLAGRGANLVLAARNEEALQRVKARCESAGGRAVVVPTDVGDAEACRHLVERAVEAFGGVDVLVNNAGVTMDARVDEVKDLSLFDRLMRINYLGAVYCTHHALPHLKARRGLVVAVSSLTGKTGVPNRSGYAASKHAMHGFFDSLRIELRGTGVDVTVVCPGFVATNIRDSALGADGQPVRQSKHDESAGNMDVDTCVAIILRAMERREREVVMTTKARVAQFLKLVAPGVVDRITAKTIQDRRR

SEQ ID NO: 27311 - protein, 482 aa, Rhodococcus sp. RHA1
MTDYDKLYIGGKWVAPATDQVLEVFSPATEERVGSCPVASPADIDDAVATARRAFDEGPWPQTTPAERGEILAKAAKLIEERGDALNALISSEMGQPPAMVGMMQQTPSLATLNFYAGLANEFEWEQTRTGAFGQTKVLREPVGVVAAVLAWNVPLFLAVNKLSPALLAGCTVLLKPAPESPLSTHLLAEIFAEAGVPEGVISVLPGGAETGEYLVSHPGIDKITFTGSSPVGRKIGAIAAQNLKRCSLELGGKSAAIILEDADLAATMPMLVMSGLMNTGQACVAQTRILAPRSRYDEVLDALVAGAGFMTVGDPSDPAAQLGPLISEKQRDRVEGYIAKGKEQGARVVLGGGRPEGLDKGWYVEPTIFADVDNSMTIAREEIFGPVLSVIPYDSEDEAIKIANDSDYGLAGSVYTTDIDHGLAVAKQIRTGTYAINWYAFDPGSPFGGYKASGIGRENGPEGLEAFCETKSVLMPPGYTG

SEQ ID NO: 27312 - protein, 353 aa, Zea mays
MESGSTFYGGEGLSIDPKWFIDPKLLFVGPRIGEGAHAKVYEGKYKNQNVAIKIVHKGDTPEEMTKREGRFLREVTMLSRVQHKNLVKFIGACLEPVMVVVTELLVGGSLRKYLVSLRPRSLEPRVAVGFALDIARAMECLHAHGIIHRDLKPENLLLTADQRTVKLVDLGLAREETLTEMMTAETGTYRWMAPELYSTVTLRHGEKKHYNHKVDVYSFAIVLWELLHNKLPFEGMSNLQAAYAAAFKNIRPSADNLPEELSEILTSCWKEDPNDRPNFTQIIQMLLHYLSTLSPQETLAGPRRTFSSENTILPPESPGTSSLMASRGDLGDTPKGKKEDKPRGFFFCFSECY

SEQ ID NO: 27313 - protein, 151 aa, Yarrowia lipolytica CLIB122
MSTTARRRLMRDFKRMQQDPPQGVSASPVADNVLTWNAVIIGPAETPFEDGTFRMVLQFDEQYPNKPPAVKFVSQMFHPNVYSSGELCLDILQNRWSPTYDVAAILTSVQSLLNDPNTSSPANVEASMLYKDHRQQYEKRVRDTVEASWTD

SEQ ID NO: 27314 - protein, 453 aa, Campylobacter upsaliensis RM3195
MSECPFFPKPYKNKASTLLTFLLKRRSWLDGLYERSYQMQTGYVKMPNFDLYVINDTKEVKRIMVDEVREFPKSELLHRLLSPLLGESIFTTNGEVWHKQRELLKPSFELTRISKVFNLMSEAVADLMMRFEKYPDNSYIEVDEMMTFVTADVIFRTIMSSKLNEVQGRQILEAFATFQEESVKTAMRGMFYFPKWLSYLLGDRKRAKAGELIRKVLSDIIKPRYEANLEKSDYGDILSSLLLVVDAKTNQRFSFEEILDQVAMLFLAGHETTASSLTWTLYLLSLYPKEQERAYNEICEVLQDSKEIKIAHLRQFKFLTNVFKESLRLYPPVGFFAREAKKDTQVRNKLIKQGSGVVIAPWLIHRHELFWQNPHGFDPSRFEREYKKEAYLPFGMGERICIGQGFAMQEAILILANILKTYKLELKEDFVPDVVGRLTIRSLNGMWIKFSKR

SEQ ID NO: 27315 - protein, 1425 aa, Aspergillus nidulans FGSC A4
MSTLTVGDTALPRESRETMVSIRDSDSTTTVLGEDSASTTDPNVSRADGWALMPQVKEQNEREAESGFKRRELGVTWQNLSVEVVSADAAVQENFLSQFNVPKLARESRNKPPLRTILDNSHGCVKPGEMLLVLGRPGSGCTTLLKMLANQRLGYKAVQGDVRYGSMTAKEAEQYRGQIVMNTEEELFFPSLTVGETMDFATRLKVPFRLPNGVESPEAYREEYKKFLLQSMGISHTVDTKVGNEFIRGVSGGERKRVSIIECLATRASVFCWDNSTRGLDASTALEWTKAIRAMTDVLGLSTIVTLYQAGNGIYDLFDKVLVLDEGKQIYYGPMTQARPYMEALGFVCREGSNVADFLTGVTVPTERKIRSGFEARFPRNADAMLEEYNKSAVKADMISEYDYPDSEYAKLRTEDFKQAIAEEKAKQLPKSSPFTVDFMNQVKICVTRQYQILWGDKATFIIKQVSTLIQALIAGSLFYDAPNNSGGLFVKSGALFFSLLYNSLLAMAEVTESFQGRPVLIKHKSFAFFHPAAFCIAQIAADIPVLIFQVTIFALPVYFMVGLEMDAGVFFTYWILVFATTMAMTAVFRACGAAFKTFDDASKVSGFLISALIMYTGYMIRKPEMHPWFVWIYWIDPLAYGFDALLSNEFHGKIIPCVGTNLVPAGPGYENATTQSCTGVGGSIPGRNYVTGDDYLASLSYSHGHVWRNFGILWAWWALFVVVTIIATSRWKGASENGPSLLIPRESVEKHRQHGHRDEESQSNEKTSTKGKSEGVQDSSDIDNQLVRNTSVFTWKDLCYTVKTPSGDRQLLDHVYGWVKPGMLGALMGSSGAGKTTLLDVLAQRKTAGTIQGSVLVDGRPLPVSFQRSAGYCEQLDVHEPYATVREALEFSALLRQPRTTPREEKLKYVDVIIDLLELHDIADTLIGRVGAGLSVEQRKRVTIGVELVSKPSILIFLDEPTSGLDGQSAYNTVRFLRKLADVGQAVLVTIHQPSAQLFAEFDSLLLLAKGGKMVYFGDIGDNGSTVKEYFARHGAPCPPNANPAEHMIDVVSGSLSQGRDWHEVWKASPEHTNAQKELDRIISEAASKPPGTVDDGHEFAMPLWQQTVIVTKRTCLAVYRNTDYVNNKLALHIGSALFNGFSFWKMGASVGELQLKLFALFNFIFVAPGAIAQLQPLFIERRDIYDAREKKSRMYSWVAFVTGLIVSELPYLVLCAVLYFVCFYYQTGLPTSSDKAGAVFFVMLLYEGLYTGIGQFISAYAPNAVFATLTNPLVIGTLVSFCGVLVPYGQIQEFWRYWIYWLNPFNYLMGSLLTFTIFDVDIKCRESEFATFDPPNGSSCIDYLSTYLQGLGVSANLINPDATSQCQVCQYTRGSDYLYSLNLKDYYYGWRDTAIVALFVLSSYALVYGLMKLRTKASKKAEE

SEQ ID NO: 27316 - protein, 109 aa, Glycine max
  misc_feature (63)..(63): Xaa can be any naturally occurring amino acid
  misc_feature (96)..(96): Xaa can be any naturally occurring amino acid
  unsure (1)..(109): unsure at all Xaa locations
ASSMISSPAVTTVNRAGAGMVAPFTGLKSMAGYTTIKTNNDITFIAINGGRVQCMQEWPPIGXTKYEILYYLSDLDDAQLAMEIEYLLTKGWILYXEFNWEHCFMYREH

SEQ ID NO: 27317 - protein, 390 aa, Zea mays
NAIPFILLFCAISTNKIFSNNKPFSFTIVSARSLLEIDPNSGLVQDKVKVGQTLEEDTQNIINMTMNVSSGWSIVKEEFILPARGAPFNSCHASTIVQIEEDNFLVAYFGGSREGAPDVKIWLQRYSDGHWHPPVVADEQDGVPMWNPVLFQLPSRELLLFYKIGQEVQKWSGAMKRSLDGGVTWSPREQLPPGILGPIKNKPFLLEDGRLLCGSSVESWNSWGAWLEVTKDAGWTWRKYGPICIKGQPLGVIQPVPYRTDDGTIRVLLRSFETIGHVCMADSIDEGVTWSYVRETELPNPNSGIDGVKMKDGRVLLAYNTFSRGTLKLAVSLNDGDSWDEVMTLEDTKGMEFSYPAVIQSMDELIHVTYTYNRTQVKHVVLRPSSMVKL

SEQ ID NO: 27318 - protein, 400 aa, Oryza sativa
  misc_feature (182)..(182): Xaa can be any naturally occurring amino acid
  misc_feature (211)..(211): Xaa can be any naturally occurring amino acid
  unsure (1)..(400): unsure at all Xaa locations
MLRLQNHLLPLLRASSSSSPVHLRRLIPSTAAASSSSSVHPNRRLHSTAAARSTTTATPFSMEDYLVDTCGLTAAQALKASKNVSHLKSATKPDAVLAILSGVGLSGADLAAVFAAEPRLLCTKAPSVALRVASLRHRVGLSDPQIASLLLLPGGAKGFHTCDMAPRLEFWIPFLGSFEMLXLKRNNAIVSSSLEKVIKPNIALLRECGLXVCDIVQMSQTSARVLTFSPERLKVIVQQAEKLRMPGCSWAFKNAVGAVARSNEGIVNARMEFLSSSLGCSMEKLRSAVCKCPQILGLSESKLHSKIEFLVGKVGLEPDYILQRPVLLTYSLEKRLLPRHYVVEVLLVKGLIKKTVDFYGCVCVSNEDFVARYIDHHENAVPGLADAYAAVCSGKLPALV

SEQ ID NO: 27319 - protein, 807 aa, Oryza sativa (japonica cultivar-group)
MFGRMRCLVGGGVEDSPRGAVRRVSPALRRVHNANASAAAAAGAEGKSGLPFRSPDVMETVHEVAIYIHRFHNLDLFQQGWYQMKISATWEEGGSKTPASPARVVQYEASDVGADDALGIWKIDDADNSFYTQPFRIKYARQDIYLSVMVSFNIFNSEEEGPAASSVILKFELIYAPTLENGSDIQASSATSSAAVHEFRVPRRALLGFTTHIVQFHFDAFHSVLVDLTLHIVYLKAGATKSSLKIPDQGLGPTSHHIVKALLTSREMLLEELKKISDAIGKTVEDLDVADLSLGKYEAVQPAKSGLPNSNKVFPATTKGVGHLAGILHDFLEKPNSAVDGANDAMLYTLPKEELLELFLTVSSQLSLLWNAFLKFHRINKTKILDYLRDIWALDRKSEWSIWTVHSKIEIPHRYLRSTDDESSHRHSLLRVSGSRKFHDDPVQNSASRAELHRKSIAQMKINTLSVQDMQIYADPSRVPVVLIEQHVMVVPQHGSSKDLATNSSEQKDTIVLPKLQGDSLALKSSAVRVKLIMVYKKQGHHLDLRLVRNQWLLLDPGAECLMSEANEDKTSGDFKEMGGRLAGEVVAFLKKKVDKLAKYGGCKELKLSFVGHSIGNVIIRTALAEPALQPYLKNLYTYMSISGPHLGYWYSSNSLFNSGLWLLKKLKGAQCIHQLTFSDDQDPQNTFFYKLCKLKTLENFKNIILLSSPQDGYVPYHSARIELCPAASSDNSRKGQVFTEMLNNCLDQMRAPTSETRIFMRCDVNFDQSAQGRNLNTMIGRAAHIEFLETDIYAKFIMWSFPELFR

SEQ ID NO: 27320 - protein, 153 aa, Vibrio sp. 12G02
GQFVGWVVTQFDVFRQIAESTTSHGKLKDINVNIEGNHVYLVFEYVTGDASGQNMVTIATNEVFHHILATSPIKPTQAFLDGNLSGDKKPNAHTLRSVRGKKVSAEVTIPAELVEKYLHTTPESMVQFGKMTTVGGLLSGTIGVNAHYANALA

SEQ ID NO: 27321 - protein, 424 aa, Zea mays
MEMESCKLFIGGISWETTEDRLREYFQSFGEVLEAVIMKDRATGRARGFGFLVFSDPIVAERVVFLRHVIDGKLVEAKKAVPRDDHVVLNKSYNTSLQGSPGPANSKKIFVGGLASSVTEAEFKKYFAQFGVITDVVVMYDHRTQRPRGFGFISFESEDAVDKVLQRTFHELNGKMVEVKLAVPKEMALNPIRNQMNVNSFGSSRISALLMNEYTQGFSPSPISGYGVKPEVRYSPGLGNRGGGFSPFGHGYGIELNFEPDQSQNFGSGSSAGFGRPLSPGYAPSLGRYGSQIESGGAGNGPVLNAATKNHLWGNGGGLGYMSNSPISRSSFNGMSSLGSIGDNSRRNSYRSEGGGGLGLEAMRGGHVGGYSSGSSSLETDSLYSDSAWLSLPAKAEERMGAFDFMSRGPAGYINRQPNGGIAA

SEQ ID NO: 27322 - protein, 153 aa, Vibrio sp. 7A03
GQFVGWAVTQYDMFKTIAEQTTAHGKLTDISMNIEGNHVYLVFEFLTGDASGQNMVTIATNAVFEYIEQHSPIAPEYAFLDGNLSGDKKANAQTLRSVRGKKVTAEAHIPAELVQKYLHTTPEKMMRFAQMTTVGGALSGTIGINAHYANALA

SEQ ID NO: 27323 - protein, 153 aa, Vibrio sp. 12F02
GQFVGWAVTQYDTFKQLAESTTSHGKLSDINISIEGNHVYLVFEFLTGDASGQNMVTIATNAVFNYIMENSPITPENAYLDGNLSGDKKASSQTLRSVRGKKVTAEAHIPAELVKKYLHTTPEKMMQFTQMSTVGATLSGTIGINAHYANALA

SEQ ID NO: 27324 - protein, 241 aa, Oryza sativa (japonica cultivar-group)
MESKILAIRDFLEDPDQSEDELVSLLQSLADMDITYKALQETDIGRHVNGLRKHPSGEVRQLVKLLVRKWKEIVDDWVRLHNSGGDGGSSVLTDGDSPDKIQGRSYQNAQVSDFKYSPSPQRHNGLSSERSSNNNGVESMIEKRRTSPAPTYHNNKQNNSIGYSTTSSSAPVRTVREQKDNLMDLEKLDSARKRLQENYQEAQNAKKQRTIQVMDIHDIPKPKNRNAFIRKGGGGLPGKHR

SEQ ID NO: 27325 - protein, 218 aa, Vibrio sp. 14A09
KLPVGLAGPLRVNGLFANDDYLVPLATTEAALVASYNRGAQLLTASGGASAMLLNEGVTRTPAFAFFGLAEAGQFVAWAVTQYDTFKQLAESTTSHGKLSDINISIEGNHVYLVFEFLTGDASGQNMVTIATNAVFSYIMENSPITPENAYLDGNLSGDKKASSQTLRSVRGKKVTAEAHIPAELVKKYLHTTPEKMMQFTQMSTVGATLSGTIGINA

SEQ ID NO: 27326 - protein, 127 aa, Myxococcus xanthus DK 1622
MRNAAIQHIEAKFLRQDVTVFNTGDSVRVHWKVKEGEKERVQAFEGIVIRKTKGNHRATFTVRKLSFGVGVERVFPLHSPRYEKIEVLSRGDVNRKRLFYLRALKGKAARVDVIEEPKPSKKAASAS

SEQ ID NO: 27327 - protein, 184 aa, Myxococcus xanthus DK 1622
MHPPVPSLTDTTLVADLNARLRDVPDFPKPGIVFKDITPVLADPRLFGRVIDAMSAPFRGQHVTKVVGVEARGFLLGAPIALALNAGFVPARKPGKLPHRSVVERYSLEYGSDGVEMHEDAILQGERVLVVDDVLATGGTAEATARLVSRLGGELVGFCFLLSLDFLEGPNRLGRERVTTLLTF

SEQ ID NO: 27328 - protein, 489 aa, Escherichia coli
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMNWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 27329 - protein, 555 aa, Bacteroides thetaiotaomicron VPI-5482
MKSDIEIARSVELKKIKQVAESIGIPREEVENYGRYIAKIPEQLIDEEKVKKSNLVLVTAITATKAGIGKTTVSIGLALGLNKIGKKAIVALREPSLGPCFGMKGGAAGGGYAQVLPMEKINLHFTGDFHAITSAHNMISALLDNYLYQNQAKGFGLKEILWRRVLDVNDRSLRSIVVGLGPKSNGITQESGFDITPASEIMAILCLSKDVEDLRRRIENILLGFTYDDQPFTVKDLGVAGAITVLLKDAIHPNLVQTTEGTAAFVHGGPFANIAHGCNSILATKLAMSFGDYVITEAGFGADLGAEKFYNIKCRKSGLQPKLTVIVATAQGLKMHGGVSLDRIKEPNMEGLKEGLRNLDKHIRNLRSFGQTVVVAFNKFATDTDEEMEMLREHCEQLGVGYAINNAFSDGGDGAVDMARLVVDTIENNPSEPLRYTYKEEDSIQQKIEKVATNLYGASVITYSSIARNRIKLIEKMGITHYPVCIAKTQYSFSADPKIYGAVNNFEFHIKDIVINNGAEMIVAIAGEILRMPGLPKEPQALHIDIVDGEIEGLS

SEQ ID NO: 27330 - protein, 146 aa, Zea mays
LFGGARPPARFRKLVGQGDVFFFDVAPPAPAGVFALNASFFLKNGGPFVFSIKGKCIGSPPPPGAGFSGEGGKVKGGQFKPPGPGGLGPPGGGPPFFLGGGRGPQKQKAPFLDWNPGFFFLPKKVCFFLVFLETLKGLSKYVDLFP

SEQ ID NO: 27331 - protein, 176 aa, marine gamma proteobacterium HTCC2080
MSALTRKKLKTQEAYMRLIKSITLSTLFFAATVSGSENNPSSSLHEVQTPVGSFYSSELSLEQNFPFSDMVHTAGGLVFLSGLVGSDDSGQLVSGGLGPETHAIFGQLKAHLAQLNLGLKDIVKCLVMIDDIEKWGDFNAIYTSYFVPPYPARSAMGADGLALGAALELECIAVKK

SEQ ID NO: 27332 - protein, 331 aa, Campylobacter upsaliensis RM3195
MAIKVAINGFGRIGRCVARIIAERDDLELVAINDTTELELTKYLLKYDTVHGEFNASVELENSDLLINNKKVKMFYTRDINELDFAKYGAELVFECTGAHLTQEKCQAFLNKGIKKVLMSAPAKDNTPTFVMGVNSHLYKGEAIISNASCTTNCLGPVCRVLQDNFGIEKGLMTTIHAYTNGQSIIDAKAKDKRRSRAAAQNIIPTSTGAAKAMKLVMPELDGKLHGQSMRVPVIDVSSVDLTALLSKKVSKEELNEAFRKASETNLKGILAVDDEERVSSDFITSPFGAVVASDLTQVISEDFVKIVAWYDNEWGYSSRLVDMAVYVMGA

SEQ ID NO: 27333 - protein, 167 aa, Adiantum capillus-veneris
MFLAIIKFQNYGQQVLEAANYIGQGFAVTLDHLNRLPITVQYPYEKKLPSERFRGRIHFEFDKCIACEVCVRVCPINLPVVDWIFLKDVKKKKLKNYSIDFGVCIFCGNCVEYCPTNCLSMTEEYELSSYNRHELNFDQTALGRLPPPASEDVSIQLVLNSRNSFRR

SEQ ID NO: 27334 - protein, 396 aa, Campylobacter upsaliensis RM3195
MKSEIISIKDIDLAKKKVFIRCDFNVPQDDFLNITDDRRIRSAIPTIRYCLDNGCSVILASHLGRPKEISSKYSLEPVAKRLSRLMSKEVLLAKDVVGEDAKKKAQNLEANEILMLENLRFEKGETKNDENLAKELASMAEIYINDAFGVCHRAHASVEAITRFFDVKAAGFLLQKEIKFADNLLRHPARPFVAVVGGSKVSGKLQALINLLPKVDKLIIGGGMAFTFLKALGYDIGNSLLEEELLEDARAIMKRGRELGVKIYLPVDVAVARTCSSEAFMSYVPTQEIPSGFMGLDIGPASGKLFREALADAQTIWWNGPMGVFEIEKFAKGSLKMAHFIGDSHATTIIGGGDTADVVARSGEADEMTFISTGGGASLELIEGKELPGVKPLRGE

SEQ ID NO: 27335 - protein, 328 aa, Glycyrrhiza echinata
MASSTSTTTSKEIDRELPPLLRVYKDGTVERFLGSSFVPPSPEDPETGVSTKDIVISENPTISARVYLPKLNNTTEKLPILVYYHGGAFCLESAFSFLHQRYLNIVASKANVLVVSIEYRLAPEHPLPAAYEDGWYALKWVTSHSTNNNKPTNADPWLIKHGDFNRFYIGGDTSGANIAHNAALRVGAEALPGGLRIAGVLSAFPLFWGSKPVLSEPVEGHEKSSPMQVWNFVYPDAPGGIDNPLINPLAPGAPNLATLGCPKMLVFVAGKDDLRDRGIWYYEAVKESGWKGDVELAQYEGEEHCFQIYHPETENSKDLIGRIASFLV

SEQ ID NO: 27336 - protein, 517 aa, Oryza sativa (indica cultivar-group)
MAGGGFPVAGGAPPGDYGGGITFSVVVTCLMAASGGLIFGYDIGISGGVTAMESFLAAFFPGVLRRMAAGRRDEYCVYDSHVLTAFTSSLYLAGLAASLAAGRVTRAVGRQAVMLAGGALFFAGAAVNAAAVNIAMLIVGRMLLGFGIGFTNQAAPVYLAETAPAKWRGAFTTGFQLFLGIGNLTANLTNYGAARIPRWGWRLSLGLAAAPASVILVGALLISDTPSSLLVRGRVEQARAALRRVRGAKADVDAELEGVARAVEAARANEEGAYRRILWRQHRPHLVMAVAVPLLQQLTGVIVIAFFSPVLFQTAGFGSNASLMGAVILGAVNLGSTLVSIATVDRYGRRVLFLTGGLVMIACQVAVAWIMGSQIGRDGESAMARRYSVAVLALTCVFSAAFGWSWGPLTWVIPGEIFPVEIRSAGQGISVAVNLGATFVLTQTFLAMLCSFKYATFLYYAAWVAVMTAFVWAFLPETKGVPLEAMGAVWARHWYWRRFVQPPPAAKDAMLPEVLVN

SEQ ID NO: 27337 - protein, 473 aa, Arabidopsis thaliana
MSLGYAEKLSFIEGVGQVGMAEFFDPSHLLQCKIEELAKLIQKSKHLVVFTGAGISTSCGIPDFRGPKGIWTLQREGKDLPKASLPFHRAMPSMTHMALVELERAGILKFVISQNVDGLHLRSGIPREKLSELHGDSFMEMCPSCGAEYLRDFEVETIGLKETSRKCSVEKCGAKLKDTVLDWEDALPPKEIDPAEKHCKKADLVLCLGTSLQITPACNLPLKCLKGGGKIVIVNLQKTPKDKKANVVIHGLVDKVVAGVMESLNMKIPPYVRIDLFQIILTQSISGDQRFINWTLRVASVHGLTSQLPFIKSIEVSFSDNHNYKDAVLDKQPFLMKRRTARNETFDIFFKVNYSDGCDCVSTQLSLPFEFKISTEEHVEIIDKEAVLQSLREKAVEESSCGQSGVVERRVVSEPRSEAVVYATVTSLRTYHSQQSLLANGDLKWKLEGSGTSRKRSRTGKRKSKALAEETKA

SEQ ID NO: 27338 - protein, 102 aa, Glycine max
  misc_feature (56)..(56): Xaa can be any naturally occurring amino acid
  misc_feature (59)..(59): Xaa can be any naturally occurring amino acid
  unsure (1)..(102): unsure at all Xaa locations
MKTNNKAIAMEHDENVEGLERFHDNLLYQVFNHLDAQTLAMAGCVNKQLHQTAHDXEAXELICTHQWANTWCADQHLQSLVLALRGYLRLHALYLLPLSKPK

SEQ ID NO: 27339 - protein, 169 aa, Oryza sativa (japonica cultivar-group)
MAATADNGEKMIVLISSDGERFELSEAAASQSKTLSHMIEDDCTDNGVPLPNVTAVVLAKVVEYFKKHAAVTPKPATEAVAADKAKREEELKSFDAEFVDVDRTMLFELILAANFLNAQDLLDLTCQHAADLIKDMSVEEVREVFNITNDFTPEEEAEVRKENAWAFDN

SEQ ID NO: 27340 - protein, 718 aa, Azoarcus sp. EbN1
MPRKILVTNALPYANGDIHLGHLVGYIQGDIWVRYQRMRGNTVHYVCADDTHGTPVMLRAEKEGITPEALIGRVHGEHLRDFTDFGVAFDNYHSTHSVENRAYAEDVYTKLKAAELIDTRAIEQFYDPVKEMFLPDRFIKGECPKCGAADQYGDNCEACGAAYAPTELKNPHSAVSGAKPVLKTSEHYFFRLSDPRAVAFLREWTRGTNAAGTRRLQVEAANKMKEWLGDETVGDGGNTLSDWDISRDAPYFGFEIPGAPGKYFYVWLDAPIGYFASFRNLAEQRGDIAVDDFTDAVRAETAGTEMVHFIGKDILYFHALFWPAMLRFAGYRTPTQLCVNGFLTVDGAKMSKSRGTFITARSYVSRGLNPEWLRYYFATKSNGTMEDVDLSLDDMVAKVNSDLVGKYVNIASRCAGFIAKRFDGKLGASDPQATADFEAAFAAGTIAHAYEERDYGRALREIMRLADLANQYVNDHKPWELAKQEGQEAHLHVVCSTALTHFRDLTLYLKPVLPALAQKVEAFLAIDPLVWPQTWQPLPAAHTINPYAHLMTRVERKQIDALLEANRESLAPAAPAAKVASSQQRHAEKQQHEAQSAETAMPHISIDDFTKVDLRIARIVGAEHVEGADKLIRLRLDIGESENGQAKLRQVFAGIKSAYDPATLVGRLTVMVANLAPRKMKFGVSEGMVLAASSADDKSSGIYLLSPDTGAASGMRVK

SEQ ID NO: 27341 - protein, 193 aa, Vibrio sp. 12F11
VGISWPLRVNGLFAEGDYLVPLATTEAALVASYNRGSKLISACGGASAMLLNEGVTRTPGFAFENLAQAGQFVAWVVTQYDHFKALAESTTSHGKLTDISCNIEGNHVYLVFEFLTGDASGQNMVTIATNAVFEYIIEHTPVKPDHAFLDGNLSGDKKANTQTLRSVRGKKVTAEVNIPAELVEKYLHTTPEK

SEQ ID NO: 27342 - protein, 193 aa, Vibrio sp. 12D02
VGLAGPLRINGLFANDDYLIPLATTEAALVASYNRGSKLITASGGVSTLLINEGVSRTPVFAFQSLSESAQFVSWVVTQYEIFRKIAESTTTHGKLKDINVNIEGNHVYLVFEYLTGDASGQNMVTIATQNVFVYILEHSPIAPVDAFLDGNLSGDKKANAYTLRSVRGRKVSADVTIPAELVEQYLNTTPEA

SEQ ID NO: 27343 - protein, 312 aa, Cryptococcus neoformans var. neoformans JEC21
MVCLVSLLAVRQPVKMPQANLYQQGLCHSRKAHPPPHGGYGGGYNQQPMGMGMGGGPGGGGFGGPGGHHGGRPGGGGGFGGPGGGGGFGGPGGGGGYGGPGGGGGFGGPGGGGGGGGRWRNILLYTFHMSAEGAREAFINSQSTSPSPPTSPTRSPVPPSTSRTSSWPTIPRTPITRSKTTMMTPWSLVDHDHTWWHPESWTAHTHTHPHTHSHSHRADEGRSTTRDDDRLVATGDAETLIKFATTLLSGSKKSWEMGSIEFGICDLLSPHIKPIIACYVRLRRATREKRRTPCRAMTPRQFPNWGWWSLAE

SEQ ID NO: 27344 - protein, 218 aa, Vibrio sp. 14C08
KVPVGIAGPLRVNGLFAKGDYLVPLATTEAALVASYHRGAKLLTAAGGASAMLLNEGVTRTPGFAFYNLIEAGQFVAWIVTQYDHFKQVAENTTAHGKLSDINVNIEGNHVYLVFEFLTGDASGQNMVTIATNAVFQTILANTPVQPEYAFLDGNLSGDKKATSQTLRSVRGKKVTAEVHLSAELIHKHLHTTPQSMMQFGQMTTVGGALSGAIGINA

SEQ ID NO: 27345 - protein, 247 aa, Sulfolobus solfataricus P2
MIYEKVAEELISSSYTIAFTGAGISTASGIPDFRGPQGLWKKYSPELASIEYFEKDPKNFWGFYSLRMRGLFEAQPNKAHYSLAELEKMGIIKVIITQNIDGLHQKAGSKNVIELHGTMRRSYCVLCLRTYDSLNVLSMIEKGNLPPRCDCGGIIRPDVVLFGEPVKNIYEALSIAYESDLVISIGSSLTVYPANLIPQTVKERGGKLIILNMEETPLDSIADYVVREPVEISLPKILENVRQKILS

SEQ ID NO: 27346 - protein, 218 aa, Vibrio sp. 12C03
KVPVGIAGPLRVNGLFATDDYLVPLATTEAALVASYNRGANLITAAGGASAMLLNEGVTRTPGFAFYNLVEAGQFVAWLVTQYDYFKQIAESTTSHGKLTDINVNIEGNHVYLVFEFLTGDASGQNMVTIATNAVFQTILATTPIAPEYAFLDGNLSGDKKANSQTLRSVRGKKVTAEIHLSASLINKYLHTTPQAMMQFGQMTTVGGALSGTTGINA

SEQ ID NO: 27347 - protein, 203 aa, Prochlorococcus marinus str. MIT 9301
MSSKLRVGVAGPVGSGKTALVETLCLSLKKNYEIAIVTNDIFTKEDANFLINKKVLEEGRIIGVETGGCPHTAIREDCSLNKNAVLDLENKYNPLDFVFVESGGDNLASSFSPELVDLSIYVIDVSAGDKIPRKGGPGITRSDLLLINKIDLADKVGADLNIMKSDTEFMRKGKPWFFTNLSIGIGVEEITQFLESHIPNNRN

SEQ ID NO: 27348 - protein, 386 aa, Triticum aestivum
TFIGAADKFRSDLMNIAMTTLSSKILSQDKEYFAELAVDAVLRLKGSTNLESIQILKKPGGSLKDSFLDEGFILDKKIGLGQPKRIENANILVANTAMDTDKVKIYGARVRVDSMSKVADIEAAEKQKMREKVEKIIGHGINCFVNRQLIYNFPEELFADAGILAVEHADFEGIERLALVTGGDIASTFDNPESVKLGHCKLIEEIMIGEDRLIHFSGVAMGQACTIVLRGASEHVLDEAERSLHDALCVLSQTVNDTRVIFGGGWPEMVMSKEVDELARRTPGKKSHAIDAFSRALQAIPTIIADNAGLDSAELISQLRAEHHKENSTVGIDVISGGLGDMQKRGICEAFKVKQAIVLSATEAAEMILRVDEIITCAPRRREDRM

SEQ ID NO: 27349 - protein, 554 aa, Saccharomyces cerevisiae
MSNNSFTNFKLATELPAWSKLQKIYESQGKTLSVKQEFQKDAKRFEKLNKTFTNYDGSKILFDYSKNLVNDEIIAALIELAKEANVTGLRDAMFKGEHINSTEDRAVYHVALRNRANKPMYVDGVNVAPEVDSVLKHMKEFSEQVRSGEWKGYTGKKITDVVNIGIGGSDLGPVMVTEALKHYAGVLDVHFVSNIDGTHIAETLKVVDPETTLFLIASKTFTTAETITNANTAKNWFLSKTGNDPSHIAKHFAALSTNETEVAKFGIDTKNMFGFESWVGGRYSVWSAIGLSVALYIGYDNFEAFLKGAEAVDNHFTQTPLEDNIPLLGGLLSVWYNNFFGAQTHLVAPFDQYLHRFPAYLQQLSMESNGKSVTRGNVFTDYSTGSILFGEPATNAQHSFFQLVHQGTKLIPSDFILAAQSHNPIENKLHQKMLASNFFAQAEALMVGKDEEQVKAEGATGGLVPHKVFSGNRPTTSILAQKITPATLGALIAYYEHVTFTEGAIWNINSFDQWGVELGKVLAKVIGKELDNSSTISTHDASTNGLINQFKEWM

SEQ ID NO: 27350 - protein, 218 aa, Vibrio sp. 12D10
KVPVGIAGPLRVNGLFARDDFLVPLATTEAALVASYNRGSQLITAAGGASAMLLNEGVTRTPGFAFYNLQQAGEFVAWITTQYDHFKQLAQATTSYGKLTDISVNIEGNHVYLVFEFLTGDASGQNMVTIATNAVFEHILAATPVEPEYAFLDGNLSGDKKPNAHSLRSVRGKKVTAEVHLSKALIQKYLHTTPEKMMQFGQMTTVGGALSGTIGINA

SEQ ID NO: 27351 - protein, 344 aa, marine gamma proteobacterium HTCC2080
MKALVKKRAEEGLWLEDVPIPAIGGNDVLIKVHKTAICGTDVHIYNWDAWAQKTIPVPMVSGHEFAGEIVELGSNVTGLQVGDIVSGEGHVVCGRCRNCLAGRLHLCPNTMGVGVNRDGAFAEYLAIPATNVFRPNVYIPTDLLSIFDPYGNAVHTALSFNMVGEDVIITGAGPIGIMAAMVAGHCGARNVILTDVNEYRLDLAKRIVPKVQPINVSKQEISRNFMESLGILEGFDVCLEMSGSPVAFQDVLSKMINGGSIAMLGLMPDDTGIAWTDVVFKGLNIKGIYGREMYETWYKMVMMVQSGLPIDRIITHRLHYTEFQEGFDIMRSGQSGKIILNWKD

SEQ ID NO: 27352 - protein, 315 aa, Oryza sativa (japonica cultivar-group)
MGNSKTPQPSKKSRIMLSDTDGHQLDNDEFSSESASNQMVLFNPETVAKGQDELGENHSPSLQKSANNPNRGMPSIGAFTVQCAKCFKWRLIPTKEKYEEIRECIIQEPFECERAREWRPDVTCNDPEDISQDGSRLWAIDKPNIALPPPGWERQIRIRGEGGTKFADVYYTSPTGRKLRSLVEIDRYLLENPDYVAQGVTLTQFSFQIPRPLRQDYVKKRPKIVNPNDEASVVTTKSVKPEEVSPIAWAAPSVHQEGEAGERASHADEPPEAEELELTRKRKAESPLFEEAHSNHVSDEPKTKLEDTQNGGPSA

SEQ ID NO: 27353 - protein, 596 aa, Glycine max
MDETSALIEAILREQEEEEEEAHRRRRNLTTQNTTIKSNNQWQTVSYTKRNRNRNNNRKPLADDNFAADPSSSDVFSSVQRHSEDRRLRLLKSQIAAAEAAAAEATPSRSKRHSDNEEDGDAEHEASAVQEVKKAKQKKPKKPKVTVAEAASGISADDLDAFLAEITASYESQQDIMLMRFADYFGRAFSSVSGAQFPWLKTFKESTVAKIVDIPLLHISEDIYKISTDWVSHRSYEALGSFVLWSLDSILADLASHQGVVKGSKKAVQQSSPKSQVAMFVVLAMVLRRKPDVLISLLPIIKENKKYQGQDKLPVIVWVITQASQGDLVMGLYLWVYLLLPMLSVKSGCNPQSRDLILQLVERIITSPKARSILLNGAVRRGERVVPPWALDSLLRVTFPLPSARVKATERFEAVYPTLREVALASSPGSKAIKHLAQQILSFAIKAAGEANSDLSKEASDIFIWCLTQNPECYKQWDFLYMDNLEASVVVLRKLSGEWKEYFVKHPTLDPLRENLKSFSQKNEKALAKVDDGARHALLKDADKYCKVLLGQLSQGHGCLKSMIVLSVVLAVGAVFMSQNLHLWDYSQLTEMLNLS

SEQ ID NO: 27354 - protein, 497 aa, Yarrowia lipolytica CLIB122
MNRHTHALIVGAGFSGLASAIKLQTDWNTTDYQIYDRDSEFGGTWQQNTYPGAASDIPALWYCLASDPKVDWKEPYPSQEELRQYIKDVAEKYNLRKRATFGAEIEKVEWLADQQMWKASIKDVATGNKYTHTSRVVFMGKGCLVVPNKFKTAGIEDFKGPIMHTAQWDHSVDYKGKNVVVIGNGCSAVQVCAAIAPEVGSLTQFARTPQWMVPRPEWKWLKTMGETFPFMLGFVRFLMFLTLEANFSLFRGGWYARADRAVRTWVSTMLLKWHLPKKYHENSIPKYELGCKRIIYDCGYWKALHQKNVELTYDPIVRMTSNSVITKSGQEWPADIVIDATGFNVAASMGGLEIVGETGENLVDFWNGKVSAYETVMVANYPNMFFLFGPNATTGHNSVIFAIENALKWIENVASDLVTGSATYVTVKNEAYDSWTQKVHEASKKMAFSTGGCVSWYMSASGAGHNGVTYPWTQFTAWWRARFPVKSDMIVKSKKDE

SEQ ID NO: 27355 - protein, 570 aa, Shewanella sp. ANA-3
MLTDMDISRRAHLKDIAALGAEFGLLPDEMQLFGKTKAKVDLRAQQRLAEQQQGKLIIVTAVTPTPHGEGKTVTTIGLTQSLKALGNKVCACIRQPSMGPVFGVKGGAAGGGYAQVVPMQELNLHLTGDIHAVSSAHNLGAAAIASRLYHETRLGKAEFESQSGQNYLDIAPNGIRWHRVVDHNDRCLREIEVGLGENNGPAYTSGFDITAASELMAILALSRNLADMRARIGKLVLAVNRQGAAISAEDLGVAGAMTAIMADAVKPTLMQTLNGAPCLIHAGPFANIAHGNSSVIADDIALKLADFVVTEGGFGSDMGFEKFCNIKARQSGLAPSAAVLVTTLKALKANSGLTSDADINAPDQARLEAGFANLNWHINNVARYGIPVVVAINRFATDTDAELNWLIEAVAGTAAFGCELSEAFSQGEAGALTLAQTVMRACEQPSEFTLLYPDEMALEAKLSTLAEVGYGATGVSLSEAAKLQLQELSALGYADLPVCMAKTPLSISHDPQLKGVPQGFIVPVRELVLNAGAGFITALVGNVMTMPGLGLVPGYLKVDIGADGEITGLG

SEQ ID NO: 27356 - protein, 261 aa, Alkaliphilus metalliredigenes QYMF
ICKGYFKLASILVGIIVGYVIAIMIGIVNFTPVAEAAWIAIPRPLHFGIEFYPSAIITMVIMYIVNSVQAVGDLSATTMGGMGREVTDEELSGGIIGNGVSSVVASFFGGLPTATYSQNVGIVAMTKVVSRFVLALAAGLILIGGFVPKFGAIMTTIPQSVLGGATITVFAIITMTGIKLIIQDELSGRNVTIVGLAVALGMGITTVPQSLELFPDWVMMVFGSSPVVIATVVVFTLNIILPKKSLADEKAEREEMEMKEG

SEQ ID NO: 27357 - protein, 542 aa, Nicotiana tabacum
MEKDTKHGDIIFRSKLPDIYIPNHLPLHSYCFENISEFSSRPCLINGANKQIYTYADVELSSRKVAAGLHKQGIQQKDTIMILLPNSPEFVFAFIGASYLGAISTMANPLFTAAEVVKQVKASGAKIIVTQACHVNKVKDYALENNVKIICIDSAPEGCLHFSVLTQADEHDIPEVEIQPDDVVALPYSSGTTGLPKGVMLTHKGLVTSVAQQVDGENRNLYIHSEDVLLCVLPLFHIYSLNSVLLCGLRVGAAILIMQKFDIVPFLELIQNYKVTIGPFVPPIVLAIAKSPMVDDYDLSSVRTVMSGAAPLGKELEDTVRAKFPNAKLGQGYGMTEAGPVLAMCLAFAKEPFEIKSGACGTVVRNAEMKIVDPETGNSLPRNQSGEICIRGDQIMKGYLNDPEATARTIDKEGWLYTGDIGYIDDDDELFIVDRLKELIKYKGFQVAPAELEALLLNHPTFSDAAVVPMKDEQAEEVPVAFVVRSSGSTITEDEVKDFISKQVIFYKRIKRVFFVDAVPKSPSGKILRKDLRAKLAAGLPN

SEQ ID NO: 27358 - protein, 190 aa, Oryza sativa (indica cultivar-group)
MAADKFLCFAFASLVSMVVLAAGSKSPDGVAALPRRGQLVAGGDNDKNECVYTLYVETGWIWKAGTDAAIGVELAAADGSGFAVGDLERWGGLMGAGHDYYERGNVDVFSGRAPCLPSPPCRMNLTSDGAGAHHGWYCKSVEVTATGPHAGCAKAAFGVEQWLATDAPPYQLYAERSVCAKSRPGGEEER

SEQ ID NO: 27359 - protein, 165 aa, Triticum aestivum
QIIELSRDYFGMSSLEKATELGGSLSVRIGDALSPSATVEGGFAGIVVDLFADGKVLPQLQEAETWLEIAKKLMPDGRIMVNCGGADTPVSLAADTGVSSWVQNPTIKALCSAFPGQLNWKRLSEKESVNYVALTGPLPDLEEWSTSVPSELSPRVKQWVPCELA

SEQ ID NO: 27360 - protein, 379 aa, Gossypium hirsutum
MSTAGQVIRCRAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRGEMINDGKSRFSINGKPIYHFLGTSTFSEYTVVHVGQVAKINPEAPLDKVCVLSCGMSTGFGATVNVAKPKKGQSVAIFGLGAVGLAAAEGARVSGASRIIGVDLNPSRFEQAKKFGVTEFVNPKDYNKPVQEAIVEMTGGGVDRSVECTGSIQAMISAFECVHDGWGVAVLVGVPNKDDAFKTHPVNLLNEKTVKGTFFGNYKPRSDIPAVVEKYMNKELELDKFITHTVPFSEINKAFELMLAGEGLRCVIRMDE

SEQ ID NO: 27361 - protein, 170 aa, Enterococcus faecalis V583
MDLRDYIASIPDYPEKGIVFRDISPLMANGDAYREATKQIVDYAKEKRIDMVVGPEARGFIVGCPVAYELGVGFAPVRKKGKLPRETIEVTYDLEYGSDTLTLHKDAITPGQRVLICDDLLATGGTIKATIELVEQLGGIVVGCAFLIELMDLHGRDKIDGYDIVTLMEY

SEQ ID NO: 27362 - protein, 262 aa, Enterococcus faecalis V583
MDLTNKVVVVTGGSAGLGEQICYEAAKQGAVVVVCARRINLIGKVREQCAVLSGREAFSYQLDIADPESVERVVEAISAEVGPIDVLVNNAGFGLFENFVEIDLAVARQMFDVNVLGMMTFTQKVAIKMIEAGQGHIINVASMAGKMATAKSTVYSATKFAVLGFSNALRLELKPLGVAVTTVNPGPIQTEFFDKADPTGTYLAAVDKIVLDPTKLAKEVVGSMGTSRREINRPFVMEAAARFYTLFPHLGDFIAGNILNKK

SEQ ID NO: 27363 - protein, 215 aa, Medicago truncatula
MTRVNEVNPIPEDTTPKSKKNQQPSWNTEQNLVLISGWIKYGICSVVGRNQTSEPYWCKIAEYCNEHCSFNSPRDAAACQNRFNYMSKLINKWVGAYDGAKRLQGSGSSEDDVLAKAQELYACGKNVQFTLKEECRALRDQPRHGSQMGGNVGSGNSGSKRSHGDSVGSSARPMGREAAKKKGKKKSKDAASLEEVKKEWVEFKEIKVQEIEQLK

SEQ ID NO: 27364 - protein, 277 aa, Zea mays
MQMHVGGGAADSPEATRPSRYESQKRRDWHTFGQYLRNHRPPLELARCSGAHVLEFLRYLDQFGKTKVHAAGCPFFGHPSPPAPCPCPLRQAWGSLDALVGRLRAAFEEHGGRPEANPFGARAVRLYLREVRDSQAKARGIAYEKKRRKRPSSFASASSQSSPQAATSPPQQAAPASSPILSDAAAERADVRAFVSDAGHGHGAGHQQQHHFFMPHPQFLHGFSLLPGNPEAVAGNGNGSSSSASVAASSGDEIALALAAAEEAHAAGCMLPLSVFN

SEQ ID NO: 27365 - protein, 414 aa, Triticum aestivum
FDLMGHIMKHTMMRAKAALQSLTRDAHGVDGSKIYLYGEGWDFAEVARNQRGINGSQLNMSGTGIGSFNDRIRDAVNGGNPFGNPLQQGFNTGLFLEPNGFYQGNEADTRRSLATYADQIQIGLAGNLRDYVLITHTGETKKGSEIHTFDGLPVGYTSSPIEIINYVSAHDNETLFDVISVKTPMNLSVDERCRINHLASSMMALSQGIPFFHAGDEILRSKSIDRDSYNSGDWFNKLDFTYETNNWGVGLPPSEKNEDNWPLMKPRLENPSFKPAKGHILAALDSFVDILKIRYSSPLFRLSTASDIKQRVHFHNTGPSSVPGVIVMGIEDARDEKPEMAQLDANFSYVVTVFNVCPHEVSMDIPALASMRLELHPVQVNSSDALVGKSVYEAATGRFTVPRRTVSVFVEPRC

SEQ ID NO: 27366 - protein, 377 aa, Solanum tuberosum
MAEGEDIQPLVCDNGTGMVKAGFAGDDAPRAVFPRIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDVKEKLSYIALDFEQELETSKTSSSVEKSYELPDGQVITIGAERFRCPEVLFQPSLIGMEAAGIHETTYNSIMKCDVDIRKDLYGNIVLSGGTTMFPGIADRMSKELTALAPSSMKIKVVAPPERKYSVWIGGSILASLSTFQQMWIAKAEYDESGPSIVHRKCF

SEQ ID NO: 27367 - protein, 198 aa, Zea mays
MATGPRSLHALLGGGAVADLLLCRRRNASAAAVVGATAVWFVFERAGYSFPSVLSNALLLLVAILFFWAKSALLLNRPLPPLPNLEVSDAVVEKAADHALVWINRLLAVGHDIAIKRNRKVFIKVILILWVVSFIGMLFNFLTLIYIGVMLSLLVPPLYEKYQDQVDEKVGVAYSVLSRHIDTIITRAGQSAKQKKTE

SEQ ID NO: 27368 - protein, 229 aa, Xylella fastidiosa 9a5c
MPLNEPSSNAFPRTVLFDLDGTLLDSAPDMLATANAMLAARGRAPITLAQLRPVISIGTFRILAVAFPELDAAAIQGLIPEFLQRYEALIGSVSKPFDGVEMMLDALECAGTVWGIVTNKPEFLARLILPLLGWTSRCAVLIGGDTLAERKPHPLPLLTAAERIGVMPTDCVYVGDDVSDIQAARAAGMPSMVALWGYRSHEDNPMTWQADTLVEQPHLLSRPDVWPST

SEQ ID NO: 27369 - protein, 315 aa, Prochlorococcus marinus str. MIT 9301
MMKDLDINFPLDKFEKLIIDIGWESLDDWFNFWNNKRNILSIDQYWNNKVNDDWIWGLALPLLSQAYKFQNNFSDRKIIGISALPGTGKTTLGKWLETISLKLNFKIAVISIDDFYLPSNEMKLAIKNNPWNVARGFPGSHSVNLMHEKLLNWKMNGELNVPVFDKSLRNGLGDRSHWRLENPDLLILEGWFLGVKPFSDDITDQLINTKNLSLHESSYILKIQNNLNEYSDIWTLIDNIWHLKPLKIEYMNTWKTNQEKEMFLQKGNALKDEKLSNFLRMLNVSIPHKSFDVIKSYALLLIDQERNLVEAGLNL

SEQ ID NO: 27370 - protein, 305 aa, Sulfolobus solfataricus P2
MPLDPRIKELLESGFIVPIGKASVDEVRKIFRQLASAAPKVEVGKVEDIKIPGSEANINARVYLPKANGPYGVLIYLHGGGFVIGDVESYDPLCRAITNACNCVVVSVDYRLAPEYKFPSAVIDSFDATNWVYNNLDKFDGKMGVAIAGDSAGGNLAAVVALLSKGKLNLKYQILIYPAVGFDSVSRSMIEYSDGFFLTREHIEWFGSQYLRSPADLLDFRFSPILVQDLSGLPPALIITAEYDPLRDQGEAYANRLLQAGVPVTSVRFNNVIHGFLSFFPLIEQGRDAIGLIGSVLRRAFYDKS

SEQ ID NO: 27371 - protein, 463 aa, Rhodococcus sp. RHA1
MPPGGPMPKVLAAPPPQSTLQPISGNAGFPVIGHSLDYFRDPMGLLQSRWDRYGPVSWLSMAGKRWVTVLGPDGCQTVLQNKDRAFVNSDGWSVLIGPFFHRGLMLLDGDEHLAHRRIMQQAFTRDRLSRYTEALHPAVEKGLDGWQPTAGFAAYPALKELTLDLATSIFMGGAEGSTPREMAEINRAFIDCVQAATSVIRYPLLGTRWKRGIDGRARLEEFFRRYLPARRAGAGEDLFSALCHIESEEGQRFSDDDVVNHMIFLLMAAHDTSTITLSTMMQYLGQHPDWQERCRRQSAALGTSTPTYDQLDELTDLDLVMKECLRLVPPVPVVARRAVEDTEVLGHYIPRGTYMSVVVHFTHHMPEYWPDPERFDPERFAPERREDKVHRFAWEPFGGGVHKCLGMHFAGAEIKTVMHHLLRRFHWHVSPGYVAPLNYTSLPFPSDGQPVDLYHRVGGADTP

SEQ ID NO: 27372 - protein, 331 aa, Bacillus sp. BSD-8
GEGREYVPFALRAQELWYELEKETHHKIFTQTGVLVYGAKGQSDFVAETMEAAKIHSLEHELFEGKQLTERWAGVEVPENYEAIFEPNSGVLFSENCIQAYRELAEAHGAKVLTYTPVEDFEVTEDLVTIKTAKGSYTANKLVVSMGAWNSKLLSKLDVEIPLQPYRQVVGFFECDESKYSNNVHYPAFMVEVENGIYYGFPSFGGCGLKIGYHSYGQEIDPDTINREFGAYPEDEANLRKFLEKYMPEANGEFKKGAVCMYTKTPDEHFVIDLHPKYSNVVIGAGFSGHGFKFSSAVGETLAQLAVTGKTEHDISIFSLNRDALKKEAAK

SEQ ID NO: 27373 - protein, 469 aa, Oryza sativa (indica cultivar-group)
MSTAAAGRKKKGGTPEASDAAAAAPARTLGCGVGSATAALPFSRGGRGVGLAPPPRSLGRGGGPAVAAIPPGGFPSYSASMDGFPFPPPFDGSYRGGFPSSSAWLDASGGDESSPGSWDKDVHPRGGFMSYFGNHAQNSHLVGAPIYIADASSPPEVEILQGNDDGNGNGNVRTEKRILWTEEEDIRLMSAWIEHSTDSTCGADKGGGQYWGEVVESYNKTTPPLRKRNLKQCKDRWHKINRWTDLFECAYVKARRIFTSGYSNQMWIDAAHKFYVDDNKEAKLGPFVLMEVWKICREVSKWKTYNENLRNARKRKSFHLEGDSEEADDTFDEMPKRPMGQKAAKKAALDAKIKSNGFGSSDDGHSKESPIQLDKFDRYSKFQEENNDKRMKLLDRQEKISSEKLEATKIAHLTAQEYKEGRKLEKESKMMETYNSLISQDTSSMSAEEKAQRVSMMKCLMKTLFPESD

SEQ ID NO: 27374 - protein, 1010 aa, Geobacter metallireducens GS-15
  misc_feature (191)..(191): Xaa can be any naturally occurring amino acid
  unsure (1)..(1010): unsure at all Xaa locations
MGISRRQFLQRGALAGAAIALSGKPGEASVDAPELRTKGLKTTTTICPFCSVGCGLIVHTKDGRVVNAEGDPQHPINQGALCPKGGALFQIANNENRLQKVKYRAPGSDTWEEKSWDWALDRIAQRMKETRDKSFKKTELNKKDNKEYVVNRTDGMAFFGGAGLDNEECYLWTKFARAMGVGQLEHQARLXHSSTVAGLAASFGRGAMTNHWIDLKNSDVILAIGCNPAENHPVSFKWIEQALDSGAKLIAVDPRYTRTASKSDIYAQIRPGTDIAFLGGIINFALQNNMIHEEYVREYTNATFIVSEQFDFQDGMFCAFDDQEKTYDLKSWAYATTADGKPKRDMGMKDPKSVYQLLKNHYRRYDVDTVCAITGTKKEDYLKVAKAFCGTGRADKAGTILYAMGITQSTHGSQNVRAVALLQMLLGNIGIAGGGVNALRGESNVQGSTDYGLLFHILPGYLKSPEFDNVDLKAYNEKWTPKTKDPKSANWWGNTPKYITSLLKAWYGENATAENDFCYDYLPKRSGNYSYVKIMEKMGKGELEGLVCMGMNPAVGGPDSGKAREALGKLKWLVTADLWETESSIFWKRPGVDPKSIQTEVFMLPAASSIEKEGSISNSGRWAQWRYAAVHPLGDSRSDLHIIDEFYKRVKALYLKQGGAFPEPITKLSWSYGTGHEPDVHMVAREINGYFTKDMTIVDKDKTLEFKKGDQVPMFKYLQDDGSTVSGCWIYCGSYTKDGNQMARRDASDPTGLGLFPKWSWCWPVNRRIIYNRASVNPAGEPFNPKRPVIAWDALEKKWKGDVPDGPWPPMKDDKEGKYPFIMLPEGHGRLYALDMKDGPFPEHYEPVESPARNLLSKVQSNPVVKVPKNVSSDTAKFPYVGTTYRVTEHWQAGAMTRSLPWLVELVPDMFVELSETLAQRKGIKQGDTVKVTTERGSIEAVALVTSRLKPFNVQGRMIEQVGMPWHFGYAGLAKGDSGNVLTPTVGCANTGIPEFKAFLCNIEKGGKRA

SEQ ID NO: 27375 - protein, 501 aa, Hordeum vulgare subsp. vulgare
MMAMATAMAATYGAPIPAPAPSASSPRRAAPDGGRRLRAVAGRPRPLFSPRAVSDSRNSQTCLDPDASTSVLGIILGGGAGTRLYPLTKKRAKPAVPLGANYRLIDIPVSNCLNSNVSKIYVLTQFNSASLNRHLSRAYGNNIGGYKNDGFVEVLAAQQSPENPNWFQGTADAVRQYLWLFEEHNVMEFLILAGDHLYRMDYQKFIQAHRETDADITVAALPMDEERATAFGLMKIDDEGRIVEFSEKPKGEKLKAMMVVTTILGLDSERAKELPYIASMGIYVFSKDAMLRLLRDNFPSANDFGSEVIPGATEIGMRVQAYLYDGYWEDIGTIEAFYNANLGITKKPVPDFSFYDRSAPIYTQSRYLPPSRVLDADVTDSVIGEGCVINHCKINHSVVGLRSCISEGAVIEDSLLMGADYYETENDKKVLSETGGIPIGIGKNTHIKKAIIDKNARIGENVKIINVDDIQEASRESDGYFIKSGIVTVIKDALIPSGTVI

SEQ ID NO: 27376 - protein, 355 aa, Glycine max
APGLIRVYVHQNRISAIPSSIIGCHSLTELYLGNNNISTLPVEIGALSRLGTLDLHSNQLKDYPVEACKLSLLVLDLSNNSLSGLPPEMGKMTTLRKLLLSGNPMRTLRSSLVSGPTPALLKFLRSRLSEDEDSEAVTTTKEVIAMATRLSITSKELSMEGLGLSAVPSEVWESGEVIKLNLSRNSIQELPVELSSCVSLQTLILSKNQIKDWPGSILKSLSSLSCLKLDNNPLRQIPSDGFEMVPKLQILDLSGNAASLLDGPAFSSLPYLQELYLRRMRLSEVPSDIVGLHQLRILDLSQNSLQSIPVGLLEPSLQALRLDGNPLRSIRRTVLDRGTKAVLQYLKDKLPEQEQ

SEQ ID NO: 27377 - protein, 256 aa, Thermobifida fusca YX
MAATVNISDVGQWFAESERTTVLTGAGISTASGIPDFRGPQGLWTRNPGAAAMFDIDIYRSDVNVRREVWRMRRDSPALTAEPNDAHRALVDLDRTGRLLAVITQNIDGLHQKAGLAPERVLEVHGTIHEVECLSCGRRVPTPDVLARLDEESDPRCLACGGIQKAATISFGQRLDPDVLDAAITAAKDCDLFLTVGTSLTVHPVAGLCDIAREHGARLVIINAEPTPYDEVADAVLRDPVETVLPELVQRAVSTA

SEQ ID NO: 27378 - protein, 532 aa, Petunia x hybrida
MDFYTLAFGSIFACGLLYILAKIISKGNKKLPPGPTPWPIIGNLHLLGAKPHISLAQLAQIYGPIMSLKLGQVTTVVISSSAMAKQVLKYQDLAFSTRFVPDALQTHNHNKFSVVWLPVSPQWRTLRRILNTNILSSNRLDSNQHLRSQKLKELLAYCATCSQEAKVVDVGQAVFKTNLNLLSNTLFSKDLADPFSDSKVELKDVIWGVIAEIGKPNLVDYFPILEKIDPQGIRRRTTIHFGKLMRLFDSLINERVEEKRRSHSEKSDVLEVLLNINKENPEEINQNHIKAMFLDLFGAATDTTTSTLEWAMAEILRQPEIMKKAQAELAEVIGKGKPIEEADVSRLPYLQCIIKETFRMHPATPFLLPRKVEQDVEVCGYIVPKGSQVLVNVWAIGRDSTYWEDPLMFKPERFWNLDLDVQGQDFELIPFGAGRRICPGLPLALRMVPVVLGSLLNSFNWKLETGIEPEELDMEEKFGLALAKASSVASYPISYLMFLYDALSKSTSYLQVILISLASFVIWFRSKSYCDK

SEQ ID NO: 27379 - protein, 433 aa, Pinus taeda
MRVEELGGILKPASDLEAAANAKEKLKEKHQLPKESNRMVKHGEGLRQYYLQHIHDLQLQVRQKTHNLNRLEAQRNDLNSKVRALREELQLLQEPGSYVGEVVKVMGKSKVLVKVHPEGKYVVDVDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMSGASGAELKAVCTEAGMFALRERRVHVTQEDFEMAVAKVMKKETEKNMSLRKLWK

SEQ ID NO: 27380 - protein, 903 aa, Porphyra yezoensis
MGDDKPPPPKSRVSRVESYLSTNGFVLTFLGLYILANVILFFFAATPERRLWPVGHYRRNLTPVARGAGNLINFNSAVILLVSARKFMSWLRNTPLNMVVPFDKAMPAFHMLVGRVFLAASVVHVGFHLPVYVVSKPWGPGYNGFTQLFITGSMLVALFAILFVTSVRVNRSKRYELFWYSHAICASLGFVLLMIHGLHYGVYWTYRWAAGPMAVYIIDRLMRRVEQKEVRMEVSRDVGAIKGNSMLCLRLPRSFTYEPGQYAEVKVPAISSVQWHPFTIASAPHEPELVFYIKKSGDWTTNLHAMFASTDPTQVEIKVRGPYGSPAQHVGQFENVVLIGGGVGSTPFASVVKSAHNWMAASSTRGPEMSPSSSFNAAAGQVSVPAATARDATTVPASASLSARLTMQHSTSAATVTAQARMPTVDSLADMDEDLSSNGSRIPAARLSDDAALRPPQAPSSFTSDVLERRVAELDRLYSIADKEDNDRVFPPPSSVQSVVEQDMTGHAVDMDGEDGALSDDDDSSRLDEEEEDQLQSQQSIGRVLRHSAFINSTAGQQLIGLALDADADVVKQRAAAKEGANRRTSVLGAFFGGLKGGDDRRGTLPSEVVRARTKRVAVLQILHSVSVSLALLWAMVARFAIVALASIMRGFSPSTAGLAMFNTRGLVVADLVLASACAVPLAVSLGCEASILGVSVYFRQRGSLVDTLFLLPLLLAGVITDALALAGHGRSAAWFASVNLLVLWPLLLFALLFRLTRVVGSRLVLAQNLQSSHSLRSLDFVWTSPSPEHDAWLVEELLPISRSGTVRLHRHITRSAAEVEPWMLDYDEVPLKTTYKRPDWAAIFAGITERSRSGSVVGVFFCGPHPMSKSIQDGIARATALSLARGYRRGAIGLDGSREMRT

SEQ ID NO: 27381 - protein, 342 aa, Malus x domestica
MENSTQESHLRAENSVTYESPYPLYAMAFASPQTRTRHQHHRIAVGSFIEEYSNRVDILSFDPDTLSIKPNPTLSFDHPYPPTKLMFHPNPNALHKTNDVLASSGDYLRLWEVGDSTVEPIQVLNNSKTSEFCAPLTSFDWNDIEPRRIGTSSIDTTCTIWDIEKGVVETQLIAHDKEVYDIAWGEARVFASVSADGSVRIFDLRDKEHSTIIYESPQPDTPLLRLAWNKQDLRYMATILMDSNKVVILDIRSPTMPVAELERHRGSVNAIAWAPQSCRHICSAGDDTQALIWDLPTVAGPNGIDPMSMYSAGAEINQLQWSAAQPDWISIAFSNKMQLLKV

SEQ ID NO: 27382 - protein, 149 aa, Pisum sativum
MAEQTFIMIKPDGVQRGLVGEIISRFEKKGFYLKGLKFVNVERAFAEKHYADLSAKPFFSGLVDYIISGPVVAMIWEGKNVVTTGRKIIGATNPAQSEPGTIRGDFAIDIGRNVIHGSDAVESANKEIALWFPEGAANWESSLHSWIYE

SEQ ID NO: 27383 - protein, 230 aa, Pisum sativum
MEAMAVFSGSNLFATSSLLLTTNSKTRYSQLRTTQNLSAFSSKSHLFSPSSTSSSYPKTFRTRSSTESGIFLPRLITSLEQVDQAYIMVKPDGVQRGLVGEIISRFEKKGFKLTGLKLFQCSKELAEEHYKHLNQKSFFPKLIEYITSGPVVSMAWEGVGVVPSARKLIGATDPLQAEPGTIRGDFAVQTGRNIIHGSDSPENGEREIALWFKEGELCEWTPVQEPWLRE

SEQ ID NO: 27384 - protein, 348 aa, Sulfolobus solfataricus P2
MKAAVYKGYGLPLEIEEVPNPAPKEGEVLVKVASTGICHSDLHLLSGELVGPLPNGFIIGHEIAGWVEKIGENVKNPYGLKEGDPVLVSWIVPCGICRYCANGKENYCKDNAKRLVGLIGINGGHAEYLTVPEIAVIPLAKNLDPYYSSPIACAYGTAYNALKSANATSGKSVVIVGAGGVGSAAIQLANSIGLNPIVAVDIDENKLKSAKLLGATHIINANENDARAKVLEALEDGADIVYETKPYPDFKLSLEVVKSGGTIVVTGLGGFSTLAQIPVTLFVSRGITLIGSLGYRPRIDLPDLVSLASSGKIDIKKLVSHIYTPDMINEAYENLKKGLHIRAIIRWN

SEQ ID NO: 27385 - protein, 148 aa, Flaveria bidentis
MEQTFIMIKPDGVQSGLVGEIIGRFEKKGFSLKGLKLLTVDRAFAEKHYADLSSKPFFNGLVEYIVSGPVVAMVWEGKNVVTTGREIIGATNPAESAPGTIRGDFAIDIGRNVIHGSDAVESARKVIGLWFPEGVANWSSSLHPWIYE

SEQ ID NO: 27386 - protein, 348 aa, Vibrio cholerae O1 biovar eltor str. N16961
MIFSVLCSDSRRLNALHALISAGFTMDFKAIQALTANDMAKVNETIHAQLNSDVSLINQLGFYIISGGGKRLRPLLAVLSAKALGYQGSHHTTAAAFIEFIHTATLLHDDVVDESDLRRGKATANAAFGNAASVLVGDFIYTRSFQMMTELGSMKILKLMSDAVNVIAEGEVQQLMNCNDPDTTEASYMQVIYSKTARLFEAATQIGAILCDASPEVELAMQNYGKYLGTAFQLIDDVMDYTSDGDEMGKNVGDDLAEGKPTLPLLYAMQHGNPEQAAMIREAIEKANGMSRLNEILAAMEQTGSLQYTIEKALHEADKAIAELAILPESEYKQALITLAHMAVNRSK

SEQ ID NO: 27387 - protein, 225 aa, Nostoc sp. PCC 7120
MLTAILFDLDGTIVNTDPIHYQAWRQMLWKCNIEIDETFYKSRISGRLNPEIVKDILPELSSAAGREFADEKEALFRELASHLQPLNGFAELIAWTEVHQLKRALVTNAPRLNAEFMLEVLGITDSFHQIVLADDCVAGKPDPAPYQVALSKLGIPAEKAIALEDSPSGIRAAVGAGIRTIGIASTHDPDILLEVGSFMAIPDFTDLHLWTLLNSLIEPDLIRST

SEQ ID NO: 27388 - protein, 148 aa, Flaveria bidentis
MEHTFIMIKPDGVQRGLVGEIIGRFEKKGFSLKGLKLLTVDQAFAEKHYADLSAKPFFNGLVEYIISGPVVAMVWEGKNVVTTGRKIIGATNPAESAPGTIRGDFAIDIGRNVIHGSDAVESAKKEIALWFPEGVANWSSSLHPWIYE

SEQ ID NO: 27389 - protein, 1645 aa, Nostoc sp. PCC 7120
MLIDYQRTKVLLIDNSLENWHCLSGFLAETKYLLQRVGTAKISISSVSELMPDIILIDSSIDKIDGHYFCQNLKAEETLQNISILLLTYIDQLSEYSSYFQIGVSDFISKPLCQEELFLRMRNQLKISSQQKNQLEEYHEPFPIGNGLISLNNAVNHNVISNKKECCFQLSDLNNEESINQSLNSQSLVSSNNKITRSKNNTQEYQINAVKLYKHNLVLTKLAKNQVLYQGNLKTALAEITNVAAHNLGIERASIWLYDETLTKIQCADLFEYSRNQHSAGLSLSAKEYPTYFQALHQDEAIAVDDAYTDPRTKEFAQSYLTPLNITAMLDTPIRLAGKTVGVLCLEAVKLPHHWTPEDQNFARSLTNLVSLALEARERQRAEAAHRISEQKLASAFRASPDPIALCTYPETRYIEVNDSFCRLFGYSRSQVIGNTDKELNIWVNLEECHFLSQILEKAKAIRNHEVDFRTSNGEIKTTLFSAEMIEIDGQKYILGTAKDITERKQAEAESRLLLLTTQAIARAVDVKSALTLVLRVICQTIGWDFGEAWTPNRESHVLEHSLVCYCEEASLEEFCHQSQNLRIAPGEGLPGRVWQTKQSEWIEDVSLVKQGQFLRSPQAAKVGLKAGFGIPIIAGKEVLAVLIFFKRSSIPVDKRLLMLLGAVATQLGSLIERKLIESAHRNSEERLQLALEASDLGLWDWNITTGKIYRDWQWQKMLGYTQEDIEDDERVIEQLLHPEDLATVKSAITAHLQGVTPVYEMEFRMRCAAGGWKWVQSRGQIVERNEQGQPLRMTGTTKDITERKILEKELELREARLNAFFSGAPVGMSILDNQLRFVQINELIAHIHGKPAQEHIGKTLEEIAPRIAPLVTPLCQKVLLTGQPILNVELSLPAVNQADSLRHFLVSYFPIPGEGNQLSGVGKVIVEISDVYDELRLRKRAEEALKESIERERAIAQVIQRMRQTLDLDTIFAATTEELRQVLNCDRAVVYRFDSQGSGEFVAESWGKGWISLIEKQKNVPHLTENTAKDQSCLAKLLEYTPQATPDKNFLCVADIYQAGFGSCYIEFLERLQAKAYIIVPILSGDQVWGLLATYQNSGPRQWKTGEINIVIQIGNQLEVALQQAQLLTQTQRQSQALEAAAIAADAANRAKSEFLANMSHELRTPLNAILGFTQIMSHDKTLSKDNQQNLTIINRAGEHLLDLINDVLEMSKIEAGRTTLNINSFDLIHLLDNLQEMMQGRATAKGLHLKFEYAPNIAQHIQADESKLRQVLLNILGNAIKFTETGSIILRVKMGTGDWGLGTEEDTKTHLSIPNTQSPITNPQSLIFEIQDTGIGICDDEVCVLFEAFGQTEAGRKSQQGTGLGLAISRKYVQLMGGDISVSSAVGVGSTFSFQIQVGLVSAHEIPYQPTTRSVIGLAPQQRECRILVVDDVADSRLLLVKLLSSVGFVVQEAANGQEALAIWQQWHPQLILMDMRMPIMDGYEATHFIRSAEIENHTTIPNPHTIIIALTAHAFEEQRQAMLQVGCDDLINKPFSEKEILEKLNKYLGIKYLYQEDSSQTLKARTKIFTHDNLLPLLSTLPRDWLINLYNAAAQCSDDLILKLVGEISAENTALKEYFVDLAHNFQFEKIMEIVSTIKDIS

SEQ ID NO: 27390 - protein, 204 aa, Arabidopsis thaliana
MGLIVDDDNDGEVLIPPPNFSMVEDEIYRSGFPELENFGFLSTLNLRSIIYLCPEPYPEDNLKSLASNNIKLFQFGIEGKTDPPTPMPKDTVLSALRVLVDVRNHPILIHCKRGKHRTGCLVGCLRKVQNWCLSSVLEEYQKCAGLKWRQRDLRFIEDFDVLRLKQCLYSIIYQYNGYGLKRRKLLYQEENVVQEQQKPQATKG

SEQ ID NO: 27391 - protein, 144 aa, Solanum lycopersicum
FIMIKPDGVQRGLVGEIISRFEKKGFSLKGLKLITVDRAFAEKHYADLSAKPFFNGLVEYIVSGPVVAMVWEGKGVVATGRKIIGATNPLESAAGTIRGDFAIDIGRNVIHGSDAVESARKEIALWFPEGIAEWQSSLHSCIYE

SEQ ID NO: 27392 - protein, 552 aa, Sulfolobus solfataricus P2
MEIIKGFPSTMMDDYQLNVTQILEHAGKWIGEQEIISRKKDGTIFRYNYGEAFRRVKKLASSLKSLGVKVGDRVGVLEWNTHRFYELYFAIPATGAVMLELNPRLHPLQLAKIINHSKVSFLFLNEDFIPLVESISNNIPLVKKFILISDIEKTPQTNYYNYESLVEEGNEEYEIPMFDERTSCYAAYTTGTTGDPKGIYYSHRSIVLNTLVISRNITIDDTFMQLVPMFHVNGWLGFMAATLVGAKLVLPGRYTVDNPKPLVDLMINEKVTVTAGVPEVFSSILNYLRSMENKPLFVNSRILIGGSEPPLSLVIGLMEFGFQVGQGYGATETTPSVAGSVVKPRIREKYSDKDMLDLLRKQGIPTFGVDIRVIDPSTGKDVPHDGKTIGELWIRGPWIASAYYNDPRTVESFVGDGVDRWWRSGDLAVVDELGYIKIVDRIKDVIKSGGEWISTVDLENHLMAHPAVAEATVIGVPHPKWGERPLAFVVLRQGFENKVSKEELLGHLGQRFARWQLPDDIIFVKEIPKTSVGKFDKKVLREKYRDFFISSR

SEQ ID NO: 27393 - protein, 366 aa, Saccharomyces cerevisiae
MFSRLPTSLARNVARRAPTSFVRPSAAAAALRFSSTKTMTVREALNSAMAEELDRDDDVFLIGEEVAQYNGAYKVSKGLLDRFGERRVVDTPITEYGFTGLAVGAALKGLKPIVEFMSFNFSMQAIDHVVNSAAKTHYMSGGTQKCQMVFRGPNGAAVGVGAQHSQDFSPWYGSIPGLKVLVPYSAEDARGLLKAAIRDPNPVVFLENELLYGESFEISEEALSPEFTLPYKAKIEREGTDISIVTYTRNVQFSLEAAEILQKKYGVSAEVINLRSIRPLDTEAIIKTVKKTNHLITVESTFPSFGVGAEIVAQVMESEAFDYLDAPIQRVTGADVPTPYAKELEDFAFPDTPTIVKAVKEVLSIE

SEQ ID NO: 27394 - protein, 428 aa, Synechococcus sp. WH 8102
MNTSRSQAIFGAAQGLMPGGVSSPVRAFKSVGGQPIVFDRVKGPYAWDVDGNKYIDYIGSWGPAICGHAHPEVISALQEAIEKGTSFGAPCALENTLAEMVIDAVPSVEMVRFVNSGTEACMAVLRLMRAFTGRDKVIKFEGCYHGHADMFLVKAGSGVATLGLPDSPGVPRSTTANTLTAPYNDLEAVKALFAENPDAIAGVILEPIVGNAGFIQPEPGFLEGLRELTKEHGALLVFDEVMTGFRISYGGAQAHFGVTPDLTTMGKVIGGGLPVGAYGGRADIMGMVAPAGPMYQAGTLSGNPLAMTAGIKTLELLKQPGSYEKLTATTEKLIAGIKEAATAAGLPFTGGSVSAMFGFFLCEGPVRNFEDAKATDSERFGKLHRAMLERGVYLAPSAFEAGFTSLAHSEADIEATVNAFRESFAEVA

SEQ ID NO: 27395 - protein, 524 aa, Oryza sativa (japonica cultivar-group)
MAVDAMFGSVAVALLAVVVAAAALRRWRRRRRRGGGRPLPGPVALPVVGHLHLFRRPLHRTLARLAARHGAAVMGLRFGSRRVAVVSSAPAAEECLGPHDLAFANRPRLPSGEILAYEWSTMGTASYGPYWRHIRRIAVTELLSAHRVQHFADVNVREVRALARRLYRRAAAAAAAGARTRVELKSRLFELLMNTMMSMICERTFYGADDDEVSEEARWFRSVVKETMELSGASTVWDFLPAPARWLDAGRMTRRMRELSDSRTRFLQRLIDDQRKDMDADSDDHAPAKRRTMIGVLLSLQRKDPDSCPDQLIRSLCIGSLQAGTDTSAATVEWAMSLLLNNPGAMARARGEIDACVGQPAARLLEAADLPKLHYLRCVVMETLRLYPPVPLLAPHESSADCVVAGFHVPQGTMLLVNTFAIHRDPQVWDEPEAFIPDRFADGKNEGKMVIPFGMGRRRCPGENLGMQMVGLALGTLIQCFDWERVGEELVDMRECSGLTMPKELPLEALYQPRASMVDLLTKI

SEQ ID NO: 27396 - protein, 459 aa, Burkholderia thailandensis E264
MTQEQRTFDSIVEREKGLRRGLSSGQMAMIAIGGAIGTGLFLGSGFAIGLAGPGVLVSYAIGALIALLLMGALAEMTVAHPTSGSFGAYAEHYVGPLAGFLVRYAYWSAVVFAVGTEVSAIAVFMKYWYPGVPGWYWVVGFSAALIAVNMTSVTLYGVVEYVFSMLKIAAIVVFIALGAYFVATAPASSGIGFANYSAHGGFLPKGFSGVWVAVIVAIFSYMSIETVAIAAGEARDPQRAVSRAFRSTVFRLVLFYLLTLALMLAIVPWTQAGTDESPFVKVMAATHVPYAAGVINFVVLVAALSAMNSQLYVTTRMMFSLSRARLAPAMFGRVGANGVPLAALVVSSSGVAVAAVLVALYPEAAFTLLMAIAMFGALFTWLMIFVTHLCFRARYRGPTPAFRMWLHPAGSLTGAALVGAVLVTTAFTREFRMTMMVGVAFVVLLTLAYRLHYRARHAR

SEQ ID NO: 27397 - protein, 502 aa, Oryza sativa (japonica cultivar-group)
MAAANGGDSKGFEVPKLEIKFTKLFINGRFVDAVSGKTFETRDPRTGEVIAKIAEGDKADIDLAVKAAREAFDHGPWPRMSGFARGRILHKFADLVEQHVEELAALDTVDAGKLFAMGKLVDIPGGANLLRYYAGAADKVHGETLKMARPCHGYTLKEPVGVVGHIVPWNYPTTMFFFKASPALAAGCTMVVKPAEQTPLSALFYAHLAKLAGVPDGVLNVVPGFGPTAGAAISSHMDIDKVSFTGSTEVGRLVMEAAAKSNLKPVSLELGGKSPVIVFDDADLDTAVNLVHMASYTNKGEICVAGSRIYVQEGIYDAFVKKATEMAKKSVVGDPFNPRVHQGPQIDKEQYEKILKYIDIGKREGATLVTGGKPCGENGYYIEPTIFTDVKEEMSIAQEEIFGPVMALMKFKTVEEAIQKANSTRYGLAAGIVTKNIDVANTVSRSIRAGAIWINCYLGFDPDVPFGGYKMSGFGKDMGMDALEKYLHTKAVVTPLYNTPWL

SEQ ID NO: 27398 - protein, 145 aa, Glycine max
MGSLMAGWYSTHMDPQSATLKRNRSLTKDEIDAYWKSKKKIEEEHLRAISNVSETIQASKNTEPEKKLQKSMTMPVTRARDYLNMVDIDTSLEQLIKRNGWWTKSSWAFLNEPPVTEAASNKYASQFHVASMGSSKFNPRDGISA

SEQ ID NO: 27399 - protein, 286 aa, Alkaliphilus metalliredigenes QYMF
MEFKISGYTRLVGLLGYPVRHSLSPLMHNMAFQHLGLDYVYLVFEVKEDNLKEAVDAMKTLDVAGFNVTMPNKQKIIPLLDEISEEARLIGSVNTVVNKNGHLKGYNTDGKGYVMGLADEGISPEGKTIVIAGAGGASKSVAIQLALEGAKEITILNRTVEAAEEICNIINKNIPTCKTSATGYEDNELKQQLKEADLFINCTNLGMGSHEEKSIISSTDILHPDLIVSDVVYAPPKTKLLHMAEEVGCKTINGLGMIIGQGALAFKLWTGEDMPIEYIKRIILSK

SEQ ID NO: 27400 - protein, 278 aa, Thermobifida fusca YX
MISVRDWNLPGGPKGAERLHVRAWAPAAGDPAFLVVLVHGYGEHIGRYEHVARWLCEHGAVCYGVDHRGHGTSSGERVLIDDFAGIVEDVHRVVTQARTAYRALPLVVVGHSMGGLIAARYVQTHPEEVSGLVLSGPVLGEWAVVDELLAHDEIPEVPIDPATLSRDPEVGAAYAADELVWHGPFKRPTLEAFRVELARATAAGKVEAPLLWLHGSDDALVPLEGTVRGILTLAGPDTTARIFPGARHEVFNETNRDEVLGEVARFAARIAAQARDSG

SEQ ID NO: 27401 - protein, 465 aa, Zea mays
MMGPLPLRRRVGVLLFLALVLLGGGGADAGTTSSYRRKLEATVEMPLDADVFRVPPGYNAPQQVHITLGDQEGTAMIVSWVTANEPGNSTVAYGEDPARMERRADGAHTRYDYFNYTSGFIHHCTLRNLKHATKYYYAMGFGHTVRTFWFTTPPKPGPDVPFKFGLIGDLGQTFDSNITLSHYESNGGDAVLYVGDLSYADNHPLHDNNRWDTWARFVERSVAYQPWVWTAGNHELDFAPELGETTPFKPFAHRYPTPYRAAGSTEPFWYSVKVASAHVVVLASYSAYGKYTPQWAWLQAELARVDRKTTPWLVVLTHSPWYNSNNYHYMEGETMRVQFERWLVDAKVDLVLAGHVHSYERSHRVSNVAYDIVNGKSTPVRNADAPVYVTIGDGGNIEGIADNFTRPQPGYSAFREASFGHATLDIKNRTHAYYSWHRNHDGAKVVADGVWFTNRYWMPTDDDTN

SEQ ID NO: 27402 - protein, 260 aa, Mycobacterium avium 104
MLGKPIAHSKSPQLHLAAYRALGLHDWTYERIECDADQLPGVVGGFGPEWVGVSVTMPGKFAALRFADERTERARRVGSANTLVRTATGWRADNTDIDGVAGALGAASGWALVCGSGGTAPAAVAGLAQLGVAGITVVARNPDKAARLVRLGDELGVPTRFCALDGAGLADEVAAAEVLVSTLPAEVAERYAGTLARVGVLLDAVYDPWPTPLAAAVSAAGGRVISGMQMLLHQAFAQVEQFTGLPAPREAMTCAAADAD

SEQ ID NO: 27403 - protein, 154 aa, Glycine max
  misc_feature (20)..(20): Xaa can be any naturally occurring amino acid
  unsure (1)..(154): unsure at all Xaa locations
RVSYVGPPPKSKGKSADGSXLWCTTEDSVYDAVKSMTQHNVGALVVVKPGQNKSIAGIVTERDYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 27404 - protein, 313 aa, Aspergillus nidulans FGSC A4
MTEWKVTIIHADLTSASLTPANGDVQCQFSRQEVYEGLKGIPGTESQWPTPHPPLHSPGSRTPLPRSVNLAVAQNAEFVPSHESQGMLYIRPILFGSSACIQLTPPDKYTFCVYVTPVAAYNGINPLDALILEGFDRAAPRGTGSGKVGGNYAPVMKWSDQARREGYAITLHLDSATRSEVEEFSTAGFVGVKEKADGDGVAVVVPDSGNVVDSVTVRCILAVAARMGWAVERRVTEMVLTGHLGQIKYEELASFSEILACGTAVTVIPIKSITCKSRGNRFTYLEASVSKPGPYAAKLAATLGDIQRGKVET

SEQ ID NO: 27405 - protein, 495 aa, Mycobacterium tuberculosis H37Rv
MAGRRRMKSVEQSIADTDEPTTRLRKDLTWWDLVVFGVSVVIGAGIFTVTASTAGDITGPAIWISFLIAAATCALAALCYAEFASTLPVAGSAYTFSYATFGEFLAWVIGWNLVLELAMGAAVVAKGWSSYLGTVFGFGNGTGHLGSLQLDWGALVIVTLVATLIALGTKLSSRFSAVVTAIKVSVVVLVVVVGAFYIRAANYSPFIPEPEVQHHGGGLDQSVFSLLTGAQGSHYGWYGVLAGASIVFFAFIGFDIVATMAEETKRPQRDVPRGILASLGVVTLLYVAVSVVLSGMVPYTQLRTVPGRGPANLATAFQANGVYWASGIISVGALAGLTTVVMVLMLGQCRVLFAMARDGLVPRQLAKTGSRGTPVRVTVLVAVLVATTASVFPITKLEEMVNVGTLFAFILVSAGVVVLRRTRPDLQRGFTAPWVPLLPIAAVCACLWLMLNLTALTWIRFGIWLVAGTAIYVGYGRRHSAQGLRQARESATRRC

SEQ ID NO: 27406 - protein, 1060 aa, Enterococcus faecalis V583
MPKRTDIKKIMVIGSGPIIIGQAAEFDYAGTQACLALKEEGYEVVLVNSNPATIMTDKEIADHVYIEPITLEFVSRILRKERPDALLPTLGGQTGLNMAMELSESGILDELNVELLGTKLSAIDQAEDRDLFKQLMEELEQPIPESEIVNTVEQAVAFAKRIGYPIIVRPAFTLGGTGGGMCDTEEELRQIAENGLKLSPVTQCLIEKSIAGFKEIEYEVMRDSADNAIVVCNMENFDPVGIHTGDSIVFAPSQTLSDYEYQMLRDASLKIIRALKIEGGCNVQLALDPHSFNYYVIEVNPRVSRSSALASKATGYPIAKLAAKIAVGLTLDEMKNPVTGTTYAEFEPALDYVVSKIPRWPFDKFEKGARELGTQMKATGEVMAIGRNIEESLLKAVRSLEIGAYHNELAELSHVSDLELTKKMVHAQDDRLFYLSEAIRRGYSIEELQSLTKIDLFFLDKLLHIIEIETALESHVDNVAVLKEAKQNGFSDRKIAALWGQTEQAIADFRRANQIVPVYKMVDTCAAEFESHTPYFYSTYEVENESNVSKKPSVLVLGSGPIRIGQGVEFDYATVHSVKAIQAAGYEAIIMNSNPETVSTDFSVSDKLYFEPLTLEDVMNVIDLENPIGVIVQFGGQTAINLAEPLTKQGVKILGTTIEDLDRAENRDLFEQALQELAIPQPPGDTATSAEEAVVIADRIGYPVLVRPSYVLGGRAMEIVENQKDLEDYMRHAVKASPEHPVLVDSYLLGQECEVDAICDGETVLIPGIMEHIERAGVHSGDSMAVYPPQYLSQEIQATIADYTKKLALGLNCVGMMNIQFVIHENRVYVIEVNPRASRTVPFLSKITGIPMAQVATKAILGEKLTDLGYQDGLYPESKQVHVKAPVFSFTKLQKVDTYLGPEMKSTGEVMGSDYYLEKALYKAFEASGLHLPSYGAVLFTIADETKEEALEIAKRFSAIGYSLVATEGTADFLAKHQLPVKKVTKISNPEGETVLDVIRNGNAQVVISTMDKNRSSANQDGFSIRREAVEHGIPLFTSLDTANAILKVLESRAFTTEAI

SEQ ID NO: 27407 - protein, 169 aa, Triticum aestivum
  misc_feature (43)..(43): Xaa can be any naturally occurring amino acid
  unsure (1)..(169): unsure at all Xaa locations
MAPTVMASSATSVAPFQGLKSTAGLPVSRRSNGASLGSVSNGXGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPG

SEQ ID NO: 27408 - protein, 200 aa, Nostoc sp. PCC 7120
MNAFRVGVAGPVGSGKTALVDALCKALRDRYKLAVVTNDIYTQEDAQFLVRSQALTSDRILGVETGGCPHTAIREDASMNLAAIEQLEQRFTDLDLVFLESGGDNLAATFSPELVDLTIYVIDVAAGDKIPRKGGPGITKSDLLVINKTDLAPYVGADLSVMERDAKKMRGDKPFIFTNLKTQQGLNDVIEFVCNHICPV

SEQ ID NO: 27409 - protein, 327 aa, Photobacterium profundum SS9
MNEVDKPEMGHNDLLIRIKKTAICGTDVHIYNWDEWSQKTIPVPMVVGHEYVGEVVGIGQEVRGFTIGDRVSGEGHITCGHCRNCRGGRTHLCRNTTGVGVNRDGAFAEFLVIPAFNAFKIPAGISDDLASIFDPFGNAVHTALSFDLVGEDVLITGAGPIGIMAAAVAKHVGARHVVITDVNEYRLDLARKMGVTRAVNVANEKLEDVMSELGMTEGFDVGLEMSGVPSAFNGMLASMNHGGKVALLGIPPSDMAVDWTQVIFKGLVIKGIYGREMFETWYKMASLIQSGLDLTPIITHHYKIDDFQKGFDMMRSGMSGKVILDWE

SEQ ID NO: 27410 - protein, 985 aa, Arabidopsis thaliana
MEKLEVLDLEGNLMTGSLPDQFTGLRNLRVMNLGFNRVSGEIPNSLQNLTKLEILNLGGNKLNGTVPGFVGRFRVLHLPLNWLQGSLPKDIGDSCGKLEHLDLSGNFLTGRIPESLGKCAGLRSLLLYMNTLEETIPLEFGSLQKLEVLDVSRNTLSGPLPVELGNCSSLSVLVLSNLYNVYEDINSVRGEADLPPGADLTSMTEDFNFYQGGIPEEITRLPKLKILWVPRATLEGRFPGDWGSCQNLEMVNLGQNFFKGEIPVGLSKCKNLRLLDLSSNRLTGELLKEISVPCMSVFDVGGNSLSGVIPDFLNNTTSHCPPVVYFDRFSIESYSDPSSVYLSFFTEKAQVGTSLIDLGSDGGPAVFHNFADNNFTGTLKSIPLAQERLGKRVSYIFSAGGNRLYGQFPGNLFDNCDELKAVYVNVSFNKLSGRIPQGLNNMCTSLKILDASVNQIFGPIPTSLGDLASLVALNLSWNQLQGQIPGSLGKKMAALTYLSIANNNLTGQIPQSFGQLHSLDVLDLSSNHLSGGIPHDFVNLKNLTVLLLNNNNLSGPIPSGFATFAVFNVSSNNLSGPVPSTNGLTKCSTVSGNPYLRPCHVFSLTTPSSDSRDSTGDSITQDYASSPVENAPSQSPGKGGFNSLEIASIASASAIVSVLIALVILFFYTRKWHPKSKIMATTKREVTMFMDIGVPITFDNVVRATGNFNASNLIGNGGFGATYKAEISQDVVVAIKRLSIGRFQGVQQFHAEIKTLGRLRHPNLVTLIGYHASETEMFLVYNYLPGGNLEKFIQERSTRDWRVLHKIALDIARALAYLHDQCVPRVLHRDVKPSNILLDDDCNAYLSDFGLARLLGTSETHATTGVAGTFGYVAPEYAMTCRVSDKADVYSYGVVLLELLSDKKALDPSFVSYGNGFNIVQWACMLLRQGRAKEFFTAGLWDAGPHDDLVEVLHLAVVCTVDSLSTRPTMKQVVRRLKQLQPPSC

SEQ ID NO: 27411 - protein, 251 aa, Sulfolobus solfataricus P2
METEIPIRIYYPDNKRDHPIILHFHGGAWILGSIETEDSVSRILANSCNCIVISVNYRLAPEHKFPAAVTDCFDSIKWTYENAESIGGHPNRIAVFGISAGGNLAAATSILSRDQGIKLRAQALVVPFVYLDLASTSMTEYRKGYFLDINVPIDYGIMMYIRDEKDLLNPMFVPLIAEDLSNLPQAIIVTAEYDPLRDQGEAYAKRLMEAGVLTLSFRVNGMVHGFLGSPNISRLVSVMVGSALKDILMRG

SEQ ID NO: 27412 - protein, 128 aa, Triticum aestivum
MVRISVLNDALKSMFNAEKRGKRQVMIRPSSKVIIKFLIVMQKHGYIGEFEYVDDHRSGKIVVELNGRLNKCGVISPRFDVGVKEIEGWTARLLPSRQFGYIVLTTSAGIMDHEEARRKNVGGKVLGF

SEQ ID NO: 27413 - protein, 603 aa, Rhodococcus sp. RHA1
MTTGTTEPDVLVVGTGFAGLCMAIKLKEAGEENVVVLEKADRVGGTWRENTYPGCGCDVMSLMYSFSFAPNRKWTRMYARQPEILDYIERVVRDYDLAPHIRFGAEVISYEFDETTDRWRVETRSGSVYHPRIVVAGPGPLHKPSVPDLPGRKSFSGVAFHSAEWDHSVDLTGKRVAVVGTGASAVQFVPEVAKTAAHVDVFQRTPHWILPKLDRPITAGEKAVFKAVPGVQKAYRGAIYWSHESLIAGFLHPRLMTVLESAARGLLRRQVRDPELRATLTPDYIIGCKRILVSSNFYPALQRGNVDLVTSGISEVTERGIRTDDGTMHEADVIVYGTGFAAGDRFENEHIVGRRGLTIQRAWRDGMEAYLGVAVAGFPNFFLMMGPNSGGGNQSIVFVIEAQAHYITRCLALMKKRDATRIEVRAGAQREFNRVVHRKLAGSVWNSGGCDSWYLDSTGHNRAAWPGSSASYWRRMRTPDDRHFELSSLAEREDDTEYRGPGVLTSGDLTVAVEVFLNGHIEPLDGLYHWYGRVVGDGVDAAKGRNRTPLFLTIGDGPEVPAALAERDPWGHFRIAGVGTPPFPLAPVEVEVPISRAKLASAE

SEQ ID NO: 27414 - protein, 311 aa, Sulfolobus solfataricus P2
MPLDPQVKELLTKINLLLPTTPLTPQEFRKVRNELFIKMFNNEKVGLYNIRDMTIPVRNGDIKVRVYFPNQRENLPAVVYYHGGGFVYGNLDTHDSVCRLISKLSNTIIVSVDYRLAPEHKFPTQVYDAYDVVKWLANNGGKLSIDTSKIAVAGDSAGGNLSTVVSILDRDNGENVVKYQIMIYPVVNMLDSSPSMYNYGDGYFLTYERILWYNKQYVKEDSDYYNPLASPILAESHNLPPALIITAEYDPLRDQGEMYAHKLKVSGVKTISLRYNGMIHGFVSFYEYLDTGKEAIHHIASSIRKMFNVFY

SEQ ID NO: 27415 - protein, 208 aa, Alkaliphilus metalliredigenes QYMF
MKIKTSDIVMSAVAPKQYPEEGLPEIALAGRSNVGKSSLINTILNRKKLARVSSSPGKTRTLNFYLINKEFHLVDLPGYGYARVSKGEKSSWGKMLETYLSNRPNLYEVVLLIDIRHEPSEQDQQMYQWIRHYGYGTIVVATKSDKIARSQHQKHFKMIRDTLGMSPEDRLIPISSLKKLGIEQLWGALEDIFVENELPITIEKEAPK

SEQ ID NO: 27416 - protein, 499 aa, Shewanella sp. ANA-3
MAQDLSSLPTALYTQQQVRAAELLAVSEGETTLYQLVERAGRAAFECFTQQRERHPQLEGMPLLVLAGSGNNGADALVCARLALEAGHQVKVYLLKTQGTAEFEHALSAYLNQGGVIDSPNIEAIQQAPVIIDGLLGTGVKGAVREDIAALIHAVNQSEAWVLSLDLPSGIVADTGVALYVAVMADVTLCFGGLKQGLLTSKARHHCGHLTFADLGLTPFFDAENATRVGGEMLKSHFAARARDSHKGQSGKVTLIGGDFGMAGAIRLASEACLRAGAGLVTVISRPEHQLTVNVSRPELMFWGCELVDMEVYLRLGWAQVVVLGPGLGKHDWGYNLFKAAGLSDKPCVLDADALNLLSQEPRRQTNWVLTPHPGEAARLLGCSVADIEQDRFAAVRALQQKYGGVVLLKGAGTVIFDGKQMVVAPVGNPGLASGGCGDVLSGIIGALMAQGMDNMQATVVGVVVHGCAADLAAVQGERGMLASDLMPFIRQLVNSDLL

SEQ ID NO: 27417 - protein, 154 aa, Synechococcus sp. WH 8102
MAADPKDTTVTDENTETAATAEVETVASAPTSPAQKLSAEALIKAFETEQMKSDLPEIYVGDTVRVGVRISEGNKERVQPYEGVVISKRHGGMNQTITVRRIFQGIGVERVFMLHSPQVANIKVERRGKVRRAKLFYLRERVGKATRVKQRFDR

SEQ ID NO: 27418 - protein, 1087 aa, Debaryomyces hansenii CBS767
MKGRRGRSKTQKLCMSSDQSRSPAYEHCSSYQNSHIDNDNDNSSPNYYLEPNLVKNITPRLEYTNIDKNDVPIQTPGSDRRVHRIKSLNKIDIRSPIVPRNSVLTPGSYNFGLDRAHSADVYRSTHTELSSLNTARTNPTLASRLLSGIPDKLYAMRDYYNDFTTIDWAKAFTLTNRFNYELHHNKWIVDNPSNGEEQESVNIPFYYKTYLVLGKWVLIVIIGFLFSLIAYLIDKIEILLVGLKHGYCRSNWFASQVSCCVNSEPTIPPPRMNSISMNIFKSGYVFSTKPNNQKSVQCPDWISWSTLFERQPYEKLRLDFVIYVVLTLVLAYLACVVTLSTKITSRLSVASSKKDKMNIYDSSANLLGPNSYIRRKESDEDYSYDGDEDTNVSARVMYTACGSGVPEVKTILSGFVIRRFLGTYTLFAKTIALIFAIASGMALGKEGPYVHLATAVGNIMTRFFPYINNNDFMKKQILSASASSGVALAFGSPLGGVLFILEEINHYLPSHQLFQIFFCAIISTLFLKFLNPYGTGNTVLFELKYTSDWNAVELIFFIIIGISGGIFGGLFVRFVGWWPKKFRQLKMIKNHPIIEVFFISLLTGLITFWNPYTKQASSELVLDLATSCNSQGLDLSLCPVTHEQFVKELGSLIFALVVKMVLTCLTFGLKLPCGIYVPSMVIGALYGRTFAMFIQWSNYKYNLNLGDEGASAPSTSLMRFICSPDSSNNECVDLGIYSMISAGAFMAGITRMNITLVTILFELTSSYTYVLPISISISVANWLGSLIEKKSLYESLLVLNDYPFMSPETEALDPFVTAGEIITDIDSYDQDDDEELNLRHRSRAVNDTTSGRIYTSKRPPFHANKLTNFDSLETNDYSTDRNFEKLYIDISASPYVAASLLQSKLILLADKLLLDGCIPLIKNEVCVGLIYFSELEYCLDKLKEFCLKYEIMDDIFCKLLDEVHYPINENTMNPLNHNLSIVRNISDTPSSQLSDGDYFNYGATTDRCLNSDSNWENLQTVLFDLSNLIRHVDYSPIFLNYDSELSLAHLIFDKIGNRVIVLLKEGRYYGVLQKKVLIDYCRREESK

SEQ ID NO: 27419 - protein, 384 aa, Zea mays
MLAARSFASPARQCLRQANRSRWAPALSQVSARTYASEVAKFHGTKGSDGKYCVTLIEGDGIGPEIAQSVKDIYSAANVPIKWESVDVTPRLNEEGKTVISDESIASVKKNLVALKGPLATPIGKGHVSLNLTLRRTFNLFANVRPCRSIAGYKTPYDDVDTVLIRENTEGEYSGIEHIVVDGVVQSIKLITREASERVLRYAFQHARDIGRKKVRAVHKATIMKMSDGLFLSTAREIAKDFPDIEFDAELLDNTCLKMVTDPVPYNDKVLVMPNLYGDILSDMCAGLIGGLGLTPSGNIGDNCSIFEAVHGSAPDIAGKQLANPTALLLSSIMMLRHMGLNSEAANIEQAIFKVLAEGKTITGDLGGKAKTFEYADAVIKALK

SEQ ID NO: 27420 - protein, 131 aa, Arabidopsis thaliana
  misc_feature (40)..(40): Xaa can be any naturally occurring amino acid
  misc_feature (53)..(53): Xaa can be any naturally occurring amino acid
  misc_feature (55)..(55): Xaa can be any naturally occurring amino acid
  misc_feature (58)..(58): Xaa can be any naturally occurring amino acid
  misc_feature (81)..(81): Xaa can be any naturally occurring amino acid
  misc_feature (97)..(97): Xaa can be any naturally occurring amino acid
  misc_feature (110)..(110): Xaa can be any naturally occurring amino acid
  unsure (1)..(131): unsure at all Xaa locations
VSKTKSKEEKRASSMLLFGLLMGWPLGLRATRVAPLKGLXKSSAAFPATGKGXNXITXSIKSKGGRVTACRVWPPMGKKEXRPLSLPSLTLTDSELXREVDYLIGNSGFXCVEFELEHGFVYREPGNSPGY

SEQ ID NO: 27421 - protein, 265 aa, Mycobacterium tuberculosis
MANTGSLVLLRHGESDWNALNLFTGWVDVGLTDKGQAEAVRSGELIAEHDLLPDVLYTSLLRRAITTAHLALDSADRLWIPVRRSWRLNERHYGALQGLDKAETKARYGEEQFMAWRRSYDTPPPPIERGSQFSQDADPRYADIGGGPLTECLADVVARFLPYFTDVIVGDLRVGKTVLIVAHGNSLRALVKHLDQMSDDEIVGLNIPTGIPLRYDLDSAMRPLVRGGTYLDPEAAAAGAAAVAGQGRGGVPRGAAALEHHHHHH

SEQ ID NO: 27422 - protein, 556 aa, Enterococcus faecalis V583
MKTDINIAQAATLKPIQEIAETIGLSEDSLELYGKYKAKIDFPTLQSLEAQPEGKLILVTSINPTPAGEGKSTVTIGLGDALNQINKKTVIALREPSLGPVMGIKGGATGGGYAQVLPMEEINLHFTGDMHAITTANNALAALLDNHLQQGNELKIDSRRVIWKRAVDLNDRALRQVVVGLGGPFQGVPREDGFDITVASEIMAILCLAQNLTDLKERLSRIIVAYNDQREPVTVKDLNVAGALTLLLKDALKPNLVQTIEGTPAFVHGGPFANIAHGCNSILATKTALHLGDYVVTEAGFGGDLGGEKFLDIKVPSLGKAPDAVVIVATIRALKMHGGLAKDQLAEENLPALQKGFANLEKHIQNMQRYDVPVVVAINEFTQDTEKEIQLLKEACQALGVPVELTSVWAQGGAGGTNLAKTVVAEIEADTKQFQPLYNPRQTIEEKIQAIVQTIYGGEQAIFSPKAQKQIADFTKNGWDQLPICMAKTQYSLSDDPQKLGRPEGFTITIRELVPKIGAGFIVALTGDILTMPGLPKVPAALNMDVDETGQASGLF

SEQ ID NO: 27423 - protein, 510 aa, Pseudomonas syringae pv. syringae B728a
MTATPKPLVLIILDGFGHSESHKGNAILAAKMPVMDRLYQTMPNGLISGSGMDVGLPDGQMGNSEVGHMNLGAGRVVYQDFTRVTKAIRDGEFFENPTICAAVDKAVSAGKAVHIMGLLSDGGVHSHQDHLVAMAELAVKRGAEKIYLHAFLDGRDTPPRSAKKSLELMDATFARLGKGRTATIVGRYFAMDRDNRWDRVSSAYNLIVDSTADFHADSAVAGLEAAYARDENDEFVKATRIGEAARVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIVVNYANGDMVGHSGIMEAAIKAVECLDVCVGRIAEALEKVGGEALITADHGNVEQMTDDSTGQAHTAHTSEPVPFVYVGKRQLKVRQGGVLADVAPTMLHLLGMEKPQEMTGHSILVAE

SEQ ID NO: 27424 - protein, 372 aa, Urtica dioica
MMMRFLSAVVIMSSAMAVGLVSAQRCGSQGGGGTCPALWCCSIWGWCGDSEPYCGRTCENKCWSGERSDHRCGAAVGNPPCGQDRCCSVHGWCGGGNDYCSGSKCQYRCSSSVRGPRVALSGNSTANSIGNVVVTEPLFDQMFSHRKDCPSQGFYSYHSFLVAAESFPAFGTIGDVATRKREVAAFLAHISQATSGERSDVENPHAWGLCHINTTTVTENDFCTSSDWPCAAGKKYSPRGPIQLTHNFNYGLAGQAIGEDLIQNPDLVEKDPIISFKTALWFWMSQHDNKPSCHDIVLNANSAANRIPNKGVIGNIISRAFGHDDFAVRSSSIGFYKRYCDMLGVSYGHDLKYWFDNTPSSEFQRIQMRVAA

SEQ ID NO: 27425 - protein, 404 aa, Propionibacterium freudenreichii subsp. shermanii
MVKKVALLTAGGFAPCLSSAIAELIKRYTEVSPETTLIGYRYGYEGLLKGDSLEFSPAVRAHYDRLFSFGGSPIGNSRVKLTNVKDLVARGLVASGDDPLKVAADQLIADGVDVLHTIGGDDTNTTAADLAAYLAQHDYPLTVVGLPKTIDNDIVPIRQSLGAWTAADEGARFAANVIAEHNAAPRELIIHEIMGRNCGYLAAETSRRYVAWLDAQQWLPEAGLDRRGWDIHALYVPEATIDLDAEAERLRTVMDEVGSVNIFISEGAGVPDIVAQMQATGQEVPTDAFGHVQLDKINPGAWFAKQFAERIGAGKTMVQKSGYFSRSAKSNAQDLELIAATATMAVDAALAGTPGVVGQDEEAGDKLSVIDFKRIAGHKPFDITLDWYTQLLARIGQPAPIAAA

SEQ ID NO: 27426 - protein, 316 aa, Vibrio cholerae O1 biovar eltor str. N16961
MRQTNNKESTMKPTADILASIIEEVRPLTSKGIVADYIPALAKVPSDKLGIAVFTNQGEVITAGDAQEGFSIQSISKVLSLTLAMGLYQPDELWSRVGKEPSGQAFNSLIQLEMEQGIPRNPFINAGAIVVCDMLQSRLSAPRQRLLEFVRQLSGEPQIAYDKVVAASEMMHSDRNAAIAYLMRSFGNFHNEVIPVLHNYFHACALKMSCVELAKTFSYLANKGVSVVTGETVITPTQSKQTNALLATCGLYDGAGEFAYRVGMPGKSGVGGGIIAVVPGEMTIAVWSPALDQSGNSLAGTRALELLAQRIGRSIF

SEQ ID NO: 27427 - protein, 327 aa, Prochlorococcus marinus str. MIT 9301
MAGTLLFNALKEAIDEEMANDVNVCVMGEDVGQYGGSYKVTKDLYEKYGELRVLDTPIAENSFTGMAVGAAMTGLRPIVEGMNMGFLLLAFNQISNNMGMLRYTSGGNYKIPTVVRGPGGVGRQLGAEHSQRLEAYFHAVPGIKIVACSTPTNAKGLMKAAIRDDNPVLFFEHVLLYNLSEELPEGDYICALDQADVVKAGKDITLLTYSRMRHHCLKAVEELEKKGIDVELIDLISLKPFDMETISKSIRKTNKVIIVEECMKTGGIGAELIALITEECFDDLDARPIRLSSQDIPTPYNGNLENLTIIQPHQIVEKVEDLISGSI

SEQ ID NO: 27428 - protein, 1292 aa, Coprinopsis cinerea okayama7#130
MSQPFSYNPPPTSSGRPTTSTGPRPGTSNPFRQLVEQQQQQGQTGAGEGGYLDGSSQPPPTYNSRNPYSNYGYDASERPPPSSYGTRPPQSSYGFGRGGGGRGYPEDDYEEEESDDENVFAFLPPTTADLEEEKRRNEEEENRRREQERIAAAQGQQQGDGGVQLHLGLLGAAGLHQHYQQQQQPQASTSMMKPITDEDRARDWEEEERRRIREEHSFAFSVDTQPGLGGTAEPSPTHSTGRRKQYPPTADSEDYGGPSYDRSQFTFAYAPPVTPPSTDSNGPSRAGLGTSDQDGFKMTRLDRDGRRSVDESSRRKSGEPERKNSDGRLQDEEKYREDDSVTVASSGLASPKGKENEDLEANRTGVAKEVKEEEGRPEPGVFGRHWQHFQPNPARYNSNSGPYKMHREYYYNQAYPQYAKSRAGSSGMDNSTKAGGSSRRRRRRRHPPGTADTNATGMSTATSEYLASSEYTDMPGSTKDRPGTGFDSLGYLKETSQSELDEYDEDDYDEYDGESREGSIKMQFDFDDIEDEDSPYPEVRASVSNIDDPDMPAMTIRMWFIGLVLCTASSALNVFLNFRYPAPAVTPLVLLLLAYPIGKFLAFTLPITTYRIPLPYIPSRLVPSNLPNALSRVLAPLTFQHAIEFSLNPGPWNIKEHVLVYIMANVAINSPYALNAIVVLEVFYEFPTGYWFSIVLVLATQMTGFGLAGMCRRFLVWPASMVWPQNLVACTLLNTLHAEDEDDGIGMLGGPTLEDDPNTEGGRRRKRGMSRYKFFIWTTLGGFLFYFLPGYLFQALSFFSFVCWAAPNNVVVNQLFGVSSGLGMSMLTFDWSQITWIGSPLMVPWWAEVHVFVGFVLFYWILTPILYYTNSWQSAYFPISASSPYDRFGNRYDIARVLKHDDTFDLEAYEAYSPLFLPATFAVTYLLAFCLSTCVIVHTVLYHGHTLLSGFRKIRPENDDIHAKLMRNYPEVPDWWYLCSFGLFFALAIIAVEIWDTSVPIWALILSLILPIVYIMPSGFIYAMTGQAYNLNILAQIIPGTLLPGQPLANMVFKAYSLQTLSAGINFTQDLKLGHYVKVPPRATFLVQMIATTLAAFIQVGVKHWIFSNVKDICDKNQPSKLVCPHSQVFYTASAIWGLIGPTRQFGPGSLYHPHLFATIVGVFLPIPFWLWRRRYPDSWVKWVSTPVILIGVSWIPPATGINYSSWFLVGFIFQYLIRKRNFAWWSKFNYVLSSALDSGTVIAVIFIFFTLQFPKDGIEVNWWGNNVFTGTADWRGESLLEVPEGGIPWKS

SEQ ID NO: 27429 - protein, 559 aa, Bartonella quintana str. Toulouse
MRYKFMGDSLSIRNEKAFEAALQALRRHATKDGVYDIRRHFVEDEQRFSHFSLRLDDLLFDFSKCGITFKTLQLLDDLAVAADVLGRREAMFSGKAINTTEKRSVLHIALRMPTDEVFMLDGHDLVRDIQDVLAHMERFSEMVRDGSYKGNTGEKIINIVNIGIGGSDLGPAMVTHALKPYHDGPHCHFVSNADTAHISDTLSVLNPATTLFIIASKTFTTAETIANAQVARQWIISHLGEEAVCRHFVAVSSALDKVAEFGIDSSRIFKFWDWVGGRYSIWSAIGLVVMLAIGGQNFRQFLNGAQQMDRHFKIAPLHKNIPIRFALLGFWHRVVCGYASRAIIPYAQRLARFPAYLQQLDMESNGKQVSLDGKTLNFSSGPVVWGDSGTNGQHAFFQLLHQGTDVIPVEFILFIKGHEQNLHPMYDILVANCLAQSKALMKGRSVEDVRRILVKSGIDVHETEKLALHKSFEGNRPSIMLVQDLLTPFTLGRLIALYEHRIFVEGILMNINSFDQWGVEFGKELANELLPILRGENKANNRDSSTLGLLAYIQARREE

SEQ ID NO: 27430 - protein, 433 aa, Spinacia oleracea
GASFSLHVLSKINSYKSQSTKPIRGVASMAKKSVGDLTSADLKGKKVFVRADLNVPLDDSQNITDDTRIRAAIPTIKHLINNGAKVILSSHLGRPKGVTPKFSLAPLVPRLSELLGLQVVKADDCIGPDVEKLVAELPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGMSVGSSLVEEDKLDLATSLLAKAKEKGVSLLLPTDVVIADKFAADADSKIVPASGIPDGWMGLDIGPDSIKTFSEALDTTQTVIWNGPMGVFEFEKFAAGTEAIAKKLEEISKKGATTIIGGGDSVAAVEKVGVAEAMSHISTGGGASLELLEGKQLPGVLALNEADPVPV

SEQ ID NO: 27431 - protein, 125 aa, Oryza sativa (indica cultivar-group)
MEVAKPRWYERTLVLAIQRVFFNTYFIGYLLSPKLAHRVVGYLEEEAIHSYTEYLKDIEAGKIENVPAPPIAIDYWRLPTGATLKDVVVVVRANEAHHRDVNHFASDVHFQRMDLKDTPAPLDYH

SEQ ID NO: 27432 - protein, 755 aa, Candida dubliniensis
MSDSKMSSQDESKLERATSQDSSSENHSINEYHGFDAHTSENIQNLARTFTHDSFKDDSSAGLLKYLTRMSEVPGVNPYEQEEINNEQLDPDSENFNAKFWVKNLRKLFESDPEYYKPSKLGIGYKNLRAYGVANDSDYQPTVTNALWKLATEGLRHFQKDDESRYFDILKSMDAIMRPGELTVVLGRPGAGCSTLLKTIAVNTYGFHIGKESQITYDGLSPKDIEHHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGYEDKVPRTPQEFEAYWKNSPEYAELIQEIDEYFVECEKSNTRETYRESHVAKQSNNTRPASPYTVSFFMQVRYGVARNFLRMKGDPSIPIFSVFGQLVMGLILSSVFYNLNQTTGSFYYRGASMFFAVLFNAFSSLLEIMSLFEARPIVEKHKKYALYRPSADALASIISELPVKLAMSMSFNFVFYFMVNFRRNPGRFFFYWLMCVWCTFVMSHLFRSIGAVSTSIAGAMTPATVLLLAMVIYTGFVIPTPSMLGWSRWINYINPVGYVFEALMVNEFHGREFQCAQYVPSGPGFENVSRSNQVCTAVGSIPGNEMVSGTNYLAGAYQ

SEQ ID NO: 27433 - protein, 1501 aa, Candida dubliniensis
MSDSKMSSQDESKLERATSQDSSSENHSINEYHGFDAHTSENIQNLARTFTHDSFKDDSSAGLLKYLTHMSEVPGVNPYEQEEINNEQLDPDSENFNAKFWVKNLRKLFESDPEYYKPSKLGIGYKNLRAYGVANDSDYQPTVTNALWKLATEGLRHFQKDDESRYFDILKSVDAIMRPGELTVVLGRPGAGCSTLLKTIAVNTYGFHIGKESQITYDGLSPKDIEHHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGYEDKVPRTPQEFEAYWKNSPEYAELIQEIDEYFVECEKSNTRETYRESHVAKQSNNTRPASPYTVSFFMQVRYGVARNFLRMKGDPSIPIFSVFGQLVMGLILSSVFYNLNQTTGSFYYRGASMFFAVLFNAFSSLLEIMSLFEARPIVEKHKKYALYRPSADALASIISELPVKLAMSMSFNFVFYFMVNFRRNPGRFFFYWLMCVWCTFVMSHLFRSIGAVSTSIAGAMTPATVLLLAMVIYTGFVIPTPSMLGWSRWINYINPVGYVFEALMVNEFHGREFQCAQYVPSGPGFENVSRSNQVCTAVGSIPGNEMVSGTNYLAGAYQYYNSHKWRNLGITIGFAVFFLAIYIALTEFNKGAMQKGEIVLFLKGSLKKHKRKTAAAKKGDIEAGPVSGKLDYQDEAEAVSNEKFTEKGSTGSVDFPENREIFFWKDLTYQVKIKKEDRVILDHVDGWVKPGQITALMGASGAGKTTLLNCLSERVTTGVITDGERLVNGHALDSSFQRSIGYVQQQDVHLPTSTVREALQFSAYLRQSNKIPKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVRDEISRMEVELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVVVGTIAFFCWYYPLGLYSNATPTDSVNPRGVLMWMLVTSFYVYTSTMGQLCMSFSELADNAANLATLLFTMCLNFCGVLAGPSVLPGFWIFMYRCNPFTYLIQAMLSTGLANTFVRCADREYVSVQPPNGQTCSSYLDPYIKMAGGYFETNNDGSCSFCQMSSTNTFLKSINSLYSERWRNFGIFIAFIAINIILTVLFYWLARVPKGNREKKNKK

SEQ ID NO: 27434 - protein, 1500 aa, Candida dubliniensis
MSTTSNTSLSQQLDEKPWVDVSDDSSVQEYQGFDATASHNIQDLARKLTHDSTKGDHHAANNLARYLSHMSDIPGVSPFNGNINHEQLDPDSENFNAKYWVKNLKKLFDSDSEYYKPSKLGVAYRNLRAFGVANDSDYQPTVTNALWKFTTEAINKLKKPDDSKYSDILKSMDAIMRPGELTVVLGRPGAGCSTLSKTISANTYGFNIGKESHITYDGLTPKDIESNYRGDVIYSAETDYHFPHLSVGDTLEFAARLRTPQNRGEGIDRETYAKHMANVYMATYGLSHTRNTKVGNDFVRGVSGGERKRVSIAEASLSGANIQCWDNATRGLDSATALEFIRALKTSAVILDTTPLIAIYQCSQDAYDLFDNVVVLYEGHQIFFGRASKAKEYFEKMGWKCPQRQTTADFLTSLTNPAEREPLPGYEDKAPRTAQEFEVYWKNSPEYAALVGEIDNHLIECEKSNTKSYYHETHVAKQSNNTRPSSPYTVSFFMQVRYVMARNFLRMKGDPSIPLVSILTQLVMGLILASVFFNLRKSTDTFYFRGGALFFSVLFNAFSSLLEILSLYEARPIVEKHRKYALYRPSADALASIISELPVKLLMTMSFNIVYYFMVNLRRTPGNFFFYWLMCALCTLVMSHLFRSIGAVTTTIATAMSISTVFLLAMIIYAGFVLPIPYILGWSKWIRYINPVTYIFESLMVNEFHGREFKCGQYIPSGPGYESLSVENKVCTTVGSTPGSTVVQGTEYIKLAYQFYSSHKWRNFGITVAFAVFFLGVYVALTEFNKGAMQKGEIVLFLRGSLKKHKRKTAASNKGDIEAGPVSGKLDYQDEAEAVSNEKFTEKGSTGSVDFPENREIFFWKDLTYQVKIKKEDRVILDHVDGWVKPGQITALMGASGAGKTTLLNCLSERVTTGVITDGERLVNGHALDSSFQRSIGYVQQQDVHLETTTVREALQFSAYLRQSKKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPEEANPAEWMLQVVGAAPGSHSKQDYFEVWRNSSEYQAVKDEISRMEVELSKLPRDNDPEALLKYAAPLWKQYLLVSWRTIVQDWRSPGYIYSKIFLVVSSSLFIGFSFFKSKNNLQGLQSQMLAVFMFFIPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAASLATTLFTLCLMFCGVLAGPDVIPGFWIFMYRCNPFTYLIQAILSTGLANAKVTCAPRELVTLKPPMGETCSSFIGPYTKAAGGYFSTNSDGTCSVCRIDSTNQFLESINAMFSQRWRNFGIFVAFIAINIILTIFFYWLAKVPKGNREKKMKK

SEQ ID NO: 27435 - protein, 373 aa, Debaryomyces hansenii CBS767
MTVDLDQYAKPGKDYYLALGLEGSANKLGVGVIKHNLGQLSLDNRAEILSNVRDTYVTPPGEGFLPRDTARHHRNWAVRIIKKALIEAKVKGSDLDCICFTQGPGMGAPLQSVVIAARTLSQLWDLPLVGVNHCVGHIEMGREITGADNPVVLYVSGGNTQVIAYSRQRYRIFGETLDIAIGNCLDRFARTLRIPNEPAPGYNIEQMAKKGKHLVPLPYTVKGMDLSMSGILAHVDSLAKDLFAENKNKKLIDDETGEQITSEDLCFSLQETLFSMLVEITERAMAHVQSNQVLIVGGVGSNERLQQMMELMVNDRKNGSIFATDERFCIDNGIMIAHAGLLGYRMGQTNELWNTVCTQRFRTDEVFVKWRDD

SEQ ID NO: 27436 - protein, 354 aa, Synechococcus sp. WH 8102
MTSVLALETSCDESAAALVWRDADGRFEVSSARIASQVEEHARWGGVVPEIASRRHVEALPGLIQQVLDESDSTLAEVDAIAATVTPGLAGALMVASVTGRTLSALRDRPFLAVHHLEGHLASVHLAEHRPQLPYLVLLVSGGHTELIRVEADGAMERLGRSHDDAAGEAFDKVARLLGLGYPGGPAIQAAAEGGDGRRFKLPKGRISLPEGGFHPYDFSFSGLKTAMLRTVEAQSGPLPTADLAASFEQVVVDVLVERSLRCAMDHGLEELVMVGGVAANRRLRQTLEQRSNAVGVRVSVAPLAYCTDNAAMIGAAALLRWDAGARGCSLRTGVSARWPLAQVDQLYTEQPAF

SEQ ID NO: 27437 - protein, 309 aa, Xylella fastidiosa Ann-1
HSADGTHKWLLAMGTDRKNAIETVYIPDKGRGTLCVSSQIGCGLNCTFCSTATQGFNRNLTTAEIIGQVWVAARHLGNVPHQRRRLTNVVMMGMGEPLMNFDNVVRAMSVMRDDLGYGLSNKRVTLSTSGLVPMIDRLSTESDVSLAVSLHAPNDKLREQLVPLNKKYPIVELMASCERYLSVNRKRDSVTFEYTLMKGVNDKQEHAHELAKLMRQFDCAMQVKGAAKVNLIPFNPFPGTCYERSTEVDIRAFQKILLDAQILAMVRRTRGDDIDAACGQLKGQVVDRTRRQAEFRRTIEDRVGRDVAA

SEQ ID NO: 27438 - protein, 443 aa, Thermotoga neapolitana
MKYDVVIVGGGPAGLVAAFTTKRFYKDKKILVVKKTEKETVPCGIPYIFHTLSGVENDYMGIEERFKSAGIDLLIDVVVDGNTDEKKLLTKTGKEIFYEKLIIATGSTPNVPNIPGVDLEGVFTVPKDANYLKMLYEKIKDSKNVVIIGGGFIGVEVADELKKSGKNVTLVEIMDSLLPVSFDPDFGEIARKEIEAENLKVLTGRKVTEIYGSKRVEGVRLDNAETILADAVILATGYRPNSDLARKLGLKVTEYGFIETDEYMRTSKPDVFAAGDCVQHRDFLTGRPSRLMLASAAVLDARIAASNLYGLKVIRANKGSLNAYSTVIGSKAFGSVGITERVAKEEGFEIVVGRAEAPDRHPGKFEDTTKLIVKLIFSEDSKILLGAQVCGGKSVGEIVNILSLGMQKGITANDLFTMQIGTHPLLTSAPTVYPLAKAAEMVL

SEQ ID NO: 27439 - protein, 253 aa, Enterococcus faecalis V583
MKPVIVKNVRIGEGNPKIVVPIVAPTAEDILAEATASQTLDCDLVEWRLDYYENVADFSDVCNLSQQVMERLGQKPLLLTFRTQKEGGEMAFSEENYFALYHELVKKGALDLLDIELFANPLAADTLIHEAKKAGIKIVLCNHDFQKTPSQEEIVARLRQMQMRQADICKIAVMPQDATDVLTLLSATNEMYTHYASVPIVTMSMGQLGMISRVTGQLFGSALTFGSAQQASAPGQLSVQVLRNYLKTFEQNK

SEQ ID NO: 27440 - protein, 160 aa, Oryza sativa (japonica cultivar-group)
MAAADGTTGEEVKKTIDLVSKDGERFEVARDAALLCKTLRWMIKGGYGRIPLPNVASPILARVVDYLARHAAAAAAMDDDGLDRFDRDFLAGVDQDTLFDLLLAANYLQADGLLDLACKKVAAMMTGKSPEQMREIFHIVNDLTPEEEKEIREDIAWALN

SEQ ID NO: 27441 - protein, 503 aa, Oryza sativa
VLELWRENEASPLYFGAGNTKRLFVFLLFTAQTPRDEHQTNRAGFHARHLFDERRLSGCSAAMEEPPGKKGPAMDPAQDSGRDWLSGLPEGVLHRIMSFLDSRQAVRTCVLSRRWRDLWRSIPRVHADIYDFTPDGTIDGEGEEDVEEAEVVVVFNRFVNRLLERRDPTASIETFFFRCCIPDEDDDGSADANRWISYGLQKNAWFLEVVVQLNSLELDRSVFNSIYLRRIAFGNVFMDQGFFKQLQIGCPALERLYLDDCIVADDEISSNTLKVLTFDTTEFCYEHRISISIPTVTTLALRNTICGKPVLKDVASLVSASVVLYCVESGNFDAYDLRHYLWSFSHVKDLIFSYQGRKLTIENNLQWCPKFFNLVGLTLGKWCLNANFYALIVFLQNSPRLEKLTLILAEDNCKTSEVFIGELEEKSFTCEHLTSVEMKCWEDDPLVINVVDFFVGSGMSSSQIHIEYEDDDEDQFHIESDDMFGFEFEYEDEDEDEDEDEDE

SEQ ID NO: 27442 - protein, 452 aa, Thermobifida fusca YX
MSANLDEKLSPIYEEILRRNPGEVEFHQAVREVLECLGPVVAKNPDISHAKIIERLCEPERQLIFRVPWMDDSGEIHVNRGFRVEFSSSLGPYKGGLRFHPSVNLSIIKFLGFEQIFKNSLTGLPIGGAKGGSDFDPKGRSDAEIMRFCQSFMTELYRHLGEHTDVPAGDIGVGQREIGYLFGQYKRITNRYESGVFTGKGLSWGGSQVRREATGYGCVLFTAEMLRARGDSLEGKRVSVSGSGNVAIYAIEKAQQLGAHVVTCSDSNGYVVDEKGIDLELLKQVKEVERGRVSDYAKRRGSHVRYIDSSSSSVWEVPCDIALPCATQNELTGRDAITLVRNGVGAVAEGANMPTTPEGIRVFAEAGVAFAPGKAANAGGVATSALEMQQNASRDSWSFEYTEKRLAEIMRHIHDTCYETAERYGRPGDYVAGANIAAFEIVAEAMLAQGLI

SEQ ID NO: 27443 - protein, 771 aa, Coprinopsis cinerea okayama7#130
MEFDFDAIEDEDSPYPEVRASVSNIDDPDMPAMTIRMWVVGLVLCMASSAVNVFFNFRSPAPSIVPLVLLLLSYPIGKFLAFTLPITTYRIPLPYIPSRFLPASMPNVLSRILRPLTFPHAIEFSLNPGPWNIKEHVLVYIMANVAVGSPYALNAIVVLEVFYEFKTGYWFSLVLVLATQLTGFGLAGMCRRFLVWPASMVWPQNLVACTLLNTLHAEDEDDGIGMLGGPTLEDDPNTEGGRRRKRGMSRYKFFIWTTLGAFVFFFLPGYLFQALSIFSFVCWAAPNNVVVNQLFGVQSGLGMSMLTFDWSQITWIGSPLMVPWWAEVHVFVGFVLFYWILTPILYYTNSWQLAYFPISDTSPYDRFGNRYNIGRVLKHDDTFDLEAYEAYSPLFLPATYAVTYLLAFCLSTCVIVHTVLYHGHTLLNGFKKIRVENDDIHAKLMRNYPEVPDWWYLCAFGFFFALAIVAVEVWDTSVPVWALLLSVILPVIYILPSGFIYAMTGQGINLNILAQIIPGTLLPGQPLANMVFKAYSVQTLSEATNFVQDLKLGHYVKVPPRATFLVQMIATTLAGFIQVGVKHWIFTNVKDICDKNQPSKLTCPHNHVFFTASAIWGLIGPTRQFGPGSIYHPHLYAIVIGVFLPLPFWLWRRRYPDSWVKWVSTPVVLNGVSWIPPATGINYSSWFLVGFMFQYLVRKRNFAWWSKFNYVLSSALDSGTVIAVIVIFFTLQFPKDGFFLNWWGNVVHTKTADFNQEPLLKIPEGGIPWKN

SEQ ID NO: 27444 - protein, 716 aa, Mycobacterium avium 104
MTSAKAAAPTPTGEVWPGKAYPLGASYDGAGTNFAVFSEVAERVELCLFDGDGTESRVALPEVDGFVWHAYIPGIEPGQRYGYRVHGPYDPAAGQRCNPNKLLLDPYSKAIDGTFEWNQSLFGYNFGDPDSRNDDDSAPSMPKSVVINPYFDWGNDRPPDHHYADTVVYEAHVKGLTQTHPDIPEQMRGSYGAVAHPVIIEHLQSIGVTAIELMPVHHFANDSTLIDKGLSNYWGYNTIGFFAPDTKYSSAATPGGQVQEFKAMVRSLHEAGIEVILDVVYNHTAEGNHLGPTLSMRGIDNAAYYRLVDDDKRYYMDYTGTGNSLNVGHPHALQLIMDSLRYWVTEMHVDGFRFDLAATLAREFYDVDRLATFFELVQQDPTVSQVKLIAEPWDVGPGGYQVGNFPPQWTEWNGKYRDTVRDFWRGEPATLDEFAYRLSGSADLYEHTGRRPVASINFVTAHDGFTLRDLVSYNEKHNEANGEDNNDGESHNRSWNCGAEGPTDDEQVNALRARQQRNFLTTLLLSQGVPMICHGDELGRTQNGNNNGYCQDNELTWIDWANADVDLLAFTRVVSALRAEHAVFRRRRFFSGKPVGRRGQDGLRDIAWFTPDGTEMTDEDWGANFAKSVTVFLNGHGIPDRDARGQRLLDDSFLLCFNAHHESIEFTLPPKEFGASWQVVVYTGPEETTPADEVPGAGVLNVDAHTAVVLRAPDGG

SEQ ID NO: 27445 - protein, 422 aa, Photobacterium profundum SS9
MSFQALGLNTQLVDTVTELGFKTPTPIQEQAIPQVLAGDDIMAGAQTGTGKTAAFGLPMIQRLLASQQSEHDEGYIKKPEAIRALVLTPTRELAQQVHDSILAYSKNTSIKVAVAYGGTSMGVQVKALKSGVDILIATPGRLLDHAFTGTVDLSKIECLVLDEADRMLDMGFVVDIKRIMQRMPRKRQTLLFSATFSNQVKKLAYDILADPKLIEVTPENITAESVTQMVYPVDKHRKRELLSYLIGSRNWNQVLIFTKTKQGSDELAKELILDGIKAVSINGDKSQGARQRALSDFKEGKVRAMVATDVAARGLDIEQLGYVVNFDLPFQAEDYVHRIGRTGRAGLTGSAISLMSIDEEWALRAIEELLDTRLPQEWLEGYEPDPTIKAQDNRRSSSTSEKRRIKAKSKIHKNRGRNQTKR

SEQ ID NO: 27446 - protein, 452 aa, Burkholderia vietnamiensis G4
MNHNTHTVATDRAPPTPRIVIVGGGAGGLQLATRLGDTVGRRGQAEVVLVDRYPTHFWKPLLHEAASGHRDPATHTIEYVAQAKRHGFRFVQGALQALDRATRTVTIAAVHDADGTEILPQRELGYDDLVLAVGSVTNFFNVPGAARHALPLENLDQAEDFRRKFLAACTRANHAAEQHPARRAAPVCISVIGAGATGVELAAALRHAVQQLTTYRFKALVSTRDVHIRLIEGGARILPALDERLSARMHAQLRTLSVDVLTDTRVAQVDADAVTTATGERLASDITIWAAGVAGPAILRELGGIALNRSNQVIVTDTLQTPDDAHVYAFGDCAACPSADALSVLPPRAQVAHQQAVYLGDAFARRLAGKRVARFAFRDAGTVVSLGHTGAVYQADFGARPRSVIVDGLAAIGLYKFLYRKHLFSVYGLKRALFQSLGHWLQRRNQPSIKLH

SEQ ID NO: 27447 - protein, 97 aa, Pseudomonas fluorescens
VIRIMMAERFFRITSHLLFLGTYIQDVGHDPVFFTFTDRQKAYTVIEAITGFRLHPAWYRIGGVCPRPATRLEKLVKDFVEWMPKRLDEYTKAALQN

SEQ ID NO: 27448 - protein, 347 aa, Sulfolobus solfataricus P2
MRAVRLVEIGKPLSLQEIGVPKPKGPQVLIKVEAAGVCHSDVHMRQGRFGNLRIVEDLGVKLPVTLGHEIAGKIEEVGDEVVGYSKGDLVAVNPWQGEGNCYYCRIGEEHLCDSPRWLGINFDGAYAEYVIVPHYKYMYKLRRLNAVEAAPLTCSGITTYRAVRKASLDPTKTLLVVGAGGGLGTMAVQIAKAVSGATIIGVDVREEAVEAAKRAGADYVINASMQDPLAEIRRITESKGVDAVIDLNNSEKTLSVYPKALAKQGKYVMVGLFGADLHYHAPLITLSEIQFVGSLVGNQSDFLGIMRLAEAGKVKPMITKTMKLEEANEAIDNLENFKAIGRQVLIP

SEQ ID NO: 27449 - protein, 463 aa, Listeria monocytogenes str. 4b F2365
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIVSLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQARGFKVPFYPVLPIVSFLLCAFLISRLSVHTWILCGIWFVIGLIVYFAYGRKHSELLKK

SEQ ID NO: 27450 - protein, 473 aa, Prochlorococcus marinus str. MIT 9301
MSKSPQDVLSQIKDEGIELIDLKFTDIHGKWQHLTLTSDMIEEDSFTEGLAFDGSSIRGWKAINASDMSMVPDASTAWIDPFYKHKTLSMICSIQEPRSGEPYDRCPRALAQKALKYLDSTGIADTAFFGPEPEFFLFDDVRYDSKEGGCFYSVDTIEAPWNTGRIEEGGNLGYKIQYKEGYFPVAPNDTAQDIRSEMLLLMGELGIPTEKHHHEVAGAGQHELGMKFDSLINAADNVMTYKYVVRNVAKKYGKTATFMPKPVFNDNGTGMHAHQSLWKSGQPLFFGEGSYANLSQTARWYIGGILKHAPSFLAFTNPTTNSYKRLVPGFEAPVNLVYSEGNRSAAVRIPLTGPSPKAKRLEFRSGDALANPYLAFSVMMLAGIDGIKNQIDPGDGVDVDLFELPADELAKIDTVPSSLNDSLNALKADKDYLLAGGVFTEDFIDNFIDIKYEEVQQLRQRPHPHEFFMYYDA

SEQ ID NO: 27451 - protein, 321 aa, Triticum aestivum
  misc_feature (77)..(77): Xaa can be any naturally occurring amino acid
  unsure (1)..(321): unsure at all Xaa locations
MAPLGDAVAPAAAAAAPGLVVSFGEMLIDFVPDVAGVSLAESGGFVKAPGSPLFGNFGRKSLAQMLGDIPNQTAVNXPGLPVEQHPPNALALLTVKFHGGGGFNVYPPPAPPRVRTEAELNLDLIRRARIFHYGSISLITEPCRSAHVAAMRAAKSTGILCSYDPNVRLPLWPSAQAARDGIMSIWKEADFIKVSDDEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 27452 - protein, 568 aa, Ashbya gossypii ATCC 10895
MSITIESVPTKAFADQKPGTSGLRKKTKVFEQTEHYTENFIQAIMESIPEGSENAVLVIGGDGRYYNDAVMQKIAEVGSANGVRKLIIGQNGLLSTPAASHIIRTYHDKVTGGIILTASHNPGGPDNDFGIKYNLANGAPAPEKVTNSMFERSRNLTHYKITRGMPKLDLGKIGENQQYGNLLVDVIDPTEAYVRLMKEIFDFPLIKKFLEHAQKEYGLKVLFDALNGITGPYGKAIFVDELGLSEDSLQNFVPKPDFGGLHPDPNLTYAHTLVSRVDRENIAFGAASDGDGDRNMIYGAGPAFVSPGDSVAIIAEYASEIPYFIKNGIHGLARSFPTSGAIDLVAKEKNLDCYEVPTGWKFFCNLFDSKKLSICGEESFGTGSDHVREKDGLWAIVAWLNVLAIYHRRHPDREPSIKTIQEEFWAKYGRTFFTRYDFEECDTEDANKVIELLRTFAENPAVVGQPFPAWHEVSVSAAGDFSYTDLDGSVSEHQGLYIKLSNGTRYVVRLSGTGSSGATIRLYVERYTNDPAYYAQTADQFLAPDIKAVLKFLRFKDLIGTEEPTVRT

SEQ ID NO: 27453 - protein, 326 aa, Glycine max
AVKPNFHLPMRSFELKNRTSPEDIKALRLITAIKTPYLPDGRFDLEAYDDLVNMQIGQGAEGVIVGGTTGEGQLMSWEEHIILIAHTVNCFGGKIKVIGNTGSNSTREAIHATEQGFAVGMHAALHINPYYGKTSLDGMVAHFRSVLSMGPTIIYNVPARTGQDIPPHVIQTLAESVNLAGVKECVGNDRIKQYTDDGIVVWSGNDDQCHDARWGYGATGVVSVASNLVPGLMRELMFGGVNPTLNSKLLPLIDWLFHMPNPIGLNTALAQLGVIRPVFRLPFVPLPVDKRIEFANLVKEIGREHFVGNKVVEVLDDDDFFLVSRY

SEQ ID NO: 27454 - protein, 478 aa, Cucumis sativus
MASSSPELPLKPIPGGYGFPFLGPIKDRYDYFYFQGRDEFFRSRITKYNSTVFHANMPPGPFISSDSRVVVLLDALSFPILFDTTKVEKRNILDGTYMPSLSFTGGIRTCAYLDPSETEHTVLKRLFLSFLASHHDRFIPLFRSSLSEMFVKLEDKLADKNKIADFNSISDAVSFDYVFRLFSDGTPDSTLAADGPGMFDLWLGLQLAPLASIGLPKIFSVFEDLIIHTIPLPFFPVKSRYRKLYKAFYSSSGSFLDEAEKQGIDREKACHNLVFLAGFNAYGGMKVLFPTILKWVGTGGEDLHRKLAEEVRTTVKEEGGLTFSALEKMSLLKSVVYEALRIEPPVPFQYGKAKEDIVIQSHDSCFKIKKGETIFGYQPFATKDPKIFKDSEKFVGDRFVGEEGEKLLKYVYWSNERETVEPTAENKQCPGKNLVVMMGRIIVVEFFLRYDTFTVDVADLALGPAVKFKSLTRATASV

SEQ ID NO: 27455 - protein, 93 aa, Oryza sativa
VPCRYRPEFPGRPTRREENFKSYCVEGKVPIGIGENPKIRNCIIDMNARIGRNVIIANTQGVPESDHPEEGYYIRSGIVVILKNATLKDGTVI

SEQ ID NO: 27456 - protein, 491 aa, Azoarcus sp. EbN1
MSFADLGLIPELLRAVAESGYTTPTPIQQQAIPVVLSGRDVMGGAQTGTGKTAGFTLPLLQRLARHASTSTSPARHPVRALILAPTRELAMQVFESVKTYSKYVPLRSTCIYGGVDMKPQIQDLRNGIEIVVATPGRLLDHVQQKTIQLGQVEMLVLDEADRMLDMGFIPDIRRILDLLPAARQSLLFSATFSDEIKKLADQMLKEPQLIEVARRNMVSETITHRVHPVSAGLKRNLLAHLLRHEPDTQALVFVATKLACSRLAHFLERHGIAADAIHGDKGQAQRTDTLEAFKSGKLRVLVATDVAARGLDIDDLPSVINFELPHTAEDYVHRIGRTGRAGRQGNAVSLVSAEERHHLAEIEKLIKLQIPQEIVPGFDPEPDFFETGSRSRHGRRTAAASAPEPAKETGQKTTPASRPARPASAARSGEARRRPGRSTIAADGFDYTKPYEPAASPADPNRLADQAAGKIGSSRRTQRPIAVLLGGLGRK

SEQ ID NO: 27457 - protein, 266 aa, Rosa hybrid cultivar
FIAFIVQCGMTHLLNGWTYGPHPFQLMLALTVFKILTALVSCATAITLITLIPLLLKVKVREFMLKKKTWDLGREVGIIMRQKEAGMHVRMLTQEIRKSLDRHTILSTTLFELSETLGLQYCAVWMPNEIKTEMILTHELKGRNYSNMYNFSIPIGDPDVALIKGSDGVNILGPDSILVSGSSGDFGEPGPVAAIRMPMLRVSNFKGGTPEFIQTCYAILVLVLAGGQPRSWSSQELEIIKVVADQVAVALSHAAILEESQLMREK

SEQ ID NO: 27458 - protein, 857 aa, Oryza sativa
  misc_feature (369)..(369): Xaa can be any naturally occurring amino acid
  misc_feature (540)..(540): Xaa can be any naturally occurring amino acid
  unsure (1)..(857): unsure at all Xaa locations
MGASRKLQGEIDRVLKKVQEGVDVFDSIWNKVYDTENANQKEKFEADLKKEIKKLQRYRDQIKTWIQSSEIKDKKALMDARKQIEREMERFKVCEKETKTKAFSKEGLGQQPKTDPKEKAKAETRDWLNNVVSDLENQIDNFEAEVEGLSIKKGKQRPPRLVHLEKSITRHKAHIKKLESILRLLDNDELSPEQVNDVKDFLDDYVERNQEDFDEFSDVEELYSTLPMEKVEALEDMVSLAPSSLVKGVASVSTTAVLSTKSSVATSPTQATVSAAPSLSVSQDQAEETASQESNPESAPQTPPSKVGSQPSVPVVPTTISTSTAAVSVSAETISSPVRPIVPTTTAAVLPASVTARSAPENIPAVTSXAPANSSSTLKDDDNMSFPPRTPSPAPAVRRLGRGITRGLTSQGLGSAPISIGPVSGNGSVSALTDLSKRNMLNTDERINSGGISQQLISPLGNKAQPQQVLRTTDTISSDSSNTNESTILGGRIFSPPVVSGARWRPQNTAGLQNQSEAGHFRGRPEISADHTGKYLPRLXQVQQPGSLLNVSPITGISQKPFPSQQPNPLLQQFNSQSSSISSQAGIGLGQVQVPESGHTKSEEQQKSFAEDVSVESVATSGANKHMSEDDTKIPFSNPSASITEGTQLSRDPDLPAGQPLQPGMSSSGVGVIGRRSVSDLGAIGDNLSVASASTSHDLLYNLQMLEAAFHRLPQPKDSERVKNYIPKHPAVTPASFPQIQAPVVSNPAFWERMGGDSLSTDLLFFAFYYQQNTYQQFLSARELKKQSWRFHRKYNTWFQRHVEPQVTTDEYERGSYVYFDFHVIDDGTGSGWCQRIKNDFTFEYNFLEDELSVQTN

SEQ ID NO: 27459 - protein, 509 aa, Mycobacterium avium 104
MLVVDFGAQYAQLIARRVREARVFSEVIPHTATIEEIKARQPRALVLSGGPSSVYEPGAPQLDPAVFDLGVPVFGICYGFQAMAQALGGTVAHTGTSEYGRTELKVLGGELHSGLPGVQPVWMSHGDAVTAAPDGFEVVASSPGAVVAAFENRARRLAGVQYHPEVMHTPHGQQVLSRFLHDFAGLGADWTAANIAGVLVEQVRAQIGDGHAICGLSGGVDSAVAAALVQRAIGDRLTCVFVDHGLLRAGERAQVQRDFVAATGANLVTVDAADTFLQALAGVTNPEGKRKIIGRQFIRAFEGAVRDVLGDKPVEFLVQGTLYPDVVESGRGSGTANIKSHHNVGGLPGDLKFTLVEPLRLLFKDEVRAVGRELGLPEEIVARQPFPGPGLGIRIVGEVTATRLDTLRRADSIAREELTAAGLDSLIWQCPVVLLGEVRSVGVQGDNRTYGHPIVLRPVTSEDAMTADWTRVPYEVLERISTRITNEVPEVNRVVLDITSKPPGTIEWE

SEQ ID NO: 27460 - protein, 322 aa, Azoarcus sp. EbN1
MSTQQLYAPIATDMQAVDAVIRERLHSDVVLIRQVAEYIIHSGGKRLRPALVLFSAGAMGYRGQSHHQLAAVVEFIHTATLLHDDVVDESELRRGNKTANALFGNAASVLVGDFLYTRAFQMMVGVGDMRVMQVLADATNIIAEGEVLQLLNCHNADVDIEDYLRVIRYKTAKLFEAATRLGAILGGANEEQERKVAAFGMHLGTAFQIIDDVLDYSSDEAATGKHLGDDLAEGKPTLPLIHAMKHGTAEQSARVRNAIESGGRDDFEAVLAAIRETGALEEARRWARAEGQFAIDALEVLPPSIFKDALLQLSDFAVVRNY

SEQ ID NO: 27461 - protein, 341 aa, Mycobacterium avium 104
MRTVVVDGPRSIRVDTRPDPVLPGPDGAIVEVSAAGICGSDLHFYEADFPMPDPIALGHEAIGTVVEAGPQVRNVKVGDQVMVSSVAGCGSCAGCATRDPVLCHSGFQIFGGGVLGGAQADLLAVPAADFQLLKIPEGISTEQALLLTDNLATGWAAAQRADIPFGGTVAVIGLGAVGLCALRSALFQGAATVFAVDQVDGRLARAARWGATPLKAPALEAILAATGGRGADAVIDAVATDASLTEALNAVRPGGTVSVVGVHDMNPFPLNALGCLIRSITLRMTTAPVQRTWPELIPLLQSGRLDVDGIFTTTMPLDEAAIGYATAGSRSGDDVKILLKP

SEQ ID NO: 27462 - protein, 126 aa, Photobacterium profundum SS9
MIIETNKAPQAIGPYSQAVKAGEYVYISGCVPFSPEDGSIPFTDIEGQSELTLNNLKAIVEAAGAEMSQVVKTTCFISDLNNFVKFNGVYATYFEPGSFPARACVEVARLPKDVLIEVEAVVYLNK

SEQ ID NO: 27463 - protein, 608 aa, Bartonella quintana str. Toulouse
MQLRNIAIIAHVDHGKTTLVDELLKQSGNFRDNQRTSERMMDSNDIEKERGITILAKVTSVVWKDTRINIVDTPGHADFGGEVERILNMVDGAIVLVDAAEGPMPQTKFVVGKALKVGLHPIVAINKIDRADARTDEVINEVFDLFAALDATDEQLDFPILYGSGRDGWMAEAPEGPKDQGLSPLFDLVTRHVPSPTVAEGPFRMIGTILEADPFLGRIITGRIHSGTIKPNQSVKVLGQDGKLLETRRISKILAFRGLERQPIEESIAGDIVAIAGLQKGTVADTFCDPAVNEPLIAQPIDPPTVTMSFLVNDSPFAGTEGDKVTSRLIRDRLLKEAEGNVALKIEEATDKDSFHVSGRGELQLAVLIENMRREGFEFSVSRPRVVMQKDENGITLEPIEEVVIDVDEEYSGTVVQKMSGRKGEMIELRPSGGNRVRLVFYAPTRGLIGYQSELLTDTRGTAIMNRLFHTYEPYKGDIAGRVNGVMISNDTGESVAYALFNLEDRGPIVIDAGVKVYQGMIIGIHSRDNDLEVNVLKGKKLTNMRASGKDEAVKLTPPLKMTLERALSWIQDDELVEVTPKNIRLRKLYLDPNERKRFEKTRASISN

SEQ ID NO: 27464 - protein, 429 aa, Sulfolobus solfataricus P2
MNVEKELREKGVEILRFTWVGLDGYIRSKGAYIDHVDELLKTGIGLTMAMMSFTPMDYISPYGTFGPQDEDVFLTPDLNTLSVFPPSAIVICNLYKHGNPWNYDPRSILIKTIEKAKEQYDFDFKSAFEIEFYLTKDKKPLDDARCFDPSAFYNNQIIPEIAKTLRQINIEPIRIIKEYGPGQYEFDIMHKDALRSADEVVIFKEVARQVASKHGVEANFMPKPFNKLAGSGLHLNISLWKDNQNLFYSHNDKYGLSDLAYNFIAGLLEHAKALTAIASPTINSYKRLVPGSWAPTKITYGYNNKSAMIRIPTPYPGMSQLDRRIEYRVPDPSTNPYLLLTAVIEAGLDGIERGLKPPEAVNENAYYRKDIDDIPRNLREALNELRKDTKLVERIGKEIIGEFIKVKLAEVEEYESLVTDWEYEVYRRL

SEQ ID NO: 27465 - protein, 327 aa, Haloarcula marismortui ATCC 43049
MTHEIAVIPGDGIGQEVTPAAVEVLEAIDGVDFDFVEGEAGDAVKEETGDALPEETRELAADADATLFGAAGETAADVILPLRQVVGSFANVRPARSYPGLDAVQPDTDIVFIRENTEGVYKGIESEISEGVTTCTRVITEDASEKIAEYGFSYAKQNSYDDVTIAHKANVMRTTDGLFLDAASAVGEDRDASYDTALMDALAMHLVMNPQDYGVVICPNLAGDMLSDLAAGLVGGLGLLPSANIGEENALFEPVHGSAPDIAGEGIANPSAMILSAAMLLDHLGYDEQGDAVRTAVESVLDSGPRTPDLGGDASTEDVTAAVIDEL

SEQ ID NO: 27466 - protein, 119 aa, Photobacterium profundum SS9
MSNIIKQIEDEQLKQDLPTFAPGDTVVVQVKVKEGDRERLQAFEGVVIAKRNRGLHSAFTVRKISNGEGVERAFQTHSPVVDSITVKRRGLVRRAKLYYLRERSGKSARIKEKLVRKSS

SEQ ID NO: 27467 - protein, 261 aa, Arabidopsis thaliana
MSGVYDSQADIYLDARPTYPADWYSKLAALSHRHNLAWDAGTGNGQAAIGIAEHYERVVATDVSETMLNLGKPHPKVTYHHTPSSMTEDEMVDLIGGENSVDLITVATAVHWFDLPRFYAIANRLLRKPGGIIAVWSYNTDMVVNPEFDSVMTRFIAETLPYCKFPESQYFLDGYKTLPFPFESVGLGSEGKPMELEMKKTVSFEGFLRMLRSWSAVGAAKEKGVDLLSDNVVKELETAWGGYELVRTIVYKTFMLAGTVP

SEQ ID NO: 27468 - protein, 701 aa, Ashbya gossypii ATCC 10895
MATVGASAEQLLQDINCEGYLGAFRKYEISSVDQLQHLDHEILEQVGIRSIGDRIRILNKSRTLQAGRDKGLLEELQQVIGKINALSAGPMAISEELVTDRHSVIFILNDGSAKKVNVNGCFNADSIKKKLIKRLPPEFVAVAQNGEETSSQDYDVFVVDYAKNVLHLLYDVELVTICHSSDRVEKNRLIFVSKDQTPSDKAILTSKKLYLKTMSAIHQLGSLPTMLQTQGATTVGNYATPGAEAPAGDEDSLRIDNSKESLRRIFNQRPPSELISTNLPEYFPHTDFKRLQKTLRSSFRQSVRMSMLRPGAPLPEGNNVGNILVNQNQAVDRALLQSLDGTKTSSRSSGRSSVDGDASSMGSERRTNASKSTTLDGRDSDAGGRIELLNSESESECDDDNIVSLPTKVVTPKSWLKGARIGSGSFGSVYLGMNAHTGELMAVKQVELEPTTVMASSDDKKSHPSSNAVVKKLTDPPQDGGRASSTKMNLLKELHHENIVTYYGSSQEGGNLNIFLEYVPGGSVSSMLNSYGPFEEPLVKNFTRQTLVGLTYLHRKNIIHRDIKGANLLIDIKGSVKITDFGISKKLSPLNKKQNKRASLQGSVYWMAPEVVKQVVTTEKADIWSVGCVVVEMFTGKHPFPDFSQMQAIFKIGTNTIPELPSWASDGAKAFLYQTFELDYKKRPSSVELLQHKWLDTTTML

SEQ ID NO: 27469 - protein, 345 aa, Aspergillus nidulans FGSC A4
MCETLQPRSVFFMSPSVGYLGAGNSQKTRHRTRSALQNPQMADTEKTFRSYTSDQGRNYAQNRLDYHQDLYNQIVEHHTSTGGKLDTLIDVGCGPGNVASNLSKHFVHTIGLDPSEGMIATARALNSSPAADSGKLRFEVSTAEDLGSNLSPPIADSSVDMIVAATAAHWFDMPAFWRSAARVLKSGGSVAIWGSANMRTSPGTPNAEAIQARIDQFEAEIRPYFLPGNELTRGLYKDLELPWTIEPAVDGFDEKAFFRKDWDTTEKFLALGAPEIDMDVFERMLGTMSPVTRWREDHPEATGEADVVRVFRRDIERLLREAGVGEGKEKVKGSAQGFLLIVKKT

SEQ ID NO: 27470 - protein, 732 aa, Mycobacterium avium 104
MSSNEPASAAGGGTHQPEVPTVWPGSPYPLGASYDGAGTNFSLFSEIAEKVELCLIDSRGAETRIPLDEVDGYVWHAYLPNINPGQRYGFRVYGPFEPSAGHRCDPSKLLLDPYGKAFHGDFTYGQALFSYDLKAVAAGGDDADPGIPPMVDSLGHTMTSVVSNPFFDWGSDRAPLTPYHETVIYEAHVKGMTQTHPSVPEQLRGTYAGLAHPAIIDHLKSLNVTAIELMPVHQFMHDSRLLDLGLRNYWGYNTFGFFAPHNQYAANRNSSVAEFKSMVRSFHEAGIEVILDVVYNHTAEGNHLGPTINFRGIDNAAYYRLVDTDLRRYKDYTGTGNSLNPRHPHVLQLIMDSLRYWVTEMHVDGFRFDLAATLARELHDVDRLSAFFDLVQQDPIVSQVKLIAEPWDVGEGGYQVGNFPGLWTEWNGKYRDTVRDYWRGEPATLGEFASRLTGSSDLYEATGRRPSASINFVTAHDGFTLNDLVSYNEKHNMANGEDNRDGESHNRSWNCGVEGPTDDPDITELRYRQMRNFWATLMVSQGTPMIAHGDEFGRTQNGNNNVYCQDSELSWMDWSLVDKNSDLLAFARRATTLRTKHPVFRRRRFFEGEPIRSGDEVRDIAWLTPGGREMTHEDWGQSFHKCVAVFLNGDAITAPNARGERVVDDSFLLCFNAGEQPVQFVMPGGDYAKEWTVELDTNEPTGRKEGAEPLVVHAEEELTLPSRSLLILRKTL

SEQ ID NO: 27471 - protein, 832 aa, Thermobifida fusca YX
MKAVVMAGGEGTRLRPMTANQPKPLLPVVNRPIMEHVLRLLKRHGFEDTVVTVQFLATLIRNYFGDGEELGMSLRYVAEEVPLGTAGSVKNAEEHLRGEPFIVISGDALTDIDLTDMVRFHRENGALVTIGLKRVANPLEFGIIIVDDNGRIQRFLEKPTWGQVFSDTVNTGIYIMEPEVLDHVAPGENVDWSGDVFPKLLKAGAPLYGYIADGYWEDVGTHESYLRAQADVLSGKVDVEIDGFEVSPGIWVAEGAEVDPEAVLKGPLYIGDYAKVEPGAELREFTVLGSNVVVRSEAFLHRAVVHDNVYVGTRANLRGCVVGKNTDIMAGVRIEEGTVVGEECVLESEAYLANNIKVYPFKTIEAGAVVNTNVIWESKGQRSLFGPRGVSGLINVEITPELAVRLASAYATTLKKGAVVTTARDASRAARTLKRAVISALTAAAINVQDLEATPLPLARFHTSQPGLSGGIALRTTPGDPQSVDIVFLDSSGADLSPAAQRKLERVFSRQEYRRAFPGEIAELSFPSRSVEAYTRELLQSIDLSGVAEANLKVVVDCAGGTGSLILPALLSQIDADVLTVNNRLDEASPTDTPAKRTRDLQRLGELVASARADFGVRFDPVGERIQLVDGSGTLVDDERALLVVLDLVAAERQGGRVALPVTTTRVAEQVANRHGVDVQWTPTSLDALTKAALADDIIFAADGRGGFILPEFSRTCDGIAAFVRLIGLVARTKMSLSQIDQRIPQAHLLRRSVPTPWAVKGSVMREVVEAAQGREIDTTDGVRVIEPDGSWALVLPDTAEAVTHLWAEGPDDETAQRLLEEWSAVVERAEG

SEQ ID NO: 27472 - protein, 331 aa, Bartonella quintana str. Toulouse
MTIQSSGMLGFQSAVTSALKTLASEKQGLEALEAALLGNLSSSFEVAVQTIKNANGHVVITGLGKSGHIGTKIAATLASTGTPAFFVHAAEANHGDLGMIGSDDVILALSWSGETLELSGIINHAARFRTPLIAMTSGEHSVLARQADIVLLLPKIEEACPHGLAPTTSTVVQLAMGDALAVALLEMRGFTATDFKIYHPGGSLGAHLKYVRDIMHVGDSIPLVVQGTTMTEAMNVLVAKHFGCVGVVNQRGELIGIVTDGDLARNIHFNLSKFNVDEVMTKDPKIVEPNTLVGAATAFINDHHIGAFFVVEDKKPLGIVHFHDLLRIGAA

SEQ ID NO: 27473 - protein, 741 aa, Oryza sativa (japonica cultivar-group)
MSRRAAPMMLGLAGPPRLGWGGRTVVVVGVRDDAEGRELLTWAFAMVASAGDRVVALHVATPPAAADQEGAMRMAARRIRATESLAALLRAYHDFCDLNQVPAHRPHISLELRICHGSSIKKALVNEASSYGAAHLILGVTNNSRSHLRPSSSSSATIAKYCAKRVPPSCSVLAVGNGRVVYRRDAAQQQLNQCISPLVETPRRIYRKIYRKLVRAATTITREKSQDDAAIAGGGRHLRRNISTPTSAPVSPVVAFTPRQAEVAAGWPLLSPDLKSALPEWTEMSVARWAMQLPSRCPAPSPLNPRNNSGDQATSPAITASETPSPATDEAAEQVAQELASLRNKYSSKYTMFSYSELARITSNFSPDRIIGKGGASEVYKGCCDDGKEVAVKVLKSSDKVMEELVSEMEIVSSVRHGNAMPLTGFCLDGGGGAAKIMLVYDYMARGSLEEILHGEKEGKDLFGWPERFKVAAGVARALVYLHGGDGDGRPVIHRDVKSSNILVSEDFQPKLCDFGLALWAAEAASPVTGDDVAGTFGFVAAAASSHLLEEFKYLAPEYFMHGKVSDKIDVYAFGVVLLELVSGRKPVSSGGGKGKESLVMWANTIIQGGKLTDLVDPSLPTDGSGVAGEVERMTLAAALCIRRSPQRRPSIANVLKLLDGDGDAVRWVRSQAGLSAGDDTDDGDGASPEKKDIQSYINLALLDVVDDSASVSSGGGDFTAANVSLEEYTKGRWSRSSSFD

SEQ ID NO: 27474 - protein, 496 aa, Pisum sativum
MAATGVLAEIIDGDVYKYYADGEWNKSTSGKSVAIINPTTRKPQYKVQACSQEEVNKVMDSAKSPQKSWAKTPLWKRAELLHKAAAILKEHKAAIAECLVKEIAKPAKDAVTEVVRSGDLVSYCAEEGVRILGEGKFLVSDSFPGNERTKYCLTSKIPLGVILAIPPFNYPVNLAVSKIAPALIAGNSIVLKPPTQGAVAALHMVHCFHLAGFPKGLISCVTGKGSEIGDFLTMHPGVNCISFTGGDTGIAISKKSGMIPLQMELGGKDACIVLEDADLDLVAANIIKGGFSYSGQRCTAVKVVLVMESVADALVEKVKVKVAKLSVGPPEDDSDITPVVSESSANFIEGLVNDAKEKGATFCQEYKREGNLIWPLLLDNVRPDMRIAWEEPFGPVLPVIRINSVEEGIHHCNASNFGLQGCVFTKDINKAIMISDAMESGTVQINSAPARGPDHFSFQGIKDSGIGSQGITNSINMMTKVKTTVINLPSPSYTMG

SEQ ID NO: 27475 - protein, 428 aa, Bartonella quintana str. Toulouse
MRLGGRLQAAIDILKEIETRHCPAGQAIRAWGLSHRFAGASDRAAISTIVYDVLRRRYSLQWRMESDDMRDVVFGTLLDTGKMTIEQIDGELEGDRFAPQLLGPKQRQSWQRRQLVDAPDYIRGDIPQWCQAHLHPLFADNWEIEAAALATRPSLDLRVNSLKATPEKVLKELAKTKIQFLSWFPQALRIAPIEKFSRHPNIQMELAFQKGHFEIQDLGSQIVAHLVEAKESMQVLDYCAGAGGKTLALAASMKNQGHIYAYDSNKVRLASIFDRLQRAGVRNVQARAHREELKSLVSQMDRVLLDAPCSGTGTWRRRPDTKWRLTLEQVRQRQVEQRAILNEAMDYLKPNGRLVYITCSLFFGENEEQISLFLKQHSNFYPINMRTLWQKYFSFSPVQPIFSHYGLTLSPATTKTDGFFLSVLQKKH

SEQ ID NO: 27476 - protein, 518 aa, Bartonella quintana str. Toulouse
MSISHPDTVLIIDFGSQVTQLIARRVRAMGVYCEIVPFQLALEGVKRLRPQAVILSGSPYSVIDDGSPRAPMEIFEIGVPVLGICYGEQVMCVQLGGKVESGHRREFGRAFLEVQEKSALFDGVWEKGSCYQVWMSHGDHVAALPEGFRVIGTSKGAPYAAIADEKRCLYAVQFHPEVVHTPDGTKLLQNFVHKISGLKGNWSMASYRDQAIATIRKKVGKSRVICGLSGGVDSSVVAVLLHEAIGDQLTCILVDHGLMRKNEAEEVLKLFRDHYNIELIHVNAANIFLNALEGETDPEKKRKTIGRLFIEVFEEETKKIEGVEFLAQGTLYPDVIESVSAIGESVTIKSHHNVGGLPERMNMKLVEPLRELFKDEVRSLGRELGLPEQFLGRHPFPGPGLAIRCPGAVTREKLEIIREADAIYLDEICKAGLYDEIWQAFVVLLPVQTVGVMGDGRTYEFVCALRAVTSVDGMTADFYPYDMEFLSKTAARIINEVRGINRVVYDITSKPPGTIEWE

SEQ ID NO: 27477 - protein, 480 aa, Ehrlichia canis str. Jake
MLSIFSSIISLLNILSILVRYNVLPYTYFFADRSIRRKSQGERVTMALQRLGPIFIKFGQSMSSRADIIGEEIANHLLCLCDKLPAFPYADVVRIIEEDFKCNISEMFCEFEQKPIAAASIAQVHKAKDIDGNVRAVKVLRPKIEKIFERDIKLMFWLARLAQYFSRFRRFQLLQLVQTFREICRMEIDLRFEAANAEELRSNIQDDDGCYVPEVDWTKTTRRVLTLEWVDAVPIYSVYKSENCETLVRNLIFCFCNQVYRDRFFHADMHPGNLMVDTKGRIVIIDFGIVGRLDKATCMYVTEILVGFLKKDYQYVADIHYRAGYVDAKYSSFITACRAIGEPIVGKNAENISISMLLTQLFKITSDFDMKLQPQLFLLQKTTVLVEGVCRQLCPEINMWKVAELWMEKYSIEKNKYIQKLKRSYICQTINDIPSFMKKVDKSLDVISNYQELNKANIGINRDIIWALIVGGLIIKLIIG

SEQ ID NO: 27478 - protein, 964 aa, Escherichia coli
MSAISLYLLAVERGESRLLSRAIEKLRISLSICAQFNMLPQWWLNFITIHLLSDLWSDTFHERLPLVPVGGDAAEWPALRELFIALLQRRPRAEIDLWPSQREAAGRSVNDNDDLVVSLPTSAGKTRIAELCILRCLAGGKRVVFITPLRALSAQTEATLSRTFGPLGKTISMLYGSIGVSGMDEDAIRQRDIVVATPEKLDFALRNDPSIINDVGLFIFDEGHMIGADEREVRYEVQIQRLLRRQDADTRRIVCLSAILPDGEQLDDFAGWLRRDKPGGPIKNNWRPTRLQFGEVIWSAPAGRLNLSVGYEAAWVSRFIVSRQPPKVKLPNKKQRTKMFPSDNKELCLATAWRLIEDGQTVLIYCPLRRSVEPFAETIVDLHQRGLLPSLFDAAPDILDTAISLGEEWLGAHSPILACLRLGVALHHGALPTAYRKEIERLLRDGVLKVTISSPTLAQGLNLSATAIVMHSLHRNRELIKVSEFRNVIGRAGRAYVDVEGLVIYPIFDKVNKRQTNWHTLTSDTGAREMESGLIQLVCVLLIRMHTRLGGDLKALTEYVTNNAVAWEFPEIMTESPQERDIAQAIWEKQLSTLDTAILSLLGENDIPDDQIETALDDILQSSLWQRSLQRYRDENERILLKSGLLSRSRYIWQRSTAAGRRGYFLSGVGLTTGLRLDAIAAKANQLLIDANAAIMGGDAEEAIAAITALAEEVFTFYPFIPDPLPGDWRGILRSWLLGEPMTNVANTQASETLQFVENGLVYRLPWAMEAIRVRATANGDLIGDTDTTLDDYELGFAVAAVETGTLSRSSSLLIQAGFSSRLAAIKVVTDTTADFQSGQELRRWLNSEEVISHTDNHDWPTPETRVMWLEFLGSLSPKGSQVWSRHRYNGMVDWRDTPAVIGTPLQLYTVDGIHHVLADDGTPLGSINGRINTNRRGLLRVEVDDENGRAMFDYLGPDDFIST

SEQ ID NO: 27479 - protein, 391 aa, Mycobacterium avium 104
MGESGPVVIDPRRHDAVLFGVGDALGSALASQLGQIGVGTAAIAADDPAAAADRLRVRPGRCVVVAGDPAAVEAARAAGFALVIGLAPDGRDGDGLRAAGADAVIAELEQITVRTGDRRMSQLPDASQALTGGADGLAGRHPAVFFDFDGTLSDIVDDPDAARPVAGATAALTRLAARCPVAVLSGRDLADVTKRVGVPGIWYAGSHGFELTAPDGSHHQNDDAAAAIPVLAQAAGRLSDELGTIPGVVVEHKRFGVAVHYRNAARDRVGEVAAAVRAAGRHDALRVTTGREVIELRPDLDWDKGKTLHWVIEHLRRSGSGALTPVYLGDDITDEDAFDAVRGGPVQGVPILVRHNDDGDRATAALFALDSPARAAEFTERLADQLERGEG

SEQ ID NO: 27480 - protein, 552 aa, Synechococcus sp. CC9605
MTASAPAQPTQRQVHLDAPFSDQKPGTSGLRKSSRQFEEPHYLESFIEASLRTLPGVQGGTLVLGGDGRYGNRRAIDVILRMGAAHGLSKVIVTTGGVLSTPAASNLIRQRKAIGGIILSASHNPGGENGDFGVKVNGANGGPTPASFTDAVFECTKTLEQYTIVEAPVIPLDAPGLHSIGAMQVEVIDGVEDFVALMQELFNFDQIRDLIRNDFPLAFDAMHAVTGPYATRLFEELLGAPAGSVRNGTPLEDFGNGHPDPNLTYAHDLAELLLEGDDYRFGAACDGDGDRNMILGQRCFVNPSDSLAVLTANATMVPAYANGLTGVARSMPTSAAVDVVAKELGIDCFETPTGWKFFGNLLDAGKITLCGEESFGTGSNHVREKDGLWAVLFWLQILAERRCSVAEIMEEHWKRFGRHYYSRHDYEAVASDAAHDLYDRLESMLPSLVGQAFAGRKISTADNFSYTDPVDGSVTTGQGLRILLDDGSRVVVRLSGTGTKGATIRIYLESYVPNSGDLNQDPQIALAEMISAINDLAEIRQRTGMDRPTVIT

SEQ ID NO: 27481 - protein, 447 aa, Ulva pertusa
MFGALSKAVGSVCSRQGQAAVTGLGSVTGHQVRRAGHAENTNTFIREALAVLDLPPAMEKIVITPQREMTVELIINRDDGKPESFMGYRVQHDNARGPFKGGLRFHKDADLDDVRSLASLMSFKTALLDVPFGGAKGGITVDTKALSEHEIEKLTRKFVQEIKDIIGPFRDIPAPDVGTDGRVMAWIFDEYSKFEGYSPGVVTGKPTWLHGSHGRESATGRGTVFGIKNMLQAFGEGPPADKTFAIQGFGNVGAWAGRLLAEQGGIVKAVSDASGCVYDDGPSGIDVPKLLRHLHRGDDLSKYPHGQQLLRDEIFDVKCDVFVPAALGGVITDPVARKISCKYIVEAANGPTTPSADLILRDRGIPVLPDIYTNAGGVTVSFLEWVQNLQNFKWTTEQVNDQLKTRMDEAFQSMWDSSQEHGVPLRTGAFTVSLRRVVRATVNRGFN

SEQ ID NO: 27482 - protein, 327 aa, Ralstonia metallidurans CH34
MIANFDADRALRLARQTLEIEAEAVSALAGRLTPAFTTAVEMILGCTGRVVVSGIGKSGHIGRKVAATLASTGTPSFFVHPAEASHGDLGMITRDDVLIAFSNSGETAELLAIIPIVKRIGAGLISITGNAESNLAKLSNAHLDGAVAQEACPLNLAPTASTTAALALGDALAVAVLDARGFGEDDFARSHPGGALGRKLLTHVRDVMRTGNAVPAVRESTPLAQALMEITRKGMAMTAVVDPDGRAVGVFTDGDLRRLLETPRDWKTVPIGEVMHRNPHTVHLDKLAVEAVQIMETNRINQLLVVDDDGHLAGALHIHDLTRAKVI

SEQ ID NO: 27483 - protein, 421 aa, Ulva pertusa
MFGALSKAVGSVCSRQGQAAVTGLGSVTGHQVRRAGHAENTNTFIREALAVLDLPPAMEKIVITPQREMTVELIINRDDGKPESFMGYRVQHDNARGPFKGGLRFHKDADLDDVRSLASLMSFKTALLDVPFGGAKGGITVDTKALSEHEIEKLTRKFVQIFDEYSKFEGYSPGVVTGKPTWLHGSHGRESATGRGTVFGIKNMLQAFGEGPPADKTFAIQGFGNVGAWAGRLLAEQGGIVKAVSDASGCVYDDGPSGIDVPKLLRHLHRGDDLSKYPHGQQLLRDEIFDVKCDVFVPAALGGVITDPVARKISCKYIVEAANGPTTPSADLILRDRGIPVLPDIYTNAGGVTVSFLEWVQNLQNFKWTTEQVNDQLKTRMDEAFQSMWDSSQEHGVPLRTGAFTVSLRRVVRATVNRGFN

SEQ ID NO: 27484 - protein, 190 aa, Ralstonia metallidurans CH34
MSNSIIQSPDLGDVTGYLRDRIRTVPDWPQPGVMFRDITPLLQNPKTLRVLIDVFVHRYMDQNLDLVAGIDARGFILGSIIAYELNLGFVPIRKKGKLPFQTVAEEYELEYGSATVEIHADACKPGDRVLLIDDLIATGGTMMAGRKLLERLGATVVEGGAIVDLPELGGSKLLQASGLSLFTVCNFDGH

SEQ ID NO: 27485 - protein, 234 aa, Ashbya gossypii ATCC 10895
MSLFEWAFGKSVTPQERLKKNQNALDRTQRELEREKRKLEAQEKRLVQDIKKSAKNGQINAAKIQAKDLVRTKRYIEKFNGMKTQLQAISLRIQAVRSSDQMAISMREATGLLSSMNRSMNLPQLQRISMEFERQNDMMDQRQEFMDEAIDDAMGDELEEDEEAEEIINKVLDEIGVGLNNKLEDAPQGLVKNSAAAEARVAIPVVSNDTGGALSASSNTDDELQARLNSLKRG

SEQ ID NO: 27486 - protein, 373 aa, Methanosarcina acetivorans C2A
MNEIITWILIALCLTQSAIFSGLTIGIFGLGRLRLEIEAEANNKDAIKILQLRKDSNFLLTTMLWGNVGINVLIALLTDSVMAGTSAFLFSTFGITCFGEIAPQAYFSRNALSVGAKLTPLIRFYQMLLYPVAKPTALILDWWLGREKLELFREQAMRIMLEKHIESGKTDIGLFEGIGALNFLSIDDVNISDEGSIIDPRSVISLPVENNRPVFPAFNRDPADPFLQKIEASGRKWVIITNPTDEPVMVLDADGFLRDAVYKKGPFIPLSYCHFPVVVKSPKTRLEKVIRQFKVYPQYPEDDVIDQDLILYWGEEKRIVTGSDILGRLLRGIVVECDVGSGCEMPPAKQPGLVRRAAFRKDKRKEKTEQRKK

SEQ ID NO: 27487 - protein, 296 aa, Ehrlichia canis str. Jake
MSKVKLSGIFTALITPFKNDFSIDEDTFSKLIEHQISNNIHGLVPCGTTGEYSTLSFEEYCRVIELCVKVTNKRVPIIAGSGSNCTQETIKRTLYVQSLNVDAALVVVPYYNRPSDEGIFQHFKAVHDATDVPIIIYNIPQRTAIDPNDVLLARILSLPRIIGIKDATGDVSRPLNLKLLIDKEFALFTGNDATSLGFYAQGGGTGCISAVSNVIPKIYSDMHNAFFAHNIKEAMDANASIFKLSKVLFCQSNPSPTKYAMSLIKGISPTVRLPLVELTQENKLKVENMLKELNLI

SEQ ID NO: 27488 - protein, 449 aa, Pasteurella multocida subsp. multocida str. Pm70
MSQVATLDAFLERVAQRDGTQPEFLQAVREVFTSIWPFLEANPKYRSQALLERLVEPERVIQFRVAWTDDQGQTQVNRAFRVQYNSAIGPFKGGMRFHPSVNLSILKFLGFEQIFKNALTTLPMGGGKGGSDFDPKGKSDGEVMRFCQALMAELYRHVGADTDVPAGDIGVGGREVGYLAGYMKKLSNQAACVFTGRGLSFGGSLIRPEATGYGLVYFAQAMLAEKGQSFAGKTVSVSGSGNVAQYAIEKALQLGAKVVTCSDSSGYVYDEAGFTTEKLAALMELKNEKRGRVEEYAKQFGLKYVAGKTPWEVKVDIALPCATQNELDLASANTLIANGVQLVAEGANMPTTIEATDAFLDAGVLFGPGKAANAGGVATSGLEMTQSSQRLYWSAEEVDKKLHSIMLDIHANCKKYGTIEGQANINYVVGANVAGFVKVADAMLAQGVY

SEQ ID NO: 27489 - protein, 117 aa, Ehrlichia canis str. Jake
MQEGNNSYDKDNVFAKILRKELPCNIVYEDESVLAFHDIHPQAPIHVLVIPKSDYISFDDFSNSSAEDIKHFFSVVKKITHKLQLDKTGYRIVTNHGKQGGQIIPHFHVHILGGKQL

SEQ ID NO: 27490 - protein, 417 aa, Symbiobacterium thermophilum IAM 14863
MENRTGDGRQNPARNEADLKEAALRLHVQNRGKWTTASKVPLQTQEDLALAYSPGVAEPCRAIAADPEAVFRYTARGNLVAVVSDGSAVLGLGDIGPEAALPVMEGKALLFKAFADIDAVPLVLAERDVDEIVRTVTRLSPTFGGINLEDIAAPRCFAVERKLQAAVDIPVFHDDQHGTAIVVAAGLQNALKLVGKRLEEVRVVIEGAGASGLATAALLLDLGVSDLTLVDSRGTIYPGRPDGMNPFKEELAQRTNPRRVRGGLAEALAGADVAVGLARGGSMTREMVRAMAPDPIVFALANPEPAIWPEEAKAAGAAVVATGRSDYPNQLNNVLAFPGIFRGALDVRAREINEAMKRAAVRAIADLVAPEELSADYIIPAPLDRRVAPAVAAAVAEAAVRSGVARSPGFDSFDPYI

SEQ ID NO: 27491 - protein, 159 aa, Propionibacterium acnes KPA171202
MSVNHLHRRMPLIVIMGVAGAGKTDIDSMLAERFGVDFMDGDDLHPQANIDKMTSGYPLNDEDRRPWLTNIAAWMAERADNGAVVACSALKHIYRDQLRKTCPDLVFVHLAGDRKIVAKRVEARTGHFMPTSLIDSHIRHPRTTGRRRGRHHSQFRRYS

SEQ ID NO: 27492 - protein, 1320 aa, Candida albicans SC5314
MKSQSTDTLQPRISSDSLVYSSSSSSSNVYSQPKLPFARSYSSIPEQVHDPGSRQSSKNSNTNFSFSEHDDSIQEFLISPIQSDIFPYSKKPVISPVLESPEAGGDSTIVETSSPSPTKSGTVSLNSNAIGSIIGSYDYSKSSLELEKPKPVEEPVFQKDHARDHARQGSDASTISNGSEQVSKDKRFVRYAMNTQSPLVNASNKWQISNVIKWLDKNQFNNSWKETFRRNEISGNRFLELENFDKESMIWKQFSKFLQLDDDLNSVDRFIELLRKESSHELQTRKSLGGGEISPINVKHENRKSTPIYTKHMSTSSVSSSNSSSSISRPLSYVDSKPKEQLSSPSHHSFFRKHSRSTSNESKDAKKRYSSFDDNRVKSVPKNDKKSNGILSTLRKYGGDKIAKNTKQRSSTYFPSLDLPPPLESDPPAYNERKISVDSELSPKSIKSFSDDLSIDPKYLPTQHQELDLRKFHDCEPITILASKDNISFVPIVITELSNAKSHIIKALGLIDIGSITLHLTDFFHKEGEAIPDFLIPKVLKLDGLLKFYVRQELKSPEGTTTTFSTTSSDSKSYIADGNKTYPETPQYLLQAQHDSRVDYWNFKDLTSISEDPSKSLAGAKQNIDSKRNDTKQKPKEFPLKFPFANAPKKGNTVPQLQIDTSGVNNISKPPTSTGSTFQVLRKKGHEIDFDKRRKSPYESKTPKIIANIYSSSVANTKKSPISASTVMALKDDVVVQRPETISRSNSIIAKRTAPPPPGDRRVQIQRQNSILRRKPGLKSTNNVTSGSSEGSKKNISDSTDDNDSEDAFFVKPLKKKENELGNNSDNNSENDEDNDSDDDFFVKPIKKEVADVSAGKVELDDSEEDFFVKPIHKKPSHMNVRPPVEEVYNNLEKYFPYTNLDKPIIDDSPASPSPQRRPTISRTFSSANKSPVAPTSADSKNTNDEQPSLRVRRMKTIRGVANEARRKVLQMKQASPPNTFANITRENSAKLTRSNTKMWGQRVVEVTSQEIEKGFVSKLRNKNGLYQEYAWIKGELIGRGSFGDVYLGLNVTTGEMLAVKQVVCGRNNKEGIEALHKEVETMKDLNHMNIVQYLGYDQQKNIYSLFLEYVAGGSIALCLKSYGKFDETLIRFITKQILLGLEYLHSNNIIHRDLKADNLLLEVDGTCKISDFGISKRSNDIYANNANMSMQGTIFWMAPEVIDSMVEGYSAKIDIWSLGCVVLEMFAGKRPWSNEAAISVIYKTGKEKLAPPIPDDIAHLVSPVAESFINRCFTIDPKDRPTAGELLNDPFVNTLDHDFNFANTKLAEMIRYNSKRLFT

SEQ ID NO: 27493 - protein, 107 aa, Nostoc sp. PCC 7120
MTQETSEKINNLITQNKIMVFMKGTKLMPQCGFSNNVVQILNTLGVPFETINVLEDQEIRQGIKEYSNWPTIPQVYINGEFIGGSDILIELYQKGELQQLVEVALAS

SEQ ID NO: 27494 - protein, 140 aa, Brassica napus
MGHYAAVWDDKAATEITKDWNGIDQVLLRNPHGASAKISLHGGQVISWRNDQGEELLFTSNKAIFKHPKSMRGGIQICYPQFGDCGSLDQHGFARNKIWVIDENPPPLASNESFGKSFVDLLLKSSEEDLKQWPHSFEFR

SEQ ID NO: 27495 - protein, 433 aa, Photobacterium profundum SS9
MSKIVKVLGREIIDSRGNPTVEAEVHLEGGFVGMAAAPSGASTGSREALELRDGDKSRFLGKGVLKALEAVNGPIAEALLGKDATDQAAIDQVMIDLDGTENKSKFGANAILAVSLANAKAGAAAKGMPLYEHIAELNGTAGQFSMPLPMMNIINGGEHADNNVDIQEFMIQPVGAKTFREAVRIGAEVFHNLAKVLKAKGLSTAVGDEGGFAPNLESNAAALAAIKEAVEAAGYELGKDVTLAMDCAASEFYDKEAGNYNMKGEGKIFTSEEFNFYLQDLANQYPIVSIEDGLDESDWAGFKHQTELLGDKLQIVGDDLFVTNTKILAEGIEKGVANSILIKFNQIGSLTETLAAIKMAKDAGYTAVISHRSGETEDATIADLAVGTAAGQIKTGSMSRSDRVAKYNQLLRIEEALGAKAPFNGLKEVKGQA

SEQ ID NO: 27496 - protein, 583 aa, Zea mays
MAVPPLLLVAVAVAALSILVLVVFAFRRCRRRRQRHPLQAAAVAPTPVAVQDEDIDRPLLSENQSDHSRQNISFLGSSVGEPSKIQTNRSNTSPRSHAIADTGRIYPAECCVTQGETHVINVENDTSEEFQLGSTLRRTPPPKWPTPDQKHRRRVSGDDNHNGSVPLKDNTYHSRLDLEVIAGPSHGISCSRQSSRPSMLPITLGRVPPSDLVLKDSEVSGKHAQINWNGKTLKWELVDMGSLNGTFLNSQAVHHPSAGSRHWGEPAELAHGDIITLGTSSKLSVQILLQNQRVPAGVGMASDPMVARRSGKKLPMEDISFCQCPLQGVEHFGLFGIFDGHGGDGAAKAVSKILPEHLGYILSHPETKERVQSYSDASDVLRYAFTLTEDTIDHQYEGCTGTALLIWFDQNKDCFAQCANLGDSACVMSVNGKTIDMTEDHRVTSATERARIARTGQPLRDGEARLSGLNLARMFGDKFLKEQDPRFSSEPYVSQAVRITKACTAFAVIASDGLWDVISTKRAVQLVVEGKERRSSGDATSAAARVASRVLDEARSLRTKDNTSVIFVDFDVLRRDPCISPVD

SEQ ID NO: 27497 - protein, 560 aa, Triticum aestivum
GFDAVSLPLDFFPVLKRRLKGAKVPGGSRKNNRQKIIYEHTIAYNVLIEKAEGKGSNNGGGGGACAIPRWLAWLVVSLLSLYLLNLLTHARSGLSPGPRPLPLIGSLHLLGDRPHRSLARLARTHAAPLMSLRLGAVTTVVASSPAMAREFLQRHDAAFATRSVPDATGMHAAGSVPWLPPAPRWRALRKMMATELFAPHRLDALHHLRSEKVGELMDHVARLARDGKPVNIGRVAFTTSLNLLSRTIFSHDLTSLDDDNRSGEFQEVVTGIMETVGGPNVSDFFPVLAPADLQGTRRRLARLFARLHVVFDAEVDQRLRARDAGQPRKNDFLDVLLDVAAREDGKDLLDRQTLRSLFTDLFAAGSDTSSSTVEWAMTELLQNPSSLAKACNELEQVIGPRRNIEEADIVRLPYMQAIIKETFRLHPPAPLLLPRQPEASLKIAGYTIPKGSRIFINVWAIGRDKDVWDEPEKFMPERFLGSTIDFRGADFELLPFGAGRRICPGMTLATRMVHLMLASLLHQFKWSLPVELEKDGIDMEDKFGLTLTKVIPLCIVATPV

SEQ ID NO: 27498 - protein, 608 aa, Gibberella zeae PH-1
MNRTSRTDEPYEGEQKGYNQSPNPLSADLTTNQDLKGTVDGRTVRRGTQSPSLYNSALDDDIRQTLDPDAGSSGARGSELVNKDVSQLMGSEVEQAAQSPFPHSPPSNSASGLGGDEGGTLSWGNRLKNGIIKFCSFIGPGFLIAVAYTAGATYQFKLLFVVLMANLFAIFLQTLCIKLGTVSGLNLAQACRAFLPRWANFGLYFFAEVAIIATDIAEVIGFAIALNLLIPAIPLVAGCAISILDVMLILLFYQPHGSMKGLRVFESFIVLLVLGVVICFCIQLSLIQETNVGSIFRGYLPSSAITEQKGLYQACGILGATVMPHSLYLGSGIVQPRLRSFDAKHDLLPENIQSPSNDSNDINKGYYIPSLRAIRHCYRASAIELAIALFTFALFVNSSIVIVSGVSLHNKPDASEADIFSIHKLLSESISSVAGTIFALALLLSGVSAGIVCTITGQMVSEGALNWRLRPWLRRLVTRGISIIPSVVIAAAVGRSGLNDALNASQVVLSIILPFVSAPLIYFTCLNKYMTVKPGGAGFGTNCDRETTRNRNEEALARDEIGSVKMANSWLTAAFAVLLWLVITVLNVANLVLLGLKDACSTRRDKAT

SEQ ID NO: 27499 - protein, 439 aa, Symbiobacterium thermophilum IAM 14863
MSQLKATLVRKIEEHRPRTQRLLKEFGHVVIDEVTIEKAIGGARDVRCLVTDISYLDPMEGIRFRGKTIEETFAALPKAPGGEYPTVEAFWFFLLTGEVPTQEQVDEVIAEWKERRNVPQYVYDVIRALPKDSHPMTMLSAGILAMQRESKFARYYHSGEYNKQRAWEYMYEDASDLVARIPMIAAYIYRYKYKDDVHIPPDPNLDMGANFAHMMGVPKPYDDVSRMYFILHSDHESGNVSAHTGHLVASALSDAYLAYSAALNGLAGPLHGLANQEVLRWIMDFQAKLGEGVEPTRENVTQALWDTLNAGQVIPGYGHAVLRKTDPRYTAQREFCLKHMPDDPLFKLVSMIYEVAPGVLMQHGKAKNPWPNVDAQSGVIQWHYGVREWDFYTVLFGVGRALGVMANIVWDRALGYPIERPKSVTTEMLEQWAAAGGRK

SEQ ID NO: 27500 - protein, 421 aa, Streptomyces peucetius ATCC 27952
MIGDEPYEPYDRPPLSKQVLLGMAPADRTALPRRRAVDATWRLGVPATGLDMAARRVRLADGDEVPYDRLLIATGVRARPWPREAEAELDGVFVLRTREDGAALARRLAEGPKRVFVIGAGFTGSEIASACRERGLSVTVAERGAAPLVGPLGGVVGAVAAGLQREHGVDLRCGVMVTALEGDSSGRVRAAHLSDGSTVETDVVVVSLGATRNTEWLAGSGLGAGPRGIACDAGCRAFDIRGIVTDDIYVAGDVARSPHALFGYQFLSLEHWGNAVAQAEIAAHNMISESTDRLPHMWVPAFWSSQFGVNIKSVGVPSLGTEIMVSQGTLSSRRFIGVYGYQGRVIGAVAFDHARWLPFYQELVETTAPFPPPFPTVDRHTDGQRPMDADFPDPSVPTHGPTVTLSGYSPADRRMTFTPAH

SEQ ID NO: 27501 - protein, 478 aa, Xylella fastidiosa Ann-1
MSEHYDVVVIGAGPAGYHAAIRAAQLGLKVACVDAALGKDGKPALGGTCLRVGCIPSKALLDSSRQYWNMGHLFNEHGISFKDAKMDVATMIARKDKIVKQFTGGIAMLFKANKITPYYGFAQLQPGNVVKVKQHEGKNIELKGTNVILASGSDSVELPFATFDGETIVDNIGALDFTKVPKRLAVIGAGVIGLELGSVWKRLGAEVTILEAMPNFLAAVDADVSKTAAKEFKQQGLDIKLNAKVSRTEISSKNNKKEVIVTYTDASGKQTLTVDKLLVAVGRKAATKGLLADGTGVQLNERGQIMVDEHCHTGVDGVWAIGDCVRGPMLAHKGFEEGIAVAELIAGLPGHVNFETIPWVIYTEPEIAWVGKTEQELKADSIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 27502 - protein, 315 aa, Oryza sativa
  misc_feature (288)..(288): Xaa can be any naturally occurring amino acid
  unsure (1)..(315): unsure at all Xaa locations
MAAVYKSLNKGAGNPAARDADAEKPRNRQRLLMLSSRGVTMRHRHLLNDLHSLLPHSRKDAKLDTKTQLSQLNELADLYNCNNVMFFEARKGKDLYVWLSKPPNGPTVKMHCQNVHTTEELNFTGNRLKGSRPILSFDASFDKQAHTRVIKELLTQSFGVPPGSRKVKPFTDHVMSFTLAGNGKVWIRCYQISEQEAAKHVKPTGDDTPADPKALPTVAGLKGETNISLVEIGPRLVLTPIVIQEGSFGGPIIYENKEFVSPNQIRSDLRRAKAGRYNERTESQIERXGQTSRLGLRTGEGAKRVDPLDNRVVFA

SEQ ID NO: 27503 - protein, 215 aa, Wolinella succinogenes DSM 1740
MKSLFEGAVKFREEDFKEHKELFERLGQKQEPHTLFVGCADSRVVPNLITNTLPGELFVVRNIANVVPPYREAEEFLATTSAVEYALNVLNVRNVIICGHSNCGGCSALYLEESSFKKTPHVKKWLELLEPTRKKVLSLEPDTIAKRSWMTEQINIEKQLENLFTYPGVKERFLKGELGVFGWYYIIETGEVFSYDFDKHQFVLVEESPKIEQER

SEQ ID NO: 27504 - protein, 162 aa, Brassica napus
MALRSVKAPTSIPPGLIVSSSVINKPQSLRFASKPTASLAVRSNLKLKPASPRAAKFRCSASSSSALTPQLRDTLEKLVNSEKVVLFMKGTRDFPMCGFSNTVVQILKSLNVPFEDVNILENEMVRQGLKEYSSWPTFPQLYIDGEFFGGCDITLEASQSGE

SEQ ID NO: 27505 - protein, 528 aa, Arabidopsis thaliana
MYNKLQNLRHETRSVEEYAEEFYLLLTFNDINDSQTQLVSRLIGELRSQLQNSLSQFDPTTVSEAHRRAASFEKQMRSASWNFTNTRPRSLEQQTPPTNIASREGDEQIKIVTRNTNDEQGLRRSARTENGEILSLARKLSPPNPRRHCVRLLGTAALLSWFPPDGMQIYPRNDRRFSCGYASGMMYFYGMRIKEDDYDGVPVLCNPITGHYATLPAIARFRQAFSFFGYDPIDKQFKVLFMIMAYPCSPDHHKVLKLGSGEMSWRRLKRTLRHEIMSEGICINGVVYYLGDTSEVLTSFVVVCFDVRYETFSFLYPGSYCELINYKGKLGLVFYDDYDGDTIKLRLWVLEDEEKNEWSKYAYVLWDDIFLAHYVSVVGVTATGEIVLSMADYTSKQPFYIFYYNPEMNTLQCVEIRGFGEYHEASGNRSRVCVFVDNVFEKDCSRFYALADHVEDINVIDSKLLKSKIYEDTYPNLEDYEQSDHDETSDDEESLRSYNYSYKPYMYAGEEERRKRSRRTRRSTIRRR

SEQ ID NO: 27506 - protein, 331 aa, Brassica napus
  misc_feature (284)..(284): Xaa can be any naturally occurring amino acid
  unsure (1)..(331): unsure at all Xaa locations
MALEIDNKFTGPVANGGEKRAYVTFLAGNGDFVKGVVGLAKGLRKVKSMYPLVVAVLPDVPEDHRKQLVEQGCVVKEIEPVYPPESQTEFAMAYYVINYSKLRIWKFVEYSKMIYLDGDIQVFQNIDHLFDLPSGHFYAVKDCFCEKTWSHTPQNKIGYCQQCPEKVTWPSELGPQPPLYFNAGMFVYEPNLYTYHNLLETLKVVPPTPFAEQDFLNMYFRDIYKPIPGIYNWVMAMLWRHPENVELDKVKVAHYCAAGSKPGRFTGKEPNMGREDIKMLVKKXGWDIYNDETLDYKNISGDKGGDDHMKQFVKALSEAGVLQYVKAPSAA

SEQ ID NO: 27507 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEVKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLDKETTYDEIKKVVKAAAEGKLKGVLGYTEDAVVSSDFLGDSHSSIFDASAGIQLSPKFVKLVSWYDNEYGYSTRVVDLVEHIAKA

SEQ ID NO: 27508 - protein, 332 aa, Saccharomyces cerevisiae
  misc_feature (12)..(12): Xaa can be any naturally occurring amino acid
  misc_feature (48)..(48): Xaa can be any naturally occurring amino acid
  misc_feature (95)..(95): Xaa can be any naturally occurring amino acid
  misc_feature (233)..(233): Xaa can be any naturally occurring amino acid
  misc_feature (242)..(242): Xaa can be any naturally occurring amino acid
  misc_feature (287)..(287): Xaa can be any naturally occurring amino acid
  unsure (1)..(332): unsure at all Xaa locations
MVRVAINGFGRXGRLVMRIALQRKNVEVVALNDPFISNDYSAYMFKYXSTHGRYAGEVSHDDKHIIVDGHKIATFQERDPANLPWASLNIDIAIXSTGVFKELDTAQKHIDAGAKKVVITAPSSTAPMFVMGVNEEKYTSDLKIVSNASCTTNCLAPLAKVINDAFGIEEGLMTTVHSMTATQKTVDGPSHKDWRGGRTASGNIIPSSTGAAKAVGKVLPELQGKLTGMAFRXPTVDVSVVXLTVKLNKETTYDEIKKVVKAAAEGKLKGVLGYTEDAVVSSDFLGXSNSSIFDAAAGIQLSPKFVKLVSWYDNEYGYSTRVVDLVEHVAKA

SEQ ID NO: 27509 - protein, 528 aa, Yarrowia lipolytica CLIB122
MSEPTTTPVVGNSASGDSAEQHDLGQKRGKGGNWNRPRGDHQAKKQKMDRRGDRQREQEKQGEGRDTRRKTDGPLVADEVRQPKRKVACMIGYCGTGYHGMQLNPPQKTIEGDIFQAFVKAGAISQNNADDPKKSAFMRAARTDKGVHAAGNVISLKMIIEDENIVEKINSHLPEQLRVWGVSRTNKAFECRKLCSSRVYEYLMPTYSFLNPRPGTVMSEKLLKDGTSPDEEGKKYWESVAADLESQGVSYDEWMKRACIDEIKGEETKEVAESEVKTDSKTDAATLEKIKAVERRHREEFRISGERLAKIREILKIYEGTHNFHNFTLGKAFKDPSAMRTMKSLTCSDPFLIDGTEWVSIKIHGQSFMLHQIRKMISMVALSVRCNADPQKLIPQTFEKARINIPKAPALGLLLERPVYDSYNKKLQGEFGREGVHFDNWNDQIEAFKHKFIYDKIYAEEKGQHVFHAFFSFVDVFTGDASFDFLLKQGITKECTTDYMNKKAKEEGKEIKKLEEDDDEVANEQNEG

SEQ ID NO: 27510 - protein, 332 aa, Saccharomyces cerevisiae
  misc_feature (32)..(32): Xaa can be any naturally occurring amino acid
  misc_feature (324)..(324): Xaa can be any naturally occurring amino acid
  unsure (1)..(332): unsure at all Xaa locations
MIRIAINGFGRIGRLVLRLALQRKDIEVVAVXDPFISNDYAAYMVKYDSTHGRYKGTVSHDDKHIIIDGVKIATYQERDPANLPWGSLKIDVAVDSTGVFKELDTAQKHIDAGAKKVVITAPSSSAPMFVVGVNHTKYTPDKKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLAKEATYDQIKKAVKAAAEGPMKGVLGYTEDAVVSSDFLGDTHASIFDASAGIQLSPKFVKLISWYDNEYGYSARVVXLIEYVAKA

SEQ ID NO: 27511 - protein, 427 aa, Haloarcula marismortui ATCC 43049
MSTQKEPPEQATDEDESPIATARRQLERAAEHLDLSEGMLEQLRHPSKTVEVSVPIHRTDGSVEVFNGYRVQHFEVRGPYKGGMRYHPSVSAEECTALAMLMTWKCAVMDLPFGGAKGGIVVDPSTLDAQETEQLTRRFAEELREVVGPTKDIPAPDMGTDEQTVAWFMDAYSMQEGETVPGIVTGKPTAVGGTHGREEAPGRSVAIVAREALDYYDGSVEGATVAVQGFGAVGANAARLLDSWGASVVAVSDVDGGIYDESGLDIESISADGDEHGQLGAVDAPRQLSNAELLELDVDVLIPAAVGNVLTEENAADVQASIIVEGANGPTTTAADTVFEERNIPVIPDILANAGGVTVSYFEWLQHINRRSWSREEVNDELEAEMLDAWEALQAEVEDRDVTWRTAAYIVALSRIGDAMNARGLWP

SEQ ID NO: 27512 - protein, 429 aa, Methanosarcina acetivorans C2A [sequence omitted]

SEQ ID NO: 27513 - protein, 275 aa, Synechocystis sp. PCC 6803
MTFSADRSPNTGIKAEITNSVSDPKETTADMVDVNSMDEDNWVDAGDGETEESKALQELPLSRQQPVLKSPQTLAMVESAFLASMVSIIWLINYYFPIGPLLRILFPIPLALVYLRWRSPAAIKGMIAAGLLLSVLMGPTRSVVFVIPYGLMSLQLGFCWVRNASWGFSIFTGALIGTFGFFFRFWLFSFLLGENLWQYVMGQITNLLDWLFLQFNILAQPDVLLVQFLAVGMVFLNSLIYMLAVHLTALLILDRLGNPIPRPPQWLKVILDYDY

SEQ ID NO: 27514 - protein, 343 aa, Aspergillus oryzae
MSSNKALIFKQVPTGYPVPGKDLTIQPALYDKDIAPAENGIVVQSLYASFDPYMRGRMRSADTKSYIPGFELDKPIDSLGIAKVIRSNNAAYKEGDIVIGQIPIQEVVSLDEGSIAKVRLLQNPLGIDLSVFLGALGMPGLTAFSSFYKIGKPKQGETIFVSAASGAVGQVVGQLAKHEGLKVIGSVGSDEKLDFILNELGFDGGFNYKKEKPADALARLAPQGLDIYYENVGGEHLEAAIDALNQFGRIVACGMISEYNSAPYPITNLHKVVGKSLEMRGFIVMNPGFADAYMEEHQMKVQKWISEGTFKALTHETVGIENAAEGLVGIFYGRNKGKAVLKF

SEQ ID NO: 27515 - protein, 578 aa, Arabidopsis thaliana
MCGILAVLGCIDNSQAKRSRIIELSRRLRHRGPDWSGLHCYEDCYLAHERLAIIDPTSGDQPLYNEDKTVAVTVNGEIYNHKILREKLKSHQFRTGSDCEVIAHLYEEHGEEFIDMLDGMFAFVLLDTRDKSFIAARDAIGITPLYIGWGLDGSVWFASEMKALSDDCEQFMSFPPGHIYSSKQGGLRRWYNPPWYNEQVPSTPYDPLVLRNAFEKAVIKRLMTDVPFGVLLSGGLDSSLVAAVALRHLEKSEAARQWGSQLHTFCIGLQGSPDLKAGREVADYLGTRHHEFQFTVQDGIDAIEEVIYHIETYDVTTIRASTPMFLMSRKIKSLGVKMVLSGEGSDEILGGYLYFHKAPNKKEFHEETCRKIKALHQFDCLRANKSTSAWGVEARVPFLDKEFLNVAMSIDPEWKLIKPDLGRIEKWVLRNAFDDEERPYLPKHILYRQKEQFSDGVGYSWIDGLKDHANKHVSDTMLSNASFVFPDNTPLTKEAYYYRTIFEKFFPKSAARATVPGGPSIACSTAKAVEWDATWSKNLDPSGRAALGVHVAAYEEDKAAAAAKAGSDLVDPLPKNGT

SEQ ID NO: 27516 - protein, 412 aa, Arabidopsis thaliana
MPLEEILSRLPLKSTRAVRSTCKKWDSLFKNRSFISKAAAAREGESQMVVLMDHNLHLVSFFFGSDTSVEIKGKRICLNDDSDSEQVKISQVFHCEGLLLCILKDDNFSLVVWNPYWGQTRWIKPRCSFEIPQGCDMYRYAIGYDNKRRNHKILRFIDYEFHYPRDNVVLWYEIYDFESDLWTTLDVTTPHWLINCGNRGVTLKGNTYWCAKKRNSDLFLNADHIICFDFTSERFGPLLLLPFSDLDGVVTLACVREEKLAALVCHEDVVEVWITIKIEANEVLWSKFLTVNVDLGDEIPSSLTYGSFFIDEEKKVAMIFDKTLDRGDTVHIMGEAGYGGQVDLGEPVNKRRCPLVCSYVPSLVQIKKPAGFQRKQQSKLEKRQYVRNISKLRALKTQSSWTLSMSLECHQQ

SEQ ID NO: 27517 - protein, 277 aa, Prochlorothrix hollandica
MTVATAEKRPLEWTTILFILGLHLGALCVLFPSNFSWYAVALALFMHWFTGCLGITLGWHRLISHRSFQVPKWLEYFFVFCGSLSCQSGPIEWIGLHRHHHAYSDQEEDHHNSNKGFWWSHMNWMWVDVPARKQLPRFTRDIASDPVYLFFDKYFIPLQFAVGIIFFIASDAIVGNGWSFVVWGVFLRIVLLYHCTWFVNSATHKFGYRTHETTDNSRNCWWVALLTYGEGWHNNHHAFQYSARHGWQWWEIDITWLTIRLLERLGLATKVKLISEA

SEQ ID NO: 27518 - protein, 263 aa, Glycine max
MTSSFSTQLVQSQNLPPRFHRHVQGNFSQDVSKVSMTHVVRSSTKSQLGYGKTLASRSHYAARFSVSRQSEAKSITYRRMTCTNAKENVLQLQAKVTNKCFFDVEIGGEPAGRVVFGLFGEDVPKTVENFRALCTGEKGYGYKGSYFHRIIQNFMVQGGDFTEGNGTGGISIYGDSFDDENFNLKHVGPGVLSMANAGTNTNGSQFFICTVQTPWLDNRHVVFGHVIDGMDVVRTLESQETGKFDNPRKPCKIADSGELPIDS

SEQ ID NO: 27519 - protein, 426 aa, Escherichia coli CFT073
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKHTLTCTYNDLASVRAAFEQYPQEIACIIVEPVAGNMNCVPPLPEFLPGLRALCDEFGALLIIDEVMTGFRVALAGAQDYYGVEPDLTCLGKIIGGGMPVGAFGGRRDVMDALAPTGPVYQAGTLSGNPIAMAAGFACLNEVAQPGVHETLDELTTRLAEGLREAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 27520 - protein, 749 aa, Debaryomyces hansenii CBS767
MSSKQFKLQLIQKSLAELGYGNLAEQISEDIHFNPITHEAESPYHNDQNEYSDLLKFIEWFYEELNVGNYATIIEYLNYIMLPEESAMNVDDIPQDFNNIGIDLFKALNLKEDSVDTIGGVCTLIITYLIKRTYFLECLVVNAFNSSKQYHKAELVGDISRYSFTPISVPDLLVILRDDLCPLLDEIQNALKSININEIVGSMWNFKPDLVELLNREKESTLLLPLVMKSPIELADLTKMILNDQVLLADTTINQISLPHIIDELRNTLIDKHLCTIFKDSCRNPATNKAAFDIPPDYLDKLIENATAYQKEQSPYYLPPRINSKRQGETFLPPLYSEINEKYKKSFPSTLITTLDKHSDEVWIAKFSPLGKLLVTGSLDGRLIIYDVLNNFEVIAILDSDIQGIKSRTRSNKAIIYCCWEPNEEYLVSCCLDTVVRVWSIKDIKKNNKRITRSMDVELDSQVALLRSSFTLGESIKTWSCEFLPTTADPQFIIGSPDKVLKAFNIDGKELFDFYADTEENGLYHDEKASSSDIKDGNDKTDSTNDGENKDKTNNIQNNFYRVNDLAITPDGKFLITANDDKQVYFYTIPDLLDPNSTTTKIATVSLGGKLTSCSISSNGKYLLLSITPEEVQIWDISGLGKSEKPILRKKLIGHSQDKYIVRSSFGYLSDKQEELAISGSVDGYIYIWKIETGQLITRIKGHVGLCNSVDWNKYYIPKKNCKDYGKLWCSVGDDKIVKIWGPSDWSNE

SEQ ID NO: 27521 - protein, 234 aa, Methanosarcina acetivorans C2A
MTERNTSTDSPEKRAAGIAAAGLVSSGMLVGLGTGSTVAYTIKELGRRVREEGLDILGVVTSYQSEMLAIEAGIRLTTLAQHPELDLAIDGADQIDSELRAIKGGGAAHTREKIVSVSARRFVVVADESKTSKQLDKLVPVEVLPFAKEPVVKKIRELGGKPQLRSAVKKDGPVITDNGNFVLDVEFGVIKDPEALALQLSSIPGVVEHGIFCNVSELYIGNKDGAIKIITRQK

SEQ ID NO: 27522 - protein, 321 aa, Pasteurella multocida subsp. multocida str. Pm70
MIKKIAVLTSGGDAPGMNAAIRGVVRSALAAGLEVYGIYEGYYGLYHNKVKQMTRYSVSDIINRGGTFLGSARFPEFKDPAVRAKCAEILRSHGIDALVVIGGDGSYMGAKLLTEEHGFPCVGIPGTIDNDVAGTDYTIGYQTALQTAVEAIDRLRDTSSSHQRISIVEIMGRHCSDLAISAGIAGGCEYIVASEVEFNREELIQQIERSIIKGKRHAIIAITELICDVNELAREIESRVKHETRATILGHIQRGGTPCAFDRILGSRMGVYAVDLLMQGKGGYCVGIQNEQLVHHDIIDAINNMRREFKADWLALSKRLD

SEQ ID NO: 27523 - protein, 441 aa, Ralstonia metallidurans CH34
MTHVFHRNPKQTLPVAVGGQGIELIDSNGRRYLDASGGAAVSCLGHGHPRVIEAIKAQVDTIAYAHTSFFTTEVSETLAQTLADAAPGDLDHVYFVSGGSEAVEAALKLARQYFVEIGQTQRRHFIARRQSYHGNTLGALAIGGNAWRREPFLPLLVPAHHVSPCYAYRDQAAGEADTQYAQRLADELEAKILELGPDSVAGFVAETVVGATAGAVPPVADYLKRIRAVCDKYGVLLILDEVMSGMGRTGYLFACEEDGVVPDIVTIAKGLGAGYQPIGAMLSTSRIYDAIIGGSGFFQHGHTYIGHATACAAALAVQRTIVEDKLLDNVLARGEQLRARLRESLGDHPNLGDVRGRGLFVGVEFVADRATKATLDPAKKTHAVLKRTCMEHGVLVYPMGGTVDGIHGDHVLFAPPFICTPTDIDNIVDRFTQAVKTVLPA

SEQ ID NO: 27524 - protein, 116 aa, Pasteurella multocida subsp. multocida str. Pm70
MAEETIFSKIIRQEIPANIVYQDELVTAFRDISPQAKTHILIIPNKLIPTVNDVTAQDEISLGRLFTVAAKLAKDEGIAEDGYRLIVNCNKHGGQEVFHLHMHLVGGEPLGRMLAK

SEQ ID NO: 27525 - protein, 255 aa, Polaromonas sp. JS666
MNENADPADELLLRLRRFHSDYFPLHQQRFQDLVAQGQHPKTLFIGCSDSRLVPYLLTGAGPGELFIVRNVGAFIPPYDGYVTDPHEPGGGCPPGGRARLEAARQWVGLHGTTAAIEFAVLNLHVERIIVCGHSHCGAIRAAYDGVSAEAVALQAWLKLAREALLPVQSSPEALRRTEQRAVVLQLERLMGYPMVRREVENGRLTLHGWHYVIEDGEVHTFDVRQGNFVPASVASNSGTGPYQPYVERDGQIFSS

SEQ ID NO: 27526 - protein, 115 aa, Brassica napus
MHHPPLETHQPERCRPMTSTVSEIEEVIDSERTTLLNGSNGLSSPEPVRRRVSGKSPADGGSRRICRQPSFGRDIGHAAKETYLVTRLSFQLLRYLGVRFRWIMKLLALTCYAML

SEQ ID NO: 27527 - protein, 298 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLEAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGHPL

SEQ ID NO: 27528 - protein, 317 aa, Haemophilus somnus 2336
MTTQLDALRNMTVVVADTGDIDAIKKYQPQDATTNPSLILSASSLPQYAPLIDEAIAYAKAKSADKTQQLIDAEDKLAVNIGLEILKIVPGRISTEVDARLSYDTQATVEKARKLIALYNEAGISNDRILIKIASTWQGIRAAEILEKEGINCNLTLLFSKAQARACAEAGVYLISPFVGRILDWYKANSDKKEYAPAEDPGVISVTKIYNYYKQYGYNTVVMGASFRNVGEITELAGCDRLTIAPALLKELQENSTALVRKLAFKGEVKAKPQPLTESQFYWQHNSDPMAVEKLADGIRKFAIDQEKLEKMLLEKF

SEQ ID NO: 27529 - protein, 176 aa, Leuconostoc mesenteroides subsp. mesenteroides ATCC 8293
MTVDLHDFVATVEDYPEPGVSFRDISPLMGDGVAYKQAVDAIADFAKHLNVDLIAGPESRGFIVGSPLAYAMNIGFVPARKGGKLPREAVSASYTLEYGGVNELEIHKDAIKPGQRVLIVDDLLATGGTINATREIIEKLGGIVAGVAFIIELESLQGREKIMKAGEVPFLALMEY

SEQ ID NO: 27530 - protein, 390 aa, Wolinella succinogenes DSM 1740
MYSHRIESLSESMTIAISTLARELQSKGKDVISLSAGEPDFETPQVIKDEAIKAIEDGFTKYTSVAGIPELLKAIQAKLARDNHLEYETKEILVSNGAKHSLFNIFQAIVEEGDEVIIPSPYWVTYPEVVTYCGGKNIFIETCDASGFKMSAAQLKAALTPKTKALVLTTPSNPTGSVYSRQELEAIAEVLKGTNVWVVSDEMYEKLVYGVEFTSVASISEDMLKRTITVNGLSKSAAMTGWRMGYLATKDKKLIKLMDNLQSQCTSNICSITQKASIPGLDGRIDPEVEKMRQEFERRRNFAVDALNAIKGLSVIKPEGAFYLFVNTKALELDSMQFCKDLLEEEGVAVVPGIGFGMEGYFRLSFATSMEKIEEGIKRIARFCEKRERA

SEQ ID NO: 27531 - protein, 115 aa, Arabidopsis thaliana; identical to SEQ ID NO: 1235

SEQ ID NO: 27532 - protein, 148 aa, Arabidopsis thaliana
MPERIKEKLMKRPVTGKDLMIVNMGPHHPSMHGVLRLIVTLDGEDVVDCEPILGYLHRGMEKIAENRAIIQYLPYVTRWDYLATMFTEAITVNGPEQLGNIQVPKRASYIRVIMLELSRIASHLLWLGPFMADIGAQTPFFYIFRERE

SEQ ID NO: 27533 - protein, 517 aa, Candida albicans SC5314
MNSTEVDNLPFQQQLTSFVELAVAKATGSPITTLFTIIFLILSYDQLSYQINKGSIAGPRFKFYPIIGPFLESLDPKFEEYKAKWDSGELSCVSIFHKFVVIASSRDLARKILSSPKYVKPCVVDVAIKILRPTNWVFLDGKQHTDYRRSLNGLFSSKALEIYIPVQEKYMDIYLERFCKYDGPREFFPEFRELLCALSLRTFCGDYITEDQIALVADNYYRVTAALELVNFPIIIPYTKTWYGKKIADDTMKIFENCAAMAKKHINENNGTPKCVMDEWIHLMKEAREKHSEDPDSKLLVREFSNREISEAIFTFLFASQDASSSLACWLFQIVADRPDIVAKIREEQLRVRNNNPDVRLSLDLINEMTYTNNVVKESLRYRPPVLMVPYVVKKSFPVTESYTAPKGAMIIPTLYPALHDPEVYDEPDSFIPERWENASGDMYKRNWLVFGTGPHVCLGKNYVLMLFTGMLGKFVMNSDMIHHKTDLSEEIKVFATIFPKDDLILEWKKRDPLKSL

SEQ ID NO: 27534 - protein, 528 aa, Prochlorococcus marinus str. NATL2A
MASMISAEKRNPAIVILDFGSQYSELIARRIRETEVYSLVMSYTTSADQLRSLKPKGIILSGGPGSVYEEGAPYCDPEIFNLGIPVLGVCYGMQLMVHELGGSVKPAAGKAEYGKAPLEVDDPTALLTNVISGSTMWMSHGDSVQKLPKGFVRLAHTSNTLEAAIALHDKSFYGVQFHPEVVHSTHGMVVIRNFVYDICSCEPDWTTNLFIDEAVSQVQQHVGDKKVLLALSGGVDSSTLAFLLNKAIGPQLTCMFIDQGFMRKGEPEFLMSFFDEKFKINVEYINARERFISQLKGVTDPEQKRKIIGREFIRVFEEESLRLGPFDYLAQGTLYPDVIESSGTNIDPKTGERIAVKIKSHHNVGGLPKDLQFKLVEPLRRLFKDEVRKVGKSLGLPDEIVRRHPFPGPGLAIRILGEVTHEKLNCLRDADLIVREEINNAGLYNKIWQAFAVLLPVYSVGVMGDQRTYAWPIVVRCVSSEDGMTADWSRLPYAVLEKISNRIVNEVEGVNRVVLDITSKPPGTIEWE

SEQ ID NO: 27535 - protein, 136 aa, Glycine max
  misc_feature (83)..(83): Xaa can be any naturally occurring amino acid
  unsure (1)..(136): unsure at all Xaa locations
MAEVLYWISTFVLILTLLCILGYQLILLVDLEFDYINPYDSTSQINQVVLPEFIIHGIFCFTNLIAGHWFIFLISLPFLYYNXRLYIKREHLADVTEIYNKLNWEKKKRLFKVAYLVLVFAFCIVSLVWTLTEDVH

SEQ ID NO: 27536 - protein, 431 aa, Rickettsia conorii str. Malish 7
MTNTRSKIKTPRSPYVKKYNSWRVRILYSIIIGYATFYFCRQNFNIATPAIREYFGVTKTQIGWILTASSIMYGVSKACNGFISDKVNARIFMVLGLLFVGIITMLIGFSDSLWLIGILWIASNWFQSMGWPPATKMLTHWFASKELGTKWAMGATSNQIGGALAMISCGYLIDKFDWRAAFFVPGVVACVVSLFLYNRLRNSPKEVGLSTVEEYKEYPLEAIGDYEKLLTPQLLKMVFCNKLIWYVCLANMFVYIIRSGVIYWAPTFLKDLRNISLANAGLQIGLYEMIGIPGALIAGVLSDKLFQGRRGPVASICMVLLSLLLVLFWKLPIHSELLSIVILSLIGFFVSGPQLLVGIAAADFSTRQAVGTANGLSGLFGYLGAAIAGVGVGWISDNYGWNGVFIFFSISALLGGGLFALIWNRSAKKYI

SEQ ID NO: 27537 - protein, 140 aa, Rickettsia conorii str. Malish 7
MTIQYTFSMIKPDAIKRNKIGQVNTYLENAGLKIVAQKMKFLTKYEAACFYDEHRARPFFNSLVEYITSGAVVLQVLKGEDAITLNRTVMGATNPAEAEAGTIRKDLGESIEANSIHGSDSENSAKREIEFFFNKSEIIE

SEQ ID NO: 27538 - protein, 413 aa, Mycoplasma gallisepticum R
MINYNKKTLKDVDLKDKTVIVRVDFNVPIKDNKVIDDTRIVQALDTIKYLIEQNCKIVLLSHLSRIKSLEDISSKKKSLRPVYENLKTKLNNVKFLEENVGYDVVEAVKQLKHQEVLLLENTRYNDVDNQGEVVKKESKNSPELGRFWASLADVFVNDAFGTSHRAHASNVGIAANISQSCIGFLVQKELEALSKLTNNPQRPFVVILGGAKVSDKLKVIESLLKSADQILIGGGMVNTFNKAKGYHIGKSLFEPEMLETAKKILAEDKDNKIILATDQMVTKASTITDIKTAPAGKCVFAKDEAENEDFEALDIGDESIKTFKSYIAKAKSIFWNGPLGVFENPNYERGSYEIAKAISESDSYSVIGGGDSAAAANQFKLADKFSFVSTGGGASLTFMEQTVLPGIEAIQSK

SEQ ID NO: 27539 - protein, 296 aa, Pennisetum glaucum
IIESVGEGVTDVAPGDHVLPVFTGECKECPHCKSAESNMCDLLRINTVRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 27540 - protein, 452 aa, Ashbya gossypii ATCC 10895
MYSKEDWGGKIEPYIEVNMQKLEGKALVAVFGFQDFRKLGYQDHGELRMVCTQEAVNAQRCTAEELGQLLVRKKVYNPETGQNETLRSEVKSMRVEKEGVLEPRYPVKETGFYCVFVYAPDVKYAGEVTFQNAFGHLPASDVNNLMLYGLLAVAYAIAMALYMFAVWKHKHELLLLQKYILAFFLFLTLETILVWSAYDLVNRKGVTAGTITYNVFISIINAGKVSMSCFLILIVALGYGVVYPKLNRKLMRRVQVFTAFNFVTMAAAIIHSSLTRAENVGVSLLLSVFPVLTLIVFYVLIIRSLGSTLGYLREHKQVVKLNAYRKMFMLIIGSIVLNILGVFFSIFSMARRNDDEIISNLWKTKFIMEVWPSFVYFLVFVVFAFMWRPTDTSYMLACSQQLPTDPENVTDFDLDDLQSLNDDASNRRVNDDEINFSDEEGPGSYHPSHQGK

SEQ ID NO: 27541 - protein, 296 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLEAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 27542 - protein, 340 aa, Arabidopsis thaliana
MEKGEDSSTFKMGNSAQERSLPYVPDCYVVPPSSKPCDSNSGIVPTIDVSRLKGGDDERRGIVNHGINQNILDDALEVANSFFELPAKEKKQFMSNDVYAPVRYSTSLKDGLDTIQFWRIFLKHYAHPLHRWIHLWPENPPGYREKMGKFCEEVRKLSIELMGAITESLGLGRDYLSSRMDENGMQVMTVNCYPPCPDPETALGLPPHSDYSCITLLLQNLDGLKIFDPMAHGGSGRWVGVPQVTGVLKVHIGDHVEVLSNGLYKSIVHKVTLNEEKTRISLASLHSLGMDDKMSVPRELVNDENPVRYKESSFNDFLDFLVKNDISQGDRFIDTLRIKD

SEQ ID NO: 27543 - protein, 296 aa, Pennisetum glaucum
IIESVGEGVTDVAPGNHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 27544 - protein, 296 aa, Pennisetum glaucum
IIESVGEGVTDVAPGNHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVWLGCRCAGGCATQGCRVQDSPNELPEREDPEGNLLWQLQATHWPAQCGGAVYEEVEKFITHSVPFSEINKAFDLMAKGGGH

SEQ ID NO: 27545 - protein, 151 aa, Brassica napus
  misc_feature (6)..(6): Xaa can be any naturally occurring amino acid
  misc_feature (12)..(12): Xaa can be any naturally occurring amino acid
  misc_feature (16)..(16): Xaa can be any naturally occurring amino acid
  misc_feature (19)..(19): Xaa can be any naturally occurring amino acid
  misc_feature (21)..(21): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(32): Xaa can be any naturally occurring amino acid
  misc_feature (38)..(38): Xaa can be any naturally occurring amino acid
  misc_feature (55)..(55): Xaa can be any naturally occurring amino acid
  misc_feature (58)..(58): Xaa can be any naturally occurring amino acid
  misc_feature (68)..(68): Xaa can be any naturally occurring amino acid
  misc_feature (77)..(77): Xaa can be any naturally occurring amino acid
  misc_feature (80)..(80): Xaa can be any naturally occurring amino acid
  misc_feature (85)..(85): Xaa can be any naturally occurring amino acid
  misc_feature (87)..(87): Xaa can be any naturally occurring amino acid
  misc_feature (92)..(93): Xaa can be any naturally occurring amino acid
  misc_feature (97)..(97): Xaa can be any naturally occurring amino acid
  misc_feature (102)..(102): Xaa can be any naturally occurring amino acid
  misc_feature (104)..(104): Xaa can be any naturally occurring amino acid
  misc_feature (106)..(106): Xaa can be any naturally occurring amino acid
  misc_feature (108)..(109): Xaa can be any naturally occurring amino acid
  misc_feature (115)..(115): Xaa can be any naturally occurring amino acid
  misc_feature (125)..(126): Xaa can be any naturally occurring amino acid
  misc_feature (130)..(130): Xaa can be any naturally occurring amino acid
  misc_feature (135)..(135): Xaa can be any naturally occurring amino acid
  misc_feature (142)..(143): Xaa can be any naturally occurring amino acid
  misc_feature (146)..(146): Xaa can be any naturally occurring amino acid
  unsure (1)..(151): unsure at all Xaa locations
MASSMXSSAAVXTSPXQAXMXAPFXGLXSSAXFPVTRXANNDITSIASNGGRVSXMKXWPPVGKKKFXTLSYLPDLXEVXLGKEXYXLLRNXXIPCXEFELXHXFXYXXHGTTPXYYDGRYWTMXXLPLXFGCTXSAQVLKXXQEXKRSTL

SEQ ID NO: 27546 - protein, 140 aa, Arabidopsis thaliana
MCVSVTISRGQKDSIPPTPTSGFDNPRTTVVIYNDLGGHLPLRYHCKSKNDDLGDRNMAVNGTWSFEFRPSVFGGTLFFCGFIWDKELHWFDIYKQSRDREFAEFGCRRCEWKIRKDGPCKLNKNSNMFDVCLPWNSQSL

SEQ ID NO: 27547 - protein, 222 aa, Brassica napus
MTLSKRSHLMIRKLSEMLVPGRRSATKPEDSSASPRSPLDMKFPSPVNSKRYSSGGIGLGIVAALEDGNIGSNRYDPVCYSGRFRCPEIDLSDEEYTYVTSPGEPTKVYYSDDGFELFENGSEYDDRRKNKPLVEPPVIKSQNCRDATEFLSSCYLCKKRLQGKDIYMYKGEMGFCSAECRSVQIMQDEQNEKCKSRVSGNVDVLSSPCAGEQSFSAGIFIF

SEQ ID NO: 27548 - protein, 482 aa, Vibrio angustum S14
MTFSFGGLFKQQAFINGQWSDAFSGKTVNITNPATNEVIGHVPLMGVEETNIAIDAADKAYRLWSKTTAKHRSLILRQWYELIVSHSDELAHILTAEQGKPLAEAKGEIAYAASFVEWYAEEAKRLNGEIIPSHKEDARILVSRQPVGVVAAITPWNFPAAMITRKCGPAFAAGCSVVLKPAPDTPYTAFALAELAHRAGIPAGLFNVITGDAVKIGAELMSNKRVRKVSFTGSTAIGKLLMAQSAATVKKVSLELGGNAPFIVFDDADLSRAIDGVMVSKFRNAGQTCVCTNRIYVHSDVYQQFVEKLAEKVSALTVGNGVDNGVTIGPLINRAAVEKVEKHINDAMMKGANLVIGTREASTNCFVQPTVLSNVTDNMLVASEETFGPLAAVFKFTDEQDVITRANNTDSGLAAYVYTQSLSRAFRVSEALEYGMVGVNEGLISTELAPFGGVKESGIGREGAHQGLEEYTEMKYTLMGGL

SEQ ID NO: 27549 - protein, 410 aa, Zea mays
  misc_feature (115)..(115): Xaa can be any naturally occurring amino acid
  unsure (1)..(410): unsure at all Xaa locations
MAKPEGPTIGVKLFVDKEKKKVLFAESDKEFVDVLFSFLTMPLGTIVRLLDKQSQMGCLDQLYKSVEDLNLEYFQTSACKAMLLKPLNAASGHCCRPQDQQDGVFVIGCLKFIVXDDLQVAPASTSLMMSFFEKFGVLDPAVLEQQVLQFSSEKIKCLLKRLLTSKQPLTDHYFEALVPQDDASLEALVQNLHPKQENEDQEMPGNQKIRVLQTKDNSALLYDEVGVDFVDSLFGLLSIPLGSAIKLYCQCSAKGCLGNAYRSIDGSVKEFVREECQSLLLDPKVPPFFGCCASKILQVDELAPRELTMEACFVCFKSLWFSGCNRSHEFAYSLRCNEVFCANKVKSIKLCEANPKRQNGGSGQTNFVVKEIKLKVMELQRAVLVLSRNILSSVLLHPKKTKKLHHYRRM

SEQ ID NO: 27550 - protein, 354 aa, Bacillus subtilis subsp. subtilis str. 168
MTMKQFEIAAIPGDGVGKEVVAAAEKVLHTAAEVHGGLSFSFTAFPWSCDYYLEHGKMMPEDGIHTLTQFEAVFLGAVGNPKLVPDHISLWGLLLKIRRELELSINMRPAKQMAGITSPLLHPNDFDFVVIRENSEGEYSEVGGRIHRGDDEIAIQNAVFTRKATERVMRFAFELAKKRRSHVTSATKSNGIYHAMPFWDEVFQQTAADYSGIETSSQHIDALAAFFVTRPETFDVIVASKLFGDILTDISSSLMESIGIAPPANINPSGKYPSMFEPVHGSAPDIAGQGLANPIGQIWTAKLMLDHFGEEELGAKILDVMEQVTADGIKTRDIGGQSTTAEVTDEICSRLRKL

SEQ ID NO: 27551 - protein, 151 aa, Prochlorococcus marinus str. NATL2A
MTLERTFVAIKPDGVQRGLIAEILGRFETKGFKLVGLKQLTPSKELAEKHYGVHKDRPFFSGLVDFITSGPVIAMVWEGEGVIASARKLIGATKPLEAEPGTIRGDLAVNIGRNVIHGSDGSDTAVFEINLWFQENELVDWNPSDQAWRVE

SEQ ID NO: 27552 - protein, 515 aa, Ashbya gossypii ATCC 10895
MDAIGFGEQAGWLWRALAALWAWRVLAALVLVLVADQAAYRRNKGRIAGPAWKMWPLIGPFLESLDPKFEVYQAKWASGPLSCVSIFHKFVVIASTRDLTRKILQSPKYVKPCLVDVAKKILRPTNWVFLDGQAHLDYRRSLNGLFTRDALARYLPSQEAVIDRYMAKFVAFSRETDYEHRVFFHEMREMLCALSLKAFCGSYITDDQVRKIADDYYLVTAALELVNFPLILPFTKTWYGKRTADMAMKIFERCAQEAKQHIAAGGEPTCVVDAWCKLMLDAKAKDDADSRLLHRKFTNREMSEALFTFLFASQDASSSLACWLFQIVADRPDVLAKIREEQLAVRRNDPSVPLSLELIDQMKYTHMAVKECLRYRPPVLMVPYQVHEAFAVSADYTAPKGSMLVATMYPALHDPAVYENPDDYIPERWDGEQSPANQAKKNWLVFGSGPHVCLGQKYVFMTFTALIGKFALFTEFDHKVTSLSEKIKVFATIFPQDDLLMSFKKRDPLTGQTTE

SEQ ID NO: 27553 - protein, 144 aa, Brassica napus
  misc_feature (135)..(135): Xaa can be any naturally occurring amino acid
  misc_feature (139)..(139): Xaa can be any naturally occurring amino acid
  unsure (1)..(144): unsure at all Xaa locations
MAASNSEKGLIVSFGEMLIDFVPTESGVSLAEAPGFLKAPGGAPANVAIAVSRLGGRSAFVGKLGDDEFGHMLAGILKENGVADQGINFDTGARTALAFVTLRADGDREFMFYRNPSADMLLRPDELDLDLIRSXAKVXHYGSI

SEQ ID NO: 27554 - protein, 529 aa, Kluyveromyces lactis NRRL Y-1140
MSVPIFGDQVTEERAENARMSAFVGAIAVGDLVKTTLGPKGMDKLLQSASNNTSMVTNDGATILKSIPLDNPAAKVLVNISKVQDDEVGDGTTSVTVLSAELLREAEKLVEQGKIHPQTIIEGFRIASAAALSALEKAAVDNSNNKEEFYNDLISIANTTLSSKILSQDKDHFSKLATDAILRLKGSTNLEHIQIIKIIGGKLSDSFLDEGFILPKRFGSNQPKRVENAKILIANTSLDTDKVKIFGTKFKVDSTSKLAELEKAEREKMKKKIEKIANFNINTFINRQLIYDYPEQMFTDLGINSIEHADFEGVERLALVTGGEVVSTFDNPEKCKLGECKLIEEIIIGEETFTKFSGCKSGEACTIVLRGATEQVLDEAERSLHDALSVLSQTTKETRTVLGGGCAEMIMSKAVDTVGQNVEGKKALAVESFAKALRQLPTILADNAGFDSSELITKLRSSIYNGMSTSGLDLDNGTIADMRELGIVESYKLKRAVVTSASEAAEVLLRVDNIIRAKPRTADRQHGHM

SEQ ID NO: 27555 - protein, 521 aa, Xanthomonas axonopodis pv. citri str. 306
MTNIHTDKILILDFGAQYTQLIARRIREIGVYCEIWAWDHDPSEIAGFGAKGIILSGGPESTTLPGAPVAPQEVFDSGLPVFGICYGMQTLAAQLGGATEAADQREFGHAEVDVVAADALFAGLTDHAGASRLNVWMSHGDHVSQVPPGFTITATTDRIPVAAMSNEAKRWYGVQFHPEVTHTLQGQTLLRRFVVDVCGCQTLWTAANIIEDQIARVREQVGDDEVILGLSGGVDSSVVAALLHKAIGDKLTCVFVDTGLLRWQEGDQVMAMFAEHMGVKVIRVNAADRYFAKLEGVRDPEAKRKIIGNLFVEIFDEESNKLANAKWLAQGTIYPDVIESAGSKTGKAHVIKSHHNVGGLPEHMKLGLVEPLRELFKDEVRRLGVELGLPRTMVYRHPFPGPGLGVRILGEVKREYAELLAKADAIFIDELRKADLYDTTSQAFAVFLPVKSVGVVGDARAYEWVIALRAVETIDFMTAHWAHLPYDFLGTVSNRIINELRGVSRVVYDISGKPPATIEWE

SEQ ID NO: 27556 - protein, 401 aa, Wolinella succinogenes DSM 1740
MDFSSLASRYGTPLYVYDFDQIKSQFLQLKEAFAGRKSLIAYAIKANSNLSVIQHLGKLESGADCVSIGEVKRALKAGIPPYKIIFSGVGKRDEEILEALSLEILMINVESEAELLRVESLAKSLGKVARISIRVNPDIDPKTHPYISTGLSENKFGVDIESAKRLYILCAKSESLHPVGIHFHIGSQLTELEPLLESAKKVADLTRSLLALKIEIKFFDVGGGLGIRYKDETPINLYDYAQGILAALHGLDVTIVCEPGRFIVGNAGCFLTRVLYEKQNEKKRFVIVDGAMNDLLRPSLYKAYHEAFAPKGGESFSEADIVGPVCESGDWLAKGVMLPPLEHGDLIVIKSAGAYGFSMSSQYNSRARAAEVALEGGESRLIRAREEIESLWQNELELLQN

SEQ ID NO: 27557 - protein, 563 aa, Rhodobacter sphaeroides 2.4.1
MVGPATGRIVVTSRIVVLGGGFGGMYAARALKRRLGRAAEIELVNAENYFVFQPLLPEVGAGSITPAHAVSPLRFLLRDVFVRKATVDSVDFDRRLVTVFQGVQRRPTEIGYDHLVIALGQAADLSKMPGLEEHALTMRTLEDARRLRAHVIGQLEHAQITRLPEVKRGALTFCVVGGGFSGIETAGEMKDLIDRSLKFYPDIDPSEVRMIVVEFADRILGEMSQGLADYATRTLRERGIEVKLGTGVASATGTQLVTTTGEVIDTRTIVATIGNAPSPVVRRMGLPSERGRISVDRTLAVKGRSDVWALGDCALIALKDAPQGPRDYAPPTAQFAVREAEQLAENIASTLTGGTPQPFDYRSKGALASLGARKGVAQVFGLELKGFPAWLLWRFYYLAFLPGLTTRIFVLLNWFMDGISPRSVVQLHTRSVPPTRYVRYRAGDVIYEAGNRSDGFYTVVTGAVEMTRTDPETGLPQVRTIGPGGHFGERLILGATRRQTSVRAAEDTKVLVMDREEFLKLADSFQAFRDYFGPYMARHGMTWPPLGETDGQAAPKPVPTEKD

SEQ ID NO: 27558 - protein, 378 aa, Arabidopsis thaliana
MTKMSNLPNDLAEEVLSRVSLTSLRNVRLTCKDWNTLSKGESFAKNHLGYQAIVAAKEKEFMMVLMMDFRVYLIRVNVHNDIESCIKPEGELISLGDEVDVSQVFHCDGLLLCITEDNEDNAKVVLWNPYWGQTRWIESTNNFHKLDMYTYALGYKKSSKSSRSYKILRFIDFSPTCSEFKIYNINSDSWKVLDVSPDWKIDSYIRGVSLKGNTYWIARERHGYGHTFLVCFDFTRERFRSRLPLPSQPCVLDTVSLSSVREEQLAVLFQCSSTLEMQIWVTTKIEPNAVLWNSKVFLAVDMHSLKFQFQVRASSFFIDEEKRVVVVFDKEKRYLASSRNKAYIVGVDGTWEQVDLGMSVDKFVYPLVCSYVPSLVHF

SEQ ID NO: 27559 - protein, 554 aa, Corynebacterium glutamicum
MAHERAGQLAQPEDLIDVAELVTAYFTRKPDVNNPDQQVAFGTSGHRGSALDSAFNEDHILATTQAIVDYRNQQPKNWVGPLFIGRDTHALSEPAMISALEVLIANDVEVLVDADGRYTPTPAVSHAILRHNDGIILGAAGPSRPYADGIVITPSHNPPRDGGFKYNPANGGPADTDATDWIANRANDILRGGLADVKRVPVSGVLDERTTAYDFKGIYIADLPNVVNIDAIREAGVRIGADPMGGASVDYWGAIAETHGLNLTVVNPHVDSTFRFMTLDTDGKIRMDCSSPHAMASLIENRDKFDVATGNDADADRHGIVTPDAGLMNPNHYLAVAIEYLFAHRPGWSADTAVGKTLVSSSMIDRVVAQLGRTLVEVPVGFKWFVPGLISGEIGFGGEESAGASFLRMDGTTWSTDKDGIILDLLAAEIIAVTGKTPSQRYAELAEEFGAPGYARTDAEANREQKAILKALSPEQVTATELAGEAITAKLTEAPGNGAAIGGLKVTTENAWFAARPSGTEDKYKIYAESFKGVEHLAQVQKEAQALVSEVLGQ

SEQ ID NO: 27560 - protein, 379 aa, Triticum aestivum
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 27561 - protein, 300 aa, Corynebacterium glutamicum
MLADRRVQLYDDEDIDRILLRGGTILGTGRLHPDKFKAGIDQIKANLEDAGIDALIPIGGEGTLKGAKWLSDNGIPVVGVPKTIDNDVNGTDFTFGFDTAVAVATDAVDRLHTTAESHNRVMIVEVMGRHVGWIALHAGMAGGAHYTVIPEVPFDIAEICKAMERRFQMGEKYGIIVVAEGALPREGTMELREGHIDQFGHKTFTGIGQQIADEIHARLGHDVRTTVLGHIQRGGTPTAFDRVLATRYGVRAARACHEGSFDKVVALKGERIEMITFEDAVGTLKEVPFERWVTAQAMFG

SEQ ID NO: 27562 - protein, 401 aa, Oryza sativa (japonica cultivar-group)
MAVECARNALLERTMDNKENIDKFRSDLMNIAMTTLSSKILSQDKEYFAELAVDAVLRLKGSTNLEAIQILKIPGGSLKDSFLDEGFILDKKIGLGQPKRIENAKILVANTAMDTDKVKIYGARVRVDSMAKVAEIEAAEKQKMREKVQKIIGHGINCFVNRQLIYNFPEELFADAGILAIEHADFEGIERLALVTGGDIASTFDNPESVKLGHCNVIEEIMIGEDKLIHFSGVAMGQACTIVLRGASEHVLDEAERSLHDALCVLSQTVNDTRVLFGGGWPEMVMAKAVDDLARKTPGKKSHAIDAFSRALQAIPTIIADNAGLDSAELISQLRAEHHKENCTAGIDVITGSVGDMQKRGISEAFKVKQAILLSATEAAEMILRVDEIITCAPRRREDRM

SEQ ID NO: 27563 - protein, 715 aa, Zea mays
MKLRTLSITRCAPSPLGCVGMGGGRRRTVLVALRRDAAGRELLTWALVKAAAAGDRVVALHVSTVAADGEMAAAEEDRTRASDSLASVLGAYRGFCERNQIDLELKLCEGPSIKKALVAEATSCAAAHLVLGVTRSSRPSGSSATATAVARYCAKRVPPSCMVTAVSNGAVVYRRDPVQHHHQLLLSPYSAVVETPRRLYRKILDARTAAGDKSQDDMAIGDVGRSARRNMSQAMSALVSPRVTLAPGTVRSSCHGQESSSSPKVSAGWPLLKKDSMPALPELSEVSVVEWAMQLPTRCCSDQRSDEKQVPEELASLRDKYSSKYTVFRHSDLAKITNGFSPDRLVGKGGAGRVYRGCTEGGKELAVKVLKPSEDVVKDFASEVDVLSSVEHENAMSLVGFCVDGGRDRLMLVYDYMPRGSLEEALHGHGGGVQAPGKGGGGVALGWPERCKVAAGVARALEYLHGDGGEGHRRPMIHRDVKSSNILVAADFEPKLCDFGLAIWADDAAAQVTGDDVAGTFGYLAPEYFMHGKVSEKMDVYAFGVVLLELVSGRKPVSAGGPRGKGSLVMWANSVIQGGKVMDLVDPNLPLPATGGDGGEVERMALAAALCIRRAHQHRPTMSNVVKLLAGDGDAVAWAKSQVGVPGDNDIDGRRHGCGAATSPEEKGGDIQSYINLALRDIVDDDDNDASSVGSAVSLEEYLRGRWSRSSSFEG

SEQ ID NO: 27564 - protein, 540 aa, Corynebacterium glutamicum
MADISTTQAWQDLTDHYSNFQATTLRELFKEENRAEKYTFSAAGLHVDLSKNLLDDATLTKLLALTEESGLRERIDAMFAGEHLNNTEDRAVLHTALRLPAEADLSVDGQDVAADVHEVLGRMRDFATALRSGNWLGYTGHTIKKIVNIGIGGSDLGPAMATKALRAYATAGISAEFVSNVDPADLVSVLEDLDAESTLFVVASKTFTTQETLSNARAARAWLVEKLGEEAVAKHFVAVSTNAEKVAEFGIDTDNMFGFWDWVGGRYSVDSAVGLSLMAVIGPRDFMRFLGGFHAMDEHFRTTKFEENVPILMALLGVWYSDFYGAETHAVLPYSEDLSRFAAYLQQLTMESNGKSVHRDGSPVSTGTGEIYWGEPGTNGQHAFFQLIHQGTRLVPADFIGFARPKQDLPAGERTMHDLLMSNFFAQTKVLAFGKNAEEIAAEGVAPELVNHKVMPGNRPTTTILAEELTPSILGALIALYEHIVMVQGVIWDINSFDQWGVELGKQQANDLAPAVSGEEDVDSGDSSTDSLIKWYRANR

SEQ ID NO: 27565 - protein, 140 aa, Synechococcus sp. CC9605
MIETSQDSLFEQAMARYQAGAAAEEVLPDFARLVEAAPRQSAGWTCLAWLQLLCDQPEEALRSARFAVRLNGQDPQARINLSLALLETQSKGVRDHIQVVQQVMTLAPEVSSELKASITDGLERKPGWKALEKVKAWLEL

SEQ ID NO: 27566 - protein, 227 aa, Triticum turgidum subsp. durum
MEFQGQHDNPANRVDEYGNPFPLAGGVGGAHAAPGTGGQFQAHRGEHKTGGILHRSGSSSSSSSSEDDGMGGRRKKGMKEKIKEKLPGGHGDQQHTGGTYRQQGTGMVGTGGTYGQKGHTGMTGTGGTYGQQGHTGMTGTGGTYGQQGHTGMTGTGGTYGQQGHTGMAGTGAHGTTATGGTYGQPGHTGMTGTGAHGTGGTYGQHGTDTGEKKGIMDKIKEKLPGQH

SEQ ID NO: 27567 - protein, 316 aa, Methylobacillus flagellatus KT
MANLFDQLKEFTTIVADTGDVEAIKSVKPYDATTNPSLLLKASTIPQYAPLIDEAIAYAKSQSGDKAQQIEDAADKLAVLIGLEILKHIPGKISTEVDARLSFDTEAMVQKGRKLIKLYEDAGIAKDRVLIKLASTWEGIKAGEILEKEGINCNLTLLFSFAQARACAEAGVFLISPFVGRILDWYKAKTGETYTAETDPGVQSVRKIYAYYKEHGYKTVVMGASFRNTGEIIALAGCDRLTVSPNLLEELKATEGKLERVLVDNGVTKQRPPLLTEKEFRFDLNEDAMATEKLAEGIRGFVVDQNKLEKALAEKL

SEQ ID NO: 27568 - protein, 389 aa, Methanosarcina acetivorans C2A
MTFPMYSDRINALPPYLFAAIDEAKDEMIAKGVDVIDLGVGDPDLPTHPHIVEAMREAVCDPKTHQYPSYAGMPEFREAAAEWCKKYKGIELDPATEVLSLIGSKEAVAHIPLAFVNPGDVVLYTDPGYPVYKIGTLFAGGEPYSLPLKAENSFLPDLDSIPADILKRAKLFFFNYPNNPTSATADMKFFEKVVEFCKKNDIIAVHDNAYSQMVYDGYDAPSFLAAEGAMDIGIELYSHSKTYNMTGWRLGFAVGSKALIKGLGKVKSNVDSGVFDAIQIAGIAALSSSQACVDDTNKIYEERRNVLIEGLTAMGLEVKPPKATFYVWAPVPTGFTSIEFAKLLLEEAGIVATPGVGFGDAGEGYVRFALTKPVERIKEAVERMKKLQF

SEQ ID NO: 27569 - protein, 468 aa, Bartonella henselae
MSYDVVVIGAGPGGYVAAIKAAQLGLKTAIIEKRMTLGGTCLNVGCIPSKALLHASEVFAETQHGFETLGISIAKSKLNLEQMMAHKKAVVTANTSGVSFLMKKNKIDTFFGTAKILNAGQIEVVARDGNKQTIETKNIIIATGSESSGIPGVNVEIDEKVIVSSTGALALEKVPTRMIVVGAGVIGSELGSVWSRLGAKVTIIEYLNKVLGSMDGEVSRQFQKIMEKQGIEFKIGAKVTAITQSGSVAQVTFEAVKGGPSETLEADVVLIATGRFPYTEGLGLEEAGVQLDERGFITIDAHWQTNIPGVYAIGDVVKGPMLAHKAEEEGVAVAEILAGQKGHVNFDVIPSVVYTQPEIASVGKTEEELKAAGIDYNVGKFPFMANGRARAMQKSDGFVKILADKKTDRVLGGHILGFGAGEMIHEIAVLMEFGGSSEDLGRCCHAHPTLSEAVREAALATFAKPLHI

SEQ ID NO: 27570 - protein, 1008 aa, Ashbya gossypii ATCC 10895
MRTALLLSLGLVAAVDPSPVNEEVSLEERFEDVSTYDFDLDSISYLSHIAVEKAVDWLESHDISSISECFEYYNEHRLDPGTLEIAVSTGHEWYKSADFFRQGIDLVAELMEKSRDSQKLQWWKHGLVQSLIRLGTVDLFEELLRDNFGVHFEKLADIYKDMQVQLHSIDVVGGVVDAPHGNSLRAPKEFPWGGPNQGSGSSQGDSPSSPWDLPKEPPTVRSKAPAGNGEKTEGNPLDYANPKKATAEFNFPKFKKPKEDEKKDGDKKDDKKDDKSDNKDDKKDDKSDSNDDKKDDKSGKKDDKPDNKPDNKDDNKPDKKGDNKPDKKGDNKPDKKDDKSDNNDAKKDGKKGEKSDRKDENKDDNSDKKDDKKDGKSDRKDENKDDNSDQKDGKKDGKSDNKDEKSDDKSDNKDEKNDKSDKKDGNDDKKDEKNDKSDKKDGNDDKKDDEKDCDKKDGDQKDDKHDDKHDDKHDDKHDDKHDDKHDDKKKNKDKNDSDKKKKGGKHDEKHDDEKKDEDKHEDEKEEKKEDKSDKKEDKRDDKSDKKEDKRDDKSDKKEDKRDDEEDERENKPDRKEDKRIDKSGKKGDKSDKDVKSDEKDKNECGRFRKCRPIEKPDESKETNPKDDNSKGKKQEDQKSKDGKNKDGKPSDDDKTEEKPDKSKGWTKPCDRWKKNKPKDGDNSGKPKEQNPNDEKDKDSGKKGDEKSKPCDEPKVQPIEDEKDDKNSKGPKDSKDSKDSKDSINAVKATALPRGKPLRDPALADRLKNAHLRSSALPKSQILDPKFPVEPTQKPVPSASLVPKESLVVLPKPPATLVSPAEPPSSTAQPLETSEPAKPAEQAPRSTHKMSSIFIPRFKGFSKFLHAPNQAVLNGQEAPPAAPEPAPEAAPEAAPEAGNPDADPAASASPVDGTQASSIVRYTRTAAAGSSAASSDLSDAASTLLARRPGYVTFDGTFPTGKRLEKYYSNHTNGSSFIIDTNVSNVATNLHPWSFVGAVIVLVSSALLF

SEQ ID NO: 27571 - protein, 385 aa, Frankia sp. EAN1pec
MTATTAESGNLLPLVSGRSRPPRHLADLSRDERRAVATSLGLPAFRADQLARHYFTHHLRADDADLMTDLPASIRPALVEAMLPRLLTPATALDCDGGQTRKTVWRTVDGAKIESVLMRYPQRATVCVSSQAGCGMGCPFCATGQGGLTRNLSTAEIVEQVVDAARTMAARTTAEGGLPGGPGRLSNVVFMGMGEPLANYAALLAALHRLIDPAPDGLGLSARGLTVSTVGLVPAIRRLAGEGLPVTLAVSLHAPDDELRDELVPINTRWPVAEVLAAAWEYARVTGRRVSIEYALIDGVNDSPERADALAALLVGQLAHVNLIPLNPTGGSSWQASAPRGQRVFVERLRARGVAATVRDTRGREIAAACGQLAAEPPVRSRAGR

SEQ ID NO: 27572 - protein, 500 aa, Medicago truncatula
MSSFFSSFTSSLSETNLATAKTILTTAASIAGTAMLIRSVANEFLPMDIRDIVFTGIKSAYCRFSTNVTMVIEEFEGLDNNQIYSAAETYLGTIVSPSTKRFRISKSDHQQTFTLTMERDQLVTDYFNGVKLKWILFSRRVENLRNNRDLTVPMKSEVRSLELTFNRKYKEMVLKSYIPFILEKARSKKQEVKALKIFTIDIQNLYGNLNDAWLGTTLDHPTTFDTLALDRDLKEFVMEDLERFVKRKEYYRQVGKAWKRGYLLYGPPGTGKSSLVAAMANYLHFDIYDLELGELSSNAELRRLLIAMPNRSIVVVEDIDCTVEFQDRSSQSKSGRCNDKQVTLSGLLNFIDGLWSSCGDERIIVFTTNHKEKLDPALLRPGRMDVHIHMSYCTPFGFRQLAFRYLGIKEHTLFGEIEETIQQTPVTPAEVAEQLLKGSETETTLKGLSDFLTKKRVTRELEAKKREQEEQHRDQLVDDSDFEGENVRHFGPQNCNGRAI

SEQ ID NO: 27573 - protein, 280 aa, Synechocystis sp. PCC 6803
MTPSAASHAIDTLIEMAHQGEINPWDVSVIDVIDRFLQDLGILNSLDLNFQQQNLPRSGQAFLWASMLVRYKADSLHNLEQEPEEVLPEAELEEWPDGLIARLPRDLENRLRRRTAVPPLQRRRVTLAELIDQIEAIAVEIEKSEQKPKRVKRARPQSRREALQIITELAHQENLTELASQLEQFLQTRLPEILPDLPHRSWVDLDTLLHCWHHHLDPDKLPDKKDKVGVFWALLLLSSQSKVSLAQEEFYQDLQVQIIDDSEKNIQLTLDPETEVLNSA

SEQ ID NO: 27574 - protein, 449 aa, Pseudomonas putida KT2440
MSTMIESVDNFLARLKQRDPGQPEFHQAVEEVLRTLWPFLEANPHYLQSGILERMVEPERAVLFRVSWVDDQGKVQVNRGYRIQMSSAIGPYKGGLRFHPSVNLSVLKFLAFEQVFKNSLTSLPMGGGKGGSDFDPKGKSDAEVMRFCQAFMSELYRHIGADCDVPAGDIGVGAREIGFMFGQYKRLANQFTSVLTGKGMTYGGSLIRPEATGYGCVYFAEEMLKRQDKRIDGRRVAVSGSGNVAQYAARKVMDLGGKVISLSDSEGTLYAEAGLTDAQWDALMELKNVKRGRISELAGQFGLEFRKGQTPWSLPCDIALPCATQNELGAEDARTLLRNGCICVAEGANMPTTLEAVDIFLDAGILYAPGKASNAGGVAVSGLEMSQNAMRLLWTAGEVDSKLHNIMQSIHHACVHYGEEADGRINYVKGANIAGFVKVADAMLAQGVV

SEQ ID NO: 27575 - protein, 94 aa, Oryza sativa
  misc_feature (6)..(6): Xaa can be any naturally occurring amino acid
  unsure (1)..(94): unsure at all Xaa locations
VRGAYXGKIVGLVISTEESSPSVVGPESSLHISRWLKETSQTNTTIASSEILVRKSLAWITGIILLVSTLIGVCLLMNMPLTRDTLLYSNVKID

SEQ ID NO: 27576 - protein, 899 aa, Schizosaccharomyces pombe 972h-
MNCEMVTSPESVNLGDSNRAVSPFCLPDCSENAVAQTRSKTLDNAALDLPYVGNRKKSEQDFFKMLSSRDRDAHSTLRKRSNSLSSFLSTKSTSASENKFHGGLNWLSLKLNLLLRLQGRMNSARTNTSMNPYSCDSNENLSTLSSVNQNFNSRQLLATIVPESIQNGCSLLRITKKKVRQRKVSLDPISGYLMLDKNTGKAYKKLCVDDIKEIRQGRDARNYREQYKISSENEKRWFTIIYCADNKLKAMHMISPTLDAHNQWIMALEGLKTYRLNEFIIGLNLVCHQGEKMIDYSENLNPWEKLEKEQSAQLDLGDVHRMCQMLHLNASMEFLEETFQKADADHSGKLSFEEFQHFVSLLKTRSEIVDIFKEYTSGSDKMSLEQFRHFLSTSQKARLDSDSIRTLYVSFCSNDDSKMGLIEFTSFLLSPHNSPVVPVIQDMSRPLNEYLISSSHNTYLLGKQFGGESSIEGYIRSLQRGCKCIEIDCWDGPNGPVVCHGHTFTSMIKFNDVIDAIRKYAFVVSPYPLFISLEIHCCPDQQRQMVSYMKQAFGDTLVMKPVTANESVLPSPEDLLNKILLKVKCSATPLHQFSTDILKVGITDSSTDTTESSELENSELTGLRKGKRRMKNIIVQELQQLAPYARSLKFRNFSLPESKTYSHIFSFSERTIKKHGKAMVPRLSKHNLRYLCRVYPGPLRVGSTNFNPQVYWRLGVQMVALNWQTYDTGLQINDALFIADPPTGYLLKPPCQRIIGTTVGEEGLPRKIKLTIDVISGQQLRRARELSNSETLSPYVEIQVHSMEESPFRWCSKVVHENGFRPFWGETMVYESIISDDFYSMIRFLVHHRGSNGNDSIFANFTCPIDRLQQGYRHIRLLDMQGENLLFSSLFLKIKKEDI

SEQ ID NO: 27577 - protein, 542 aa, Crocosphaera watsonii WH 8501
MRTRCCPVLRNSWIPLSSPLLGYRSSSSAFRMTWLTTLMIISTTISYHTVVYLENETKPTGISDFVCSVFWRHLTMFNRKKIDIPRLQPSWRAIIGEFPPNQSSQSLWHCQGFSLVEGVPKLSKNKRFAVVGDVSLSNTDLLLKRLAINPSRWQEDHQTLIAWGWEELGKDCLHYLRGIFSFVVWDTHEKQGWAIRDRVGGRTLYYYQQDSTFYISPRLKNLSPYFKKNLDLIALRDYLCTGFIPGKRTLWQGVKELRPGTILSLPQEKIETYWTPQENISQSPLSFDKSSEILRELLETIIQEYLPPQEPVGVYLSGGLDSSCVTALAKQFHQETVHTYSIHFGEDYPNELEFSSLVAAHCQTKHHILAISPQEMWENLPITMANLDSPIGDPLTVPNYLLAQLAKQDVKVILNGEGSDPCFGGPKNQPMLLHSLYHNSEQKIDLLSSYLTSFKKCFLDLPNLLNPDIFKQVKDAPSVFEADLLSSADYLNRLMLLNIKFKGSDHILNKVNNLTLSGLLEGRSPLFDSRVVDKIFIHSSSL

SEQ ID NO: 27578 - protein, 343 aa, Crocosphaera watsonii WH 8501
MVSERTLPEFNTVSIQLTKAEGLMLYEDMTLGRLFEDKCAEMYYRGRMFGFVHLYNGQEAVSTGIIKALRPGEDYVSSTYRDHVHALSCGVPPREVMAELFGKETGCSKGRGGSMHLFSEKHRLLGGYAFVAEGIPVATGAAFQSKYRREMMGDDSADQVTACFFGDGASNNGQFFECLNMASLWKLPIIYVVENNKWAIGMAHDRATSEPEIYKKASVFDMVGVEVDGMDVLAVRKVAQEAVDRARAGEGPTLIEALTYRFRGHSLADPDELRSPDEKQFWGNKDPIQRLEAYLIEHNLANQSELDEIKQKVQASVDDAVKFAEESPEPDPKELYRYIFAED

SEQ ID NO: 27579 - protein, 188 aa, Triticum aestivum
  misc_feature (32)..(32): Xaa can be any naturally occurring amino acid
  misc_feature (159)..(159): Xaa can be any naturally occurring amino acid
  unsure (1)..(188): unsure at all Xaa locations
IDEMEEMLTGNRIWRLRCVDIGILSTDDALNXGCSGVMLRGSGIKWDLRKTQPYDSYEDFDFDIPIGSNGDTFDRYLCRVEEMRQSLRIINQCLNNMPPGEIKIDDNKIVPPSRAEMKNSMEAVIHHFKLFSEGYQVPPGATYTAVEAPKGEFGVYLVXDGSSKPYKCKIKAPGFAHWAATDHICSGL

SEQ ID NO: 27580 - protein, 703 aa, Cryptococcus neoformans var. neoformans B-3501A
MAHRTNTRSPSGLNRRPTDRCTSQSGSLQTASSPVQSTFGGRIYAAPEEDRGLIMRDRSERDRGENDWADEKGNSMGKTRGMDVGVTRPKRRLSSLPNLLVPPPLHRAMSSTSVSSPPQSPIGQPGHGSYHSLQQPFHNQKAHGSSTANNFPSYSRSNPPKLDDKVGMVGYATAMAAASREKEGPPSLWGIELKWISLITLALQNAFLTIIMHYSRISTAPNRTYSAAAAVLLNELLKGGISVFIALKRIDNEMTASPPPPVYSEKLDDKDFDKRSGQKLPSIIHPTRLQALSKAVFSPDCYKLSVPAILYVIQNNLQYVAASNLDVATFQVTYQMKILTTAFFSVLLLRKRLSRTKWASLILLAIGVGIVQIQSSSAPAASHHTHVTVSHERQLRSEIPVSDEPIMSPERVMHPVRGFVAVTLACMTSGLAGVYFEFILKSSSGSSAPDLWVRNTQLSLFSLVPALVPIIVNPSGPNGMGYFSKVMSCFDNFNGWAIGTVLTQTFGGLITALVIRYSDNIMKGFATSLSIIISFLASVALFSYPITLSFIVGASIVLFATYTYNSPAPPASSTRKEIAVPGSPISTSAPILGEPEKPSRASSVINLLGLGSNNGSRKPSVSDIKSYASSQLGLSSYPVSASVSAPGTPRTNMNDYAESGRSSPASFGGVQTSHGGSGAGFGRGNVGDKVRPILSLDIDRKHG

SEQ ID NO: 27581 - protein, 654 aa, Arabidopsis thaliana
MGKCSALMIFLSSSLLLVLQTLHVVNAVKCFGNSFNGNSSTFAQNRQKLFPTLADKVIINDGFYNASLGQDPDKVYALVSCARGYDQDACYNCVQSLTQNTLTDCRSRRDSFIWGGNDDVTCLVRSSNQSTFGSVQLKPPVVWPSPDTIESSKNITLFKQQWEEMVNRTLEAATKAEGSSVLKYYKAEKAGFTEFPDVYMLMQCTPDLSSRDCKQCLGDCVMYFRKDYMGRKGGMASLPSCYFRWDLYSFHNAFDNVTRVPAPPPRPHAQEKESCITVKKGKSIGYGGIIAIVVVFTFINLLVFIGFIKVYARRGKLNNVGSAEYSDSDGQFMLRFDLGMIVMATDDFSSENTLGQGGFGTVYKGTFPNGQEVAVKRLTKGSGQGDMEFKNEVSLLTRLQHKNLVKLLGFCNEGDEEILVYEFVPNSSLDHFIFDEDKRSLLTWEVRFRIIEGIARGLLYLHEDSQLKIIHRDLKASNILLDAEMNPKVADFGTARLFDSDETRAETKRIAGTRGYMAPEYLNHGQISAKSDVYSFGVMLLEMISGERNNSFEGEGLAAFAWKRWVEGKPEIIIDPFLIENPRNEIIKLIQIGLLCVQENSTKRPTMSSVIIWLGSETIIIPLPKAPAFTWIRSQSESGAMSLSDDVFTELSCR

SEQ ID NO: 27582 - protein, 199 aa, Triticum aestivum
MSSNLSFVLNKPGDVSFEERPKPSLASPHDVLVAVNYTGICGSDVHYWVHGSIGKFVVEDPMVLGHESAGTVVEVGDKVKTLKAGDRVALEPGYPCRRCQNCLAGKYNLCPDMVFAATPPYHGTLTGFWSAPADFCFKLPDNVSLQEGALIEPLAVAGHIVKQARVKPGDSVVVMGAGPVGLLCAAVAKAYGASKDVSV

SEQ ID NO: 27583 - protein, 236 aa, Cryptococcus neoformans var. neoformans B-3501A
MPFHAEPLKPSEEIDMDLGHSVAAQKFKEIREVLEGNRYWARKVTSEEPEFMAEQVMGQAPNFLWIGCADSRVPEVTIMARKPGDVFVQRNVANQFKPEDDSSQALLNYAIMNVGVTHVMVVGHTGCGGCIAAFDQPIPTVENPGATPLVRYLEPIIRLKHSLPEGSDVNDLIKENVKMAVKNVVDSPEAWEKARKGEFREVFVHGWLYDLSTGNIVDLNVTQGPHPFVDDRVPRT

SEQ ID NO: 27584 - protein, 95 aa, Glycine max
FAPGIVPGLHPNALMMVLPALVLPSRLAGAAFLTMFLLGTVVAMGSYPVFIGSCREALKNKVPRITEKLPWGFFFIAIALGFALIINQFFGFSLY

SEQ ID NO: 27585 - protein, 329 aa, Zea mays
MVASTASRLSPPRFSTPSPSLHPPNRRSRFSPVRAAKLEAVLSIGAHLIPHPRKAASGGEDAFFANSDAGGVFAIADGVSGWAEKNVNPALFSRELMRNSSNFLNDEAVSHDPQILLMKAHAATSSIGSATVIIAMLEKTGTLKVASVGDCGLKVIRKGQVMFSISPQEHYFDCPYQISSEAEGQTYKDALVCSVNLMEGDIIVSGSDGLFDNIFDQEIVSIISESPSVDEAAKALAELARKHSVDIRFDSPYSMEARSRGFDVPWWKKLLGGKLIGGKMDDITVVVAQVKTVVVPEDEVQGGDTEEQKGNEQGAAAVVAYKMNDEEVA

SEQ ID NO: 27586 - protein, 392 aa, Corynebacterium glutamicum
MTIDLQRSTQNLTYEEIFEAHEGGKLSISSTRPLRDMRDLSLGYTPGVAQVCEAIKEDPEVARTHTGIGNTVAVISDGTAVLGLGDIGPQASLPVMEGKAQLFSSFAGLKAIPIVLDVHDVDALVETIAAIAPSFGAINLEDISAPRCFEVERRLIERLDIPVMHDDQHGTAVVILAALRNSLKLLDRKIEDLKIVISGAGAAGVAAVDMLTNAGATDIVVLDSRGIIHDSREDLSPVKDALAEKTNPRGISGGINEAFTGADLFIGVSGGNIGEDALKLMAPQPILFTLANPTPEIDPELSQKYGAIVATGRSDLPNQINNVLAFPGIFAGALAAKAKKITPEMKLAAAEAIADIAAEDLEVGRIVPTALDPRVAPAVKAAVQAVAEAQYA

SEQ ID NO: 27587 - protein, 468 aa, Burkholderia pseudomallei K96243
MQKGHSETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIAFGIGNHGVPMGISNLWAHGGFFPNGAQGVLMSMQMVMFAYLGVEMIGLTAGEAANPQKTIPGAINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAIVVSMAALLVGVLLNYLVPEKVFVWVTSISTFGAIWTWGVILVTQMKFRASLAPAEERALRFRMPFWPYASWVALAFLVLVIGLMAYFPDTRIALYVGPAWLVLLVVLYFVLKLEPEGGKAAGLERRYGRG

SEQ ID NO: 27588 - protein, 474 aa, Glycine max
  misc_feature (280)..(280): Xaa can be any naturally occurring amino acid
  misc_feature (288)..(289): Xaa can be any naturally occurring amino acid
  unsure (1)..(474): unsure at all Xaa locations
MGLNWHRWVVSAFLLVAWALILDTGEICFCMGGKTSDFLRNDYLSLDMPIDSDTFRVPPGYNAPQQVHITQGDHVGKGVIISWISPHEPGSSTVIYWAENSEFKWQAHGFFLTYKYFNYTSGYIHHCTVHNLEFDTKYYYEVGIGNTTRQFWFKTPPPVGPDVPYTFGLIGDLGQTYNSNRTLTHYEQSPAKGQTILYVGDLSYADDYPLHDNIRWDTWGRFTERIAAYQPWIWTAGNHEIDFAPQLGETRPFKPYTARYHVPYKASDSTSPLWYSLKRXSAYIIVMXXYSALGKYTPQYKWLEKELPKVNRTETPRLIVLMHSPIYNSYVTHYMEGETVRVMYEKWFVEYKVDVVFAGHVHAYERSERVSNIAYNVVNGLCRPINDQSAPVYITIGDGGNLEGLATAMTEPQPSYSAYREASFGHGILDIKNRTHAHFSWNRNQDGYAVVADSVWLHNRYWNHPEQTSLAAFR

SEQ ID NO: 27589 - protein, 698 aa, Candida albicans
MTSLQQQQQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKSRVPTLKELTIMCRNAYDEEMFVQMEMHILSTLDWSIGHPTLEDCLQLAIDSNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQSDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGSLITNNGSFTNIVNNTNSSSPLMNQQQQYYHQQQHQQQVTQSSLYQHHHQYHQ

SEQ ID NO: 27590 - protein, 701 aa, Mycoplasma gallisepticum R
MKRKNILKFVSLLGIGSFVMLAAASCTTPVNPTPNPTPNPTPNPTPNPTPNPKPKPDPMPNPPSGGMNGGNTPTPNPNPHSGGMNGGDTNPGNGGGMDNSAQQLAAAKTALTTLLNGQTEKVGLYVDYAKISAKLSAAYTTAKNVLNNSASTTQNINAARTTLEAEIAAAAKAKTDFDAQHGPLVEAYNNLKETLKEEKTNLDSLANENYAAIRTNLNSLYEKANTIVTATLDPATGNIPQVMSVTQANQDITNATSKLVAWKQNADNLANSFIKQSLVKNNLTGVDEANNQEQPGNYSFVGFSVDVNGPQNNNRPNWSFAERKVWASENTPLATTPAEDATQQAAPLTDVSWIYSLNDAEAKYTLSFRYFGVEKTAYLYFPYKLVKTGDNVGLQYKLNGGDTKQINFVQTPASGPSDGAASEEETMASPAEMQSAPTVDDIKIAKVALSNLNFNSNTIEFSVPTGKVAPMIGNMYLTSSNAEVNKNKIYDDLFGNTFNNENNPTAVTVELLKGYSLAASWRTYIRQFTDLRDNRVQTSDPVYLIGLIGGNANRSTSGLSNVKTSPDVNGDRRTFTIYVNAPMNGEYSISGSYLTNNDRNLVLSTSNTESSSNHTVTITVKGKNNWTTLGTFDTFEMSTTNGNSVKDMKKTLTLKKGLNKITLAGGKLQSNNAPYIGDLSFTLRNSVSNTDSSTNAVEMPK

SEQ ID NO: 27591 - protein, 387 aa, Chlamydomonas reinhardtii
MKELNIKDKDDEAGSSKAQQNAATAEIFEGRLIEGDLKTGGHVLSASSGTGASRQTYNYSTDRVVGNGSFGVVFQATCLETGETVAIKKVLQDKRFKNRELQIMKLVDHPNIVKLKHCFYSHTDKDETYLHLVLEFVPDTVYRISKHYAKNNQRMPNLFVKLYAYQMCRALNSIHKMGICHRDIKPQNLLVNTETHQLKLCDFGSAKVLVKGEPNISYICSRYYRAPELIFGATDYTSAIDVWSVGCVLAELLLGQPLFPGESGVDQLVEIIKVLGTPTREEINAMNPNYTEFKFPQIKAHPWTKVFSKRMPPDAVDLVSKLLQYAPQKRMTAVQAMTHPFFDELRDPATRLPNGRALPPLFNWLPGELDEVPADIVRKLQPVAKAS

SEQ ID NO: 27592 - protein, 457 aa, Frankia sp. EAN1pec
MSTHTETPVDGSAETITGAQPYEAGFTESSAGRVYTVTGGDWEQVLGVGEDDGERITVNMGPQHPSTHGVLRLVLEIEGETVTETRLVIGYLHTGIEKSCEYRTWTQAVTFLTRADYLSPLYNEAAYCLSVEKLLGITGEVPERATVIRVLVMELQRIASHLVWLATGGMELGATTGMIFGFREREKILDLLETITGLRMNHAYIRPGGLAQDIPDEVIPEIRAFLDYMPKRIREYHALLTGQPIWKARMVDVNFLDAAACLALGTTGPVLRAAGLPWDLRKTMPYCGYETYEFDVPTALEGDSYARYLVRIEEMGESLKIIEQCLDRLRPGPVMVADKKIAWPSQLAIGSDGMGNSLEYIRKIMGTSMEALIHHFKLVTEGFRVPAGQVYTQIESPRGELGYHVVSDGGTRPFRVHVRDPSFVNLQAVPALTEGGQVADVIVGVASVDPVLGGVDR

SEQ ID NO: 27593 - protein, 229 aa, Frankia sp. EAN1pec
MTDLVPGSAGVPGGPGGRRRDAFGARGSGDTSGFGGLVPPVAALASTSRPFGDEAADTVYDTLERVFPELGDAVERVVFAYGELTIHVRRERLLDVAWTLRDDPGLRFELLSSLSGVDYPDDLTGRRLHSVVHLTSLTHRRRLRVEVSVADGDAVLPSLTPVWPTADWHEREAYDLFGIVYEGHHELTRIMMPDDWVGHPQRKDYPLGGIPVEYKGAQIPPPETRRSYS

SEQ ID NO: 27594 - protein, 260 aa, Arabidopsis thaliana
MASSSSMQMVHTSRSIAQIGFGVKSQLVSANRTTQSVCFGARSSGIALSSRLHYASPIKQFSGVYATTKHQRTACVKSMAAEEEEVIEPQAKVTNKVYFDVEIGGEVAGRIVMGLFGEVVPKTVENFRALCTGEKKYGYKGSSFHRIIKDFMIQGGDFTEGNGTGGISIYGAKFEDENFTLKHTGPGILSMANAGPNTNGSKFFICTVKTSWLDNKHVVFGQVIEGMKLVRTLESQETRAFDVPKKGCRIYACGELPLDA

SEQ ID NO: 27595 - protein, 228 aa, Oryza sativa (japonica cultivar-group)
MAIARTGVYVDDYLEYSSTLAGDLQRILSTMRELDERAHGIMGQTKEQIKYLLGVPSHGFDRSNMDDDESASERMKKDIEASQDNALSLCTEKVLLARQAYDLIESHIKRLDEDLGQFAEDLKQEGKIPPDEPSILPAISAFSRDDKRRPGFSTPQATKKFREREWDRERGMDFDLMPPPGSNKKTTAPMDVDQTIDPNEPTYCICHQISYGDMIACDNDNVSLYGAK

SEQ ID NO: 27596 - protein, 322 aa, Pseudomonas putida KT2440
MQPQTFYRAVADDFSAVDEIIKKQLTSRVPLVSKIGDYITSAGGKRLRPLLVLLCGKALGREGDDLRLLAATIEFLHTATLLHDDVVDMSGMRRGRSTANALWGNAPSVLVGDFLYSRSFEMMVELGSMPVMQILSKATRVIAEGEVLQLSRVRDASTTEEVYMEVIRGKTAMLFEASTHSAAALAQATDEQREALRTFGDHLGVAFQLVDDLLDYKGDSQTLGKNVGDDLAEGKPTLPLIYTMREGTAEQAALVRQAIQKGGLEDLEQIRVAVEESGALKYTAELARDYVKRAIACLEVLPASEYRDALVELSEFAVARTH

SEQ ID NO: 27597 - protein, 333 aa, Wolinella succinogenes DSM 1740
MSPLRIAINGFGRIGRSVARVIAQRSDVELVAINDLASPETLAYLLRHDSVHGAFPHEVSWEGNRFYIGKKEVLLYQERDPQKLDFSAASPEVVIESTGLFLTQELVKHHLQKGVKRVIFSAPAKDSTPTYVLGVNHERYQGEPIISNASCTTNCLAPLAMLLDEAFGIEKGIMTTIHAYTNDQNILDTAHRSDFRRSRAAAINMIPTTTGAAKALGLVLPSLQGKLHGHSVRVPTPDVSMVDLNVKLAQKSSAQAINELFMEASQGRLKGILGMDKDFGVSLDFQGDPRSSIVASDLTFVIEGDMAKVMAWYDNEWGYSNRLVDMARFITSL

SEQ ID NO: 27598 - protein, 134 aa, Arabidopsis thaliana
MGSLETCLLFFVMVMFMSAIMSRASTSVVIYNDLGGGLPLRHHCKSREDDLGYQSLAPGRSWSFGFTPDIFGRTLFYCRFSWGAESHIFDIYKQSRDKEFQEFGCKKCEWKIRKNGPCKFYKKTGMFDHCYSWD

SEQ ID NO: 27599 - protein, 181 aa, Solanum lycopersicum
MASSIVSSAAAATRSNVAQASMVAPFTGLKSAASFPVTKKNNNVDITSLASNGGRVRCMQVWPPINMKKYETLSYLPDLSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 27600 - protein, 217 aa, Zea mays
MGSRQGPPKHQNKFAWVPNAGVKINETEVGGRFRPLSEITGVCHRCREQIAWKRKYGKYKKLTEPAKCQKCLKRNVRQAYHKLCTGCAKEQKVCAKCYSSSEQIMGRDIYEVEPEQKLLDETIKNARERDRRTLLRAMNKDSNPKKSDEEATRSDSSKVGDVFPSTSLEEYANKSGRVSGIVGHGHVVDDEEDDDDVASEPELDEDHSGDDDDELQK

SEQ ID NO: 27601 - protein, 922 aa, Corynebacterium glutamicum
MADQAKLGGKPSDDSNFAMIRDGVASYLNDSDPEETNEWMDSLDGLLQESSPERARYLMLRLLERASAKRVSLPPMTSTDYVNTIPTSMEPEFPGDEEMEKRYRRWIRWNAAIMVHRAQRPGIGVGGHISTYAGAAPLYEVGFNHFFRGKDHPGGGDQIFFQGHASPGMYARAFMEGRLSEDDLDGFRQEVSREQGGIPSYPHPHGMKDFWEFPTVSMGLGPMDAIYQARFNRYLENRGIKDTSDQHVWAFLGDGEMDEPESRGLIQQAALNNLDNLTFVVNCNLQRLDGPVRGNTKIIQELESFFRGAGWSVIKVVWGREWDELLEKDQDGALVEIMNNTSDGDYQTFKANDGAYVREHFFGRDPRTAKLVENMTDEEIWKLPRGGHDYRKVYAAYKRALETKDRPTVILAHTIKGYGLGHNFEGRNATHQMKKLTLDDLKLFRDKQGIPITDEQLEKDPYLPPYYHPGEDAPEIKYMKERRAALGGYLPERRENYDPIQVPPLDKLRSVRKGSGKQQIATTMATVRTFKELMRDKGLADRLVPIIPDEARTFGLDSWFPTLKIYNPHGQNYVPVDHDLMLSYREAPEGQILHEGINEAGSMASFIAAGTSYATHGKAMIPLYIFYSMFGFQRTGDSIWAAADQMARGFLLGATAGRTTLTGEGLQHMDGHSPVLASTNEGVETYDPSFAYEIAHLVHRGIDRMYGPGKGEDVIYYITIYNEPTPQPAEPEGLDVEGLHKGIYLYSRGEGTGHEANILASGVGMQWALKAASILEADYGVRANIYSATSWVNLARDGAARNKAQLRNPGADAGEAFVTTQLKQTSGPYVAVSDFSTDLPNQIREWVPGDYTVLGADGFGFSDTRPAARRFFNIDAESIVVAVLNSLAREGKIDVSVAAQAAEKFKLDDPTSVSVDPNAPEE

SEQ ID NO: 27602 - protein, 318 aa, Arabidopsis thaliana
MTTNDDDHAAERNTMSMNYELAATLSDEEQRARKGKAKIVCKEEDHVFIKKKEKYEEESEKREFFSHVPRKIRPALRYPQPNFENPNGASSSLNLPFEEDYYMAEYYKKTETINPPNPYHQWSPSSFLTEYTHPRMLEVLHRCGFNRPVVTCYSRTAREMRWWLRQVMKDMRAEDLTLILEKTLSTTDVITTTHGRFSMHFNRLISNDFLKPEERSILEEDTYNDETMGVGAILVDQRSQKWSVILKRWGQNYFLSCGWNDVVKANKLKAGDDICLWAFRCDGVLCFAMRQWRGILCFALVPPLTLRQSSSSNARRLC

SEQ ID NO: 27603 - protein, 112 aa, Glycine max
MILLLGGSQLPNCSASAIITYSSSPSMSGFYIVMQTASSIISFSAVVAVFRAAPGMVTPFSDIKTMVGFPSKKTNNDITSIPSTGGRVQCMQVWPPVGKKKFETLSYLPDLM

SEQ ID NO: 27604 - protein, 334 aa, Corynebacterium glutamicum
MTIRVGINGFGRIGRNFFRAVLERSDDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHGDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 27605 - protein, 405 aa, Corynebacterium glutamicum
MAVKTLKDLLDEGVDGRHVIVRSDFNVPLNDDREITDKGRIIASLPTLKALSEGGAKVIVMAHLGRPKGEVNEKYSLAPVAEALSDELGQYVALAADVVGEDAHERANGLTEGDILLLENVRFDPRETSKDEAERTAFAQELAALAADNGAFVSDGFGVVHRAQTSVYDIAKLLPHYAGGLVETEISVLEKIAESPEAPYVVVLGGSKVSDKIGVIEALAAKADKIIVGGGMCYTFLAAQGHNVQQSLLQEEMKETCTDLLARFGDKIVLPVDLVAASEFNKDAEKQIVDLDSIPEGWMSLDIGPESVKNFGEVLSTAKTIFWNGPMGVFEFAAFSEGTRGIAQAIIDATAGNDAFSVVGGGDSAASVRVLGLNEDGFSHISTGGGASLEYLEGKELPGVAILAQ

SEQ ID NO: 27606 - protein, 401 aa, Rickettsia conorii str. Malish 7
MSIISTRLSSIKPSPTLAVVKKTLELKKAGVDIITLGAGEPDFDTPDNIKEGAIKAIKDGFTKYTNVEGMPLLKQAIKDKFKRENNIDYELDEIIVSTGGKQVIYNLFMASLDQGDEVIIPAPYWVSYPDMVALSTGTPVFVNCGIENNFKLSAEALERSITDKTKWLIINSPSNPTGASYNFEELENIAKVLRKYSHVNVMSDDIYEHITFDDFKFYTLAQIAPDLKKRIFTVNGVSKAYSMTGWRIGYGAGSKTLIKAMTIIQSQSTSNPCSISQMAAIEALNGPQDYIKPNALNCQKKRDLALSILKRVKYFECYKPEGAFYLFVKCDKIFGHKTKSGTIIANSNDFAEYLLEEAKVAVVPGIAFGLEGYFRISYATSMEELEKACIRIEKTIDVIPA

SEQ ID NO: 27607 - protein, 409 aa, Schizosaccharomyces pombe
YPTGLILDACLGESQSIMFKKSGLRTLGTLHRDLIIDKLNHDDVTIITAVLDLREKHAESIMTPIEDVLTLPMDRILDEDLIGEIICAGYSRIPVHKPGFPHDFIGMLLTKTLIGYDPDDKWPVGKFALATLPQTWPNTSCLDLLNYCQEGKSHMILISNSPGEPHGAIGVITLEDIIEELIGEEIIDETDVYIDVHKGLPRVGENNDFWNRMLHRSHLSTMAALHKSQRSHDLAANEHAPILNPKNSALNPRLVTNDRVKVKSPSLIQSSTGYGSMSQSPSRSDLPSKISRVNAELQAHGSQRSSIDVSKENKSSVADGPSSQAHNGPSTQPPEALPNGTDPSSSKTTENNGNQQSERTESADGKKDNSGSISSNSSKTFTGKRVRLGNVIESNVVSPDGTNRLLLTI

SEQ ID NO: 27608 - protein, 558 aa, Methylobacillus flagellatus KT
MYIYDEIDQAIVDERVKQYRDQTRRFLAGELSDEEFRPLRLQNGLYIQRHAPMLRIAVPYGMLSSRQLRKLGDIAKRYDRGYGHFSTRQNLQLNWPQLEDVPDILAELATVQMHAIQTSGNCIRNITTDQFAGVAPDEVVDPRAIAEIARQWSTFHPEFALLPRKFKIAVSGTKQDRALIQTHDIGLEFYRDQEDKIAVRVWVGGGLGRTPILGSVIREHLEWQHVLTYCEAIIRVYNLHGRRDNAYKARIKILVKALGIEEFRRQVEEEWQYLKDSPNTITEAELARVSKYFTQMPYETLSDHDAGFDSAIASNPAFAAWVKRNTHPHKQPGYRAVTLSLKSHGRPPGDITSEQMHIVADLADEYSFGEVRPSHEQNLILADVKLSDLYSLWEKARAAGLATPNIGLLTDIICCPGGDFCALANAKSIPIAEAIQMQFDDLDYLYDIGEIELNISGCMNACGHHHVGHIGILGVDKDGSEWYQVTLGGKQGNDASIGTVLGPSFAAEEMPGVIQKLIDVYVRERTPEERFIDTVRRIGVAPFKTHVYGEKKKEVAHA

SEQ ID NO: 27609 - protein, 259 aa, Corynebacterium glutamicum
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDATELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 27610 - protein, 225 aa, Mycoplasma gallisepticum R
MKLNMIKGFIFDLDGVITDTAKLHYIAWKKIVAQLGINFLEEENEKLKGLSRLDTLKAILRLKKPKNDLSQAELIKICEQKNDLYKKLLTTEIYQNSILKGIDQLIIKAKANKIKLAVASSSHNAPLISEKLGLLDSFDYIVNPSEINQGKPAADIYLKAAEGLDISTDQAIGFEDAISGLKAIKAAKMKAVVIIHGSNEDFSKADLIYQSTSELNFDFIMRHFQ

SEQ ID NO: 27611 - protein, 560 aa, Azoarcus sp. BH72
MYRYDDYDQRLVDERVAQFRDQTRRYLAGELSEDEFRPLRLQNGLYVQRHAPMLRIAVPYGLFSSAQLRTLADIARRYDRGYGHFTTRQNIQFNWPELAKVPEILAQLATVQMHAIQTSGNCIRNITSDAFAGVAADELIDPRPWCEILRQWSSFHPEFAHLPRKFKFAVNGAKEDRAVIQAHDIGLDVVKNDAGEIGFRVLVGGGLGRTPIIGEEIAAFVPWQHIVTYCESILRVYNLHGRRDNKYKARIKILVKALGIEEFRRQVEAEWAFHKNGPSTLTEAEVARVAAHFVDPAYESLPATDAGYASLLDENKPFAAWVKRNVRAHKVPGYASVTISLKKTGVPPGDITESQMELVADLADAYSYGEVRATHQQNLVLADVRQSDLFKVWQSLRDAGLATPNIGLLTDIISCPGGDYCALANAKSIPIANAIQERFDNLDYLYDIGEIELNISGCMNACGHHHVGHIGVLGVDKNGEEWYQVTIGGDQGNKAAIGKVIGPSFAAAEMPDVVTHLIETYIANRHEDERFVDTVRRIGIEPFKAHVYGNRQTEKKVAHA

SEQ ID NO: 27612 - protein, 486 aa, Pseudomonas syringae pv. syringae B728a
MTSQSLNSHHVDPDTALKLYIDGRWSAPLDPVSIAVINPATEEVVAHVASGSAADVDRAVAAARAAFAGWSGSSPHARAQVIGRIHELILERKEQLAQAISLEMGASISSARAMQVPLAAEHVRVARDLLATYRFHTVEGSTAIEREPIGVCGLITPWNWPLYQITAKVAPAIAAGCTVVLKPSELSPLSALLFAQLVHDAGLPPGVFNLVNGSGPEVGGAMAAHPDIDMISITGSNRAGALVAQAAAPTVKRVTQELGGKSPNILLPDADFAKAVPPGVMAAFRNVGQSCSAPTRMIVPRNRLAEVEALAAETAAAIVVGDPQLEETVLGPIANEAQFQRVQAMIDAGLSEGAKLVCGGPGRVQGHERGFYTRPTVFSEVDSSMRIAREEIFGPVLCLIAYDTVEEAIAIANDTVYGLGAHVQGQDLEQARAVASRIRAGQVHLNYPAWNPMAPFGGYKRSGNGREYGVQGFEEYLETKAIVGFA

SEQ ID NO: 27613 - protein, 666 aa, Dehalococcoides ethenogenes 195
MSNTKSDSLCINALRFLAVDAVQKANSGHPGAPMGMAAMAYALWQNFLKHNPQDPAWPNRDRFILSAGHASALLYSLLHLTGYDLPLDELKNFRQWGSKTPGHPEYGLTPGVEMTTGPLGQGFASGVGMAMAEAHLAAVFNQPDCKIIDHYTYGIVSDGDLMEGVASEAASLAGHLALGKLIYLYDDNEISIEGSTELAFTENTALRFESYGWQVIGPVDGLNPEAVSGAIKEAQSDSARPSLIICKTVIGFGSPNKAGKASAHGEPLGTDEVAKSRKSLGWDYEPFVIPPEALAEFRMALDKGKTAQQVWQSKLDYYSSRYPEKAALLQDRLSGKLPDNWDNELDKLFDKAMASREASGLIINTLASRLPALMGGSADLSPSNKTVIKDGGEYEPPHYEGRNIHFGVREHAMGAIANGLALHGGIIPYVATFLIFYDYMRPAVRLASLMGQRVIYIFTHDSIGLGEDGPTHQPIEQLAGLRSVPGLVTIRPADSYETAQAWKTAILRKDGPTAIALSRQKLPLLDNSQANSVNLAKGAYILAETDSRPQVALVASGSEVSIAVQAAEILKNKGVSSRVVSFPSWQLFEAQPRTYRQSILPASLPRVIIEAGSAQGWCKYLGANGDIISIDHFGASAPAPVLYQHFGLTPENMAEKALKLLENEDE

SEQ ID NO: 27614 - protein, 799 aa, Saccharomyces cerevisiae
MVLPILPLIDDLASWNSKKEYVSLVGQVLLDGSSLSNEEILQFSKEEEVPLVRLSLPSGKFSDDEIIAFLNNGVSSLFIASQDAKTAEHLVEQLNVPKERVVVEENGVFSNQFMVKQKFSQDKIVSIKKLSKDMLTKEVLGEVRTDRPDGLYTTLVVDQYERCLGLVYSSKKSIAKAIDLGRGVYYSRSRNEIWIKGETSGNGQKLLQISTDCDSDALKFIVEQENVGFCHLETMSCFGEFKHGLVGLESLLKQRLQDAPEESYTRRLFNDSALLDAKIKEEAEELTEAKGKKELSWEAADLFYFALAKLVANDVSLKDVENNLNMKHLKVTRRKGDAKPKFVGQPKAEEEKLTGPIHLDVVKASDKVGVQKALSRPIQKTSEIMYLVNPIIENVRDKGNSVFLEYTEKFDGVKLSNPVLNAPFPEEYFEGLTEEMKEALNLSIENVRKFHAAQLPTETLEVETQPGVLCSRFPRPIEKVGLYIPGGTAILPSTALMLGVPAQVAQCKEIVFASPPRKSDGKVSPEVVYVAEKVGASKIVLAGGAQAVAAMAYGTETIPKVDKILGPGNQFVTAAKMYVQNDTQALCSIDMPAGPSEVLVIADEDADVDFVASDLLSQAEHGIDSQVILVGVNLSEKKIQEIQDAVHNQALQLPRVDIVRKCIAHSTIVLCDGYEEALEMSNQYAPEHLILQIANANDYVKLVDNAGSVFVGAYTPESCGDYSSGTNHTLPTYGYARQYSGANTATFQKFITAQNITPEGLENIGRAVMCVAKKEGLDGHRNAVKIRMSKLGLFPKDFQ

SEQ ID NO: 27615 - protein, 310 aa, Aspergillus oryzae
MASQQNGTNGASASNDFTVKAGLAQMLKGGVIMDVVNAEQARIAEEAGAAAVMALERVPADIRAQGGVARMSDPSMIKEIMEAVTIPVMAKARIGHFVECQILEAIGIDYIDESEVLTPADDIYHVTKHNFKAPFVCGCRNLGEALRRISEGAAMIRTKGEAGTGDVVEAVKHMRTVNAQIARARAILQSSPDYEPELRAFARELEVPYELLRETAEKGRLPVVNFAAGGVATPADAALMMQLGCDGVFVGSGIFKSGDAKKRAKAIVQAVTHYKDPKVLAEVSEGLGEAMVGINVSQMAESDKLAKRGW

SEQ ID NO: 27616 - protein, 443 aa, Polaromonas sp. JS666
MPDRRRRPLRGEQATRSETGRGWAYTPTYNLRLRPCWPAYFTCERSMNFIRFSDLCASGKAAGQRVFIRADLNVPQDDSGAITEDTRIRASIPCLQMALDAGAAVMVTSHLGRPVEGEFKPADSLAPVAKRLGELMKREIPLVTQWVDGVDVQPGQLVLLENCRLNPGEKKNSEALARKMAALCDIFVHDAFGTAHRAEASTYGIAQYAKVASAGPLLAAEMDAISTALSNPRRPLVAIVAGSKVSTKLTILKSLASNVDQLIVGGGIANTFMLAAGLKIGKSLAEADLLPEARAVIEAMKARGAAVPIPTDVVTAKTFAADATATVKAATDVEDDDLILDIGPETTARLAAQLKAAGTIVWNGPVGVFEFDAFSRGTEGIARAIADSSAFSIAGGGDTLAAIAKYGIEKQVGYISTGGGAFLEVLEGKTLPAFEILQKRAAG

SEQ ID NO: 27617 - protein, 608 aa, Arabidopsis thaliana
MNCFPCFTSQKSRNAPCTTNETNDDNVEHDEFRPPVVATTKRTEEREPAEQQPPVKTFNFRELATATKNFRQECLLGEGGFGRVYKGTLQSTGQLVAVKQLDKHGLHGNKEFLAEVLSLAKLEHPNLVKLIGYCADGDQRLLVFEYVSGGSLQDHLYEQKPGQKPMDWITRMKIAFGAAQGLDYLHDKVTPAVIYRDLKASNILLDAEFYPKLCDFGLHNLEPGTGDSLFLSSRVMDTYGYSAPEYTRGDDLTVKSDVYSFGVVLLELITGRRAIDTTKPNDEQNLVAWAQPIFKDPKRYPDMADPLLRKNFSERGLNQAVAITSMCLQEEPTARPLISDVMVALSFLSMSTEDGIPATVPMESFRDKSNKSSSSSDSEDEEEEKEQKAEKEEESTSKKRQEQEETATDSDDESDSNSEKDQEEEQSQLEKARESSSSSSDSGSERRSIDETNATAQSLKISYSNYSSEEEDNEKLSSKSSCKSNEESTFSRYDSGRDHDDSSRNTSMRINSLAHDDKEEDEEENHETRSYSDHDDSPRNTSMRINSLSHDDDEEEEEENHQTRLEHIHSSKSEDQSVYSDDDAGESGESSLHRIEAKEEEHISSDHD

SEQ ID NO: 27618 - protein, 152 aa, Arabidopsis thaliana
  misc_feature (64)..(64): Xaa can be any naturally occurring amino acid
  misc_feature (72)..(72): Xaa can be any naturally occurring amino acid
  misc_feature (75)..(75): Xaa can be any naturally occurring amino acid
  misc_feature (88)..(88): Xaa can be any naturally occurring amino acid
  misc_feature (93)..(93): Xaa can be any naturally occurring amino acid
  misc_feature (105)..(105): Xaa can be any naturally occurring amino acid
  misc_feature (126)..(126): Xaa can be any naturally occurring amino acid
  misc_feature (144)..(144): Xaa can be any naturally occurring amino acid
  unsure (1)..(152): unsure at all Xaa locations
MASSMLSSNAVVKSQAQATMVAPFTGLKSSASLKVTRKANNDITSITSNGGRVSRMKVWPPIGXKKYQTLTXLTXLGESERLRKLAKXLRNKXVPSVELELQHGXMLRDHGYTPGYSDGWYWTMWXLHMFGILESAQVFKAVKXCNYEYPGA

SEQ ID NO: 27619 - protein, 414 aa, Neisseria meningitidis MC58
MTLFCEQVPYPRLAEAFGTPLYVYSQSALTEAFEHYQTAFAALNPLVCYAVKANGNLSIIKHFASLGSGFDIVSGGELARVLAAGGDAAKTIFSGVGKSEAEIEFALNAGVKCFNMESIPEIDRIQKVAARLGKTAPVSLRINPDVDAKTHPYISTGLKANKFGIAYADALEAYHYAAQQPNLKIIGIDCHIGSQLTDLSPLVEACERILILVDALAAEGIVLEHLDLGGGVGIVYQDENVPDLGAYAQAVQKLIGTRRLKLILEPGRSLVGNAGSLLTRVEFVKYGEEKNFVMVDAAMNDLMRPALYDAYHHIEAVETKDIATLTANIVGPICETGDFLGKDRTIACEEGDLLLIRSAGAYGASMASNYNARNRAAEVLVDGNEYRLIRRRETLEQQMANELACLQAEHQNAV

SEQ ID NO: 27620 - protein, 308 aa, Methanothermobacter thermautotrophicus str. Delta H
MLNPSDFIEEAVEEIRSTVGNEKAIIALSGGVDSSVASVLAGRAIGDNLTAVFVDHGLLREGEAEYVRKTFSERLNFRYIDASEEFLKELEGVTDPEEKRKIIGRVFIEVFERVAEEIGARYLVQGTIAPDWIESEGQIKSHHNVALPHGLVLEIVEPIRELYKDEVREIGLELGLPREMIQRQPFPGPGLAVRIVGEITREKIEICRRANAIVEEEVVESGLHESLWQYFAVLTDTMVTGVKGDVRDFGYLVVIRMVESLDAMTASVPELPWDLIKRISKRITAEIPEVTHVALSVSDKPPSTIEFA

SEQ ID NO: 27621 - protein, 514 aa, Capsicum annuum
METWFIIVVTLCISFFLKSIFDIIISSNSKSKKKLPPGPYTWPVIGTFLWARRGIIDVERILVDLKAKYGPMITLNMGTRTTIFVSSHSLAYQALVQKGSVFSDRESVDSNNETRVINSAPYGSTWRLLRRNLTSEMLHPSRIKSYSKARAWVLDILLKQLRGKQDDSVKLVDHFQYAMFCLLVLMCFGDKLDEPQIKKIENMLVKFLLGLRRFKVLAIFPRLGKLIFGKLWKEFYELGQEQEKTYLPLIEARIKAKEQKTEHGELEDEFVTCYVDTLLNLEWPDEKRKLNHREIVGLCIEFLTAATDTTSTALQWIMANLVKNPTIQDKLYQEIASVVGEKKSESTEEVVKEEDLQKMPYLKAVILEGLRRHPPGHILFPHKVTEEVELNGYVIPKNVTINFMLADMALDPNVWEDPLEFKPERFLVEGSDKESFDITGSREIKMMPFGAGRRICPGYALAMLHLEYFVANLIWHFQWNPVEGYGVDLSEKQEFTVVMKNPLRARICPRVNTL

SEQ ID NO: 27622 - protein, 355 aa, Thermoanaerobacter tengcongensis MB4
MYRIAVLPGDGIGPEVIEEGLKVLKAVEEKYGLRFDIKKYPFGGEAIDKYGEPYPEETRNGCLSSDAVLLGAVGGPKWDGLEGDKRPEAGLLALRKSLGVYANLRPAVLYPSLKDASPLKNELLEKGLDILVVRELTGGIYFGPRGKEAIGYGFRAYDTEVYETQEIERIAVIAFEAALRRRKKITSVDKANVLESSRLWRKTVEEVAKRYPEVELNHMYVDNCAMQLVKNPFQFDVILTNNMFGDILSDEAAQIVGSIGILPSASLRGDRVGLYEPIHGSAPDIAGKKIANPLATILSVAMMLQYSFGEEEAAQDIRKAVERALEEGFRTADLGKGIVLSTEEMGDKVVEYIKG

SEQ ID NO: 27623 - protein, 382 aa, Xanthomonas axonopodis pv. citri str. 306
MPLTTKLPKVGTTIFTVMSQLAAEHGAVNLGQGFPDFAVPQRLVDELSKAMAAGHNQYPPMTGVATLRQAIAGKAQRCYGAQVDADTEITVTSGATEAIFNAIHAVVRAGEEVIVLDPAYDCYEPAIDLAGARAVHVALHPQTFAVDWDALRAAITPKTRLLMINSPHNPSGAMLSAEDMQTLTELLRGTEIFLLSDEVYEHIVFDGRRHESVLRWPALRERAFVISSFGKTYHCTGWKIGYAIAPPALTAEFRKVHQYNTFTSFGPAQHAFAAMIRDEPEHDEQLGAFYQAKRDRFREQLLATRLKPLPVPGGYFQLVDYSAISDLPDTEFVKWLTIENGVAAIPLSPFYENAPAGQRLARLCFAKNDATLDAAIERLRRL

SEQ ID NO: 27624 - protein, 486 aa, Glycine max
MVEKSSRTNLGHHQDFGMEAYSIDGVSSQSESKFYDDDGHVKRTGNVWTTSSHIITAVVGSGVLSLAWAMAQMGWVAGPVVMIFFSAVTLYTTSLLADCYRCGDPVTGKRNYTFMDAVQSILGGYYDTFCGVVQYSNLYGTAVGYTIAASISMMAIKRSNCFHSSGVKNPCHVSSNPYMIGFGIIQILFSQIPDFHKTWWLSIVAAIMSFAYSTIGLALGIAKVAETGTFKGSLTGVRIGTVTEATKVWGVFQGLGDIAFAYSYSQILIEIQDTIKSPPSEAKTMKKSAKISIGVTTTFYMLCGFMGYAAFGDSAPGNLLTGFGFFNPYWLIDIANAAIVIHLVGAYQVYAQPLFAFVEKWASKRWPEVDTEYKVPIPGFSPYNLSPFRLVWRTVFVIITTIVAMLIPFFNDVLGLLGALGFWPLSVFLPVQMSIKQKRTPRWSSRWIGMQILSVVCLIVSVAAAVGSVASIVLDLQKYKPFHVDY

SEQ ID NO: 27625 - protein, 382 aa, Glycine max
MAIDCITSIPMMPQPPTQETTKEQEQQQPLVFDASVLRHQLHIPSQFIWPDEEKACLDEPELFVPFIDLGGFLSGDPVAATEASRLAGEACQKHGFFLVVNHGIDQRLICDAHLYMEHFFGLPLSQKQRAQRKPGEHCGYASSFTGRFSSKLPWKETLSFQYSADKNSSPALVKDYLCSKMGKEFEQFGKVYQDYCDAMSNLSLGIMELLGMSLGVGRACFREFFEENSSIMRLNYYPPCQKPDLTLGTGPHCDPTSLTILHQDQVGGLQVCVDNEWHSIKPDLNAFVVNVGDTFMALSNGRYKSCLHRAVVNSQTTRKSLAFFLCPRSDKVVSPPCELVDNLSPRLYPDFTWPMLLEFTQKHYRADMKTLEAFANWLRKSN

SEQ ID NO: 27626 - protein, 424 aa, Arabidopsis thaliana
MATPMVEDTSSFEEDQLASMSTEDITRATRLLDNEIRILKEDAQRTNLECDSYKEKIKENQEKIKLNKQLPYLVGNIVEILEMNPEDDAEEDGANIDLDSQRKGKCVVLKTSTRQTIFLPVVGLVDPDSLKPGDLVGVNKDSYLILDTLPSEYDSRVKAMEVDEKPTEDYNDIGGLEKQIQELVEAIVLPMTHKERFEKLGVRPPKGVLLYGPPGTGKTLMARACAAQTNATFLKLAGPQLVQMFIGDGAKLVRDAFQLAKEKAPCIIFIYEIDAIGTKRFDSEVSGDREVQRTMLELLNQLDGFSSDERIKVIAATNRADILDPALMRSGRLDRKIEFPHPTEEARARILQIHSRKMNVHPDVNFEELARSTDDFNGAQLKAVCVEAGMLALRRDATEVNHEDFNEGIIQVQAKKKASLNYYA

SEQ ID NO: 27627 - protein, 367 aa, Yarrowia lipolytica CLIB122
MFIGGLNWETTDESLTNYFAQFGEVLECTVMRDHFSGKSRGFGFLTFRDPKCVNAVMAKEHYLDGKIIDPKRAIPREEQDKTSKIFVGGVGSDVTEEDYKQFFEQYGTVIDAQLMIDKDSGRPRGFGFVTFDSEQAMNTILAQPLLILKDKPIEVKRAENRSKGAGASAVANAVAGPSHGGGNHNYNNNHSHGGTADAAAAPAQNSYGGMTPQAMTQWWQQYMQYMQQVQQMQGGAAADPEAQQAMMAQMMAQMQQQQQPQGQSHQQRDNHHQQSRERDHHNDESSDDNEMRRVDRGRDDRSGRRGRGYNQSDRRSRSPGVPTGPRDGRQRGRRHGGGRGRDRRDGGRAPGYHPYGGSRDRQQGRRD

SEQ ID NO: 27628 - protein, 101 aa, Schizosaccharomyces pombe 972h-
MSSVESFVDSAVADNDVVVFAKSYCPYCHATEKVIADKKIKAQVYQIDLMNNGDEIQSYLLKKTGQRTVPNIFIHQKHVGGNSDFQALFKKGELDSLFNTA

SEQ ID NO: 27629 - protein, 1006 aa, Oryza sativa (indica cultivar-group)
MGASEVRSWGPLGHLSPRSGPSGDSMKNQRFCFVNHVGKIVLNSDTLLGNGVVGILAETANMWERRAPLTPSHCARLLLGGGKRGTGVNRIIVQPSTKRIHHDAQYEDVGCEISKDLSECGLIIGIKQPKLEMILPHRAYGFFSHTHKAQKENMPLLDEILEKRVSLFDYELIAGDDGKRLLAFGKFAGRAGLIDFLHGLGQRYLSLGYSTPFLSLGQSHMYPSLAAAKAAVIAIGEEIATFGLPSGICPIVFVFTGTGNVSASTFLFVGMIARSLSQHPQSSKRVFQLYGCVVSSRDMVTPKDPTRCFNKADYYAHPEHYKPVFHERIAPYASAIVNCMYWERRFPRLLSIDQLQQLMKNGCPLVGISDITCDIGGSIEFVNKSTSIERPFFRYDPCTNSCHDDMEGNGVICLAVDILPTEFSKEASQHFGDILSKFVARLASAKELLELPSHLRKACIAHAGRLTSLYEYIPRMRKTIIELPPAPTNLLPDKKYNSLVSLSGHLFDKFLINEALDIIETAGGSFHLIRCDVGQSIDDMSYSELEVGADDTATLDKIIDSLTSLANAHGDPNARREIELSLKIGKVNECGTDDSMAKEGSKVLILGAGRVCRPAAEFLASYSNIFSSSAYDHDIDQIHVIVASLYQKDAEETIDGIRNATAAQLDVADIKNLSNLVSQMKKHLVTASYVDESMSKLEQSAEGAGVTILCEMGLDPGIDHMMSMKMIDEAHSRKGKIKSFTSFCGGLPSPASANNPLAYKFSWSPAGAIRAGRNPAVYKFHGEIIHVDGFSEIMATFAKIGFFDAASHPLLQQTTRPTYRDFLVELFNACNISTTARKEYSEVSGGQDGELISRLLSFGHCKDKEIAAKTVKTIKFLGLYEETQIPENCSSAFDVICQRMEQRMAYIHNEQDMVLLHHEVEVEYPDGRPTEKHQATLLEFGKVENGRPTTAMALTVGIPAAIGALLLLQNKIQKKGVIRPLEPEIYIPALEILESSGIKLAERVET

SEQ ID NO: 27630 - protein, 463 aa, Magnetospirillum magnetotacticum MS-1
MLKAIKDNDVKYVDFRFTDPRGKWQHVTFDVSLVDEEIFQDGTMFDGSSIAGWKAINESDMLLMPDPSTACMDPFFSASTMSIVCDVLEPSTGEPYARDPRSTAKLAEAYLRSTGIGDEIFVGPEAEFFVFDDVKFGADPYHTGFQLDSTELPTNGFTDYEGGNLGHRIQTKGGYFPVPPQDSAQDMRGEMLAAMQSMGVKVEKHHHEVASAQHELGMKFDKLTTLADHMQIYKYCIHNVAQSYGKSATFMPKPVYGDNGSGMHVHQSIWKDGKPLFAGDKYADLSQECLWYIGGIIKHAKALNAFTNPSTNSYKRLVPGYEAPVLLAYSARNRSASCRIPWTTNPKAKRVEVRFPDPMANPYLAFSALLMAGLDGIINKIDPGPAMDKDLYDLPPRELKKIPTVCGSLREALQNLDKDRAFLKAGGVFSDDQIDSFIELKMTEVLRYEMTPHPIEFVNYYSL

SEQ ID NO: 27631 - protein, 269 aa, Crocosphaera watsonii WH 8501
MTPTAVITGASAGIGQATAILLAQKGYNLVLAARTNDRLEAVAQQAIELGSQVLAIPTDVTDVKQVNNLVEKALDTYTQVDILINNAGICMTAPMSQTSLEDWQKILNVNLWGYIYPIHALLPHFLSRQQGTIVNVGSFGGKMPLPNMTAYCTSKYAVTGLTETLRLELEPKGIHVCGVHPSVTNSDFLERAVFRGPQETYSEQMRASMKDILNSPLASQPQDVAKAIFQIIEHPQREVVVGTGAIATSLYSLAPSLSQWLLQQSQGKS

SEQ ID NO: 27632 - protein, 320 aa, Bacillus cereus ATCC 10987
MKLQLMYSFLRSDINVIEKELKKTVASEQPLVEEAALQLIEAGGKRIRPVFVLLAGKFGDYKLDAIKHVAVALELIHMASLVHDDVIDAAFLRRGSATVNAKWGDRIAMYTGDYLFAKSLECITNIEIPEAHQALSHTILEVCKGEIEQIKDKYDYDQNLRTYLRRIKRKTALLIAASCQLGAIAAGANRDTVSRLFWYGYFVGMSYQIIDDILDFVSTEEKLGKPAGGDLLQGNITLPALYAMEDPVLCKKIKSVHENTTADEMKEIIEAVKNSDAIDKAFAFSERYLHKALEIIKPLPRGQAKYALQNVAKYIGKRKF

SEQ ID NO: 27633 - protein, 236 aa, Rickettsia conorii str. Malish 7
MPSRNDDLIFTQAMPYLHPIRKQIMTTQKIVPTKSTDGSKLFRHQAKFVAGAMNINQILNFSLPEIAFVGKSNVGKSSLINTICNNKNLAKVSNTPGRTRQINFFNLADKLIIVDLPGYGFANVPISVKEQWGVLISYYLRNSYNLRLVNLLIDSRRGIKENDKKVADLLLANKREFQIIFTKSDKVTDHKNLHDEAQNFLATLNYSCNVMYVSNRSKEGARELKASLAKCIKPQK

SEQ ID NO: 27634 - protein, 166 aa, Bacillus cereus ATCC 10987
MCVGIYNYIHNSEVERFFMEKTFLMVKPDGVQRAFIGEIVARFEKKGFQLVGAKLMQVTPEIAGQHYAEHTEKPFFGELVDFITSGPVFAMVWQGEGVVDTARNMMGKTRPHEAAPGTIRGDFGVTVAKNIIHGSDSLESAEREIAIFFKEEELVDYSKLMNEWIY

SEQ ID NO: 27635 - protein, 201 aa, Oryza sativa (japonica cultivar-group)
MSPPPREAVVEEEEEDEPETATLRVPLGRLLLEEREFRARQRESSGTSPVQPQRRRPDDEGELEGVPPESYCLWAPGGQPSTTPASPRRCRKSGSTGSVLRWRRISERLVRRSHSDGKEKFVFLNAPGGGAPSPHPPKDNDDANGGGSVGKGDAGRHGWSYYSKGGGGGSGGRRRSYLPYKQELVGLFANVSGLRRSYHPF

SEQ ID NO: 27636 - protein, 371 aa, Yarrowia lipolytica CLIB122
MSNNLASLINEELQRATPTPAQRLNVIEQAISRRVEAEYKDDIIAHMATMQQQTLPEASMMDLQPELEWHMRPYLLDFIVETHVTLRLQPQTLFLAINLIDRYCSKRVVYKKHYQLVGCTCLWIAAKYEDKKSRVPTISDLKHMCCGAYEEDMFCQMEGHVLNTLEWTVGHPTTDSYLDLFLGPESQQVTQTIRHVSRYLCEIALYPRTFFSFAPSLVASCARTLAYHILGIPCPNPNMHSSIYPSSAGGNSAEMHCLSTLAQHMQQPSRAVQKKYSRQSYCNAAQIVQSFVSQAANSNPTAIPNPATPPPTLSAPHSPASSIHTTFSEASTPSSAYFPISQQNSPANVKQHFSPQVYSMSNLSNVSVNYR

SEQ ID NO: 27637 - protein, 111 aa, Prochlorococcus marinus str. NATL2A
MTTIFDKILSGEIPCDEVFSDNKCLAFKDITPQAPTHILIIPRKPIPSLQDIKKEDQELLGHLLLKGTEIANAAGLESWRTIINTGEEAGQTVFHLHIHIIGGRKLSWPPG

SEQ ID NO: 27638 - protein, 182 aa, Pseudomonas syringae pv. syringae B728a
MTFDQSNFKSLIRPVVDFPKPGVVFRDITPLFQSPKATRQVIDSFVQRYIDAEFSHIGVMDARGFLIGSVVAYQLNKPLVLFRKQGKLPADVLSEAYQTEYGEAYLEVHADSLCEGDSVVMFDDLIATGGTLIAAANLIRRMGAEVYEAAAIIDLPELGGSKRLNDLKIPTFCLTEFALDEQ

SEQ ID NO: 27639 - protein, 246 aa, Aspergillus oryzae
MFRVAAPTGAKLRIENLHYDITESDLEDLFTRIGPISNLSLVYDRAGRSEGVAFVTYERPSDARTAISEFDGANAKGQPIRVTLVSTGGGRRDRNPFDNVERPKGSLFDRVERPRDRDSRSLSPGSGHESADDGARRRRGRRGGGGRYRRSDVSKPAPEHIDRYVPGQRSPARRPANGRRQGQGESRRAPAARPKKTQEELDQEMDDYWGTANTGADKETVPVEPQQVAPATAAATAGDDDVDMIE

SEQ ID NO: 27640 - protein, 320 aa, Schizosaccharomyces pombe 972h-
MELMARFLERYLHFAPTNTEPPGTLIWFLGHSYKIEDSQWPEKFLYDSFSLITITYRSGIEGLENMTSDTGWGCMIRSTQTLLANCLRICYPEKQLKEILALFADEPSAPFSIHQFVTMGKTLCDINPGQWFGPTTSCSCVARLSDQNPDVPLHVYVARNGNAIYRDQLSKVSFPVLLLIPTRLGIDSINESYYDQLLQVFEIRSFVGITGGRPRSAHYFYARQNQYFFYLDPHCTHFAHTTTQPASEETFHSATLRRVAIQDLDPCMIFGFLIRDEEEWHSFEANQKYFADIVQIFDSEPQPVETHDDFVLDENVEDHL

SEQ ID NO: 27641 - protein, 509 aa, Prunus cerasus
MTDRRAQDNAVSGQPLLKKKPKRNLYAIGCAILASMTSILLGYDIGVMSGASIYIQKDLKISDVEVEILIGILNLYSLIGSAAAGRTSDWIGRRYTIVFAGAIFFTGALLMGLATNYAFLMVGRFVAGIGVGYALMIAPVYNAEVSPASSRGALTSFPEVFVNIGILLGYVANYAFSGLPIDLGWRLMLGVGVFPSVILAVGVLSMPESPRWLVMQGRLGEAKQVLDKTSDSLEEAQLRLADIKEAAGIPEHCVEDVVQVPKHSHGEEVWKELLLHPTPPVRHILIAAIGFHFFQQLSGIDALVLYSPRIFEKAGITDSSTLLLATVAVGFSKTIFTLVAIGFLDRVGRRPLLLTSVAGMIASLLCLGTSLTIVDHETEKMMWASVLCLTMVLAYVGFFSIGMGPIAWVYSSEIFPLKLRAQGCSMGTAVNRIMSGVLSMSFISLYKAITMGGTFFLYAGIATVGWVFFYTMLPETQGRTLEDMEVLFGKFWRWREGYALLRNKRAVVC

SEQ ID NO: 27642 - protein, 177 aa, Triticum aestivum
  misc_feature (51)..(51): Xaa can be any naturally occurring amino acid
  misc_feature (83)..(83): Xaa can be any naturally occurring amino acid
  unsure (1)..(177): unsure at all Xaa locations
MAAGGDAGEKKMITLKSSDGEEFEVEEAVAMESQTIRHMIEDDCADNGIPXLPNVNSKILSKVIEYCNKHVQAKPADGAAAGXAGAGASDAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 27643 - protein, 435 aa, Schizosaccharomyces pombe 972h-
MNILQGSEAPLSYEEIASRAGAFDFNKNIPLKNWLRTSTTISKQAHVYVSEHDYSNGVFLLFRYCELFMKCQKHPDAAAYKKELFDYYQGVRNALEEIELIKPIVKEQYEQYQCQKNDLDDLKKLSMKDSQPSLEKPVSYVDEPILEQWALSDLQILPPSSTDLLSPDSQKLSKSSSDLPQFDYPSLNSSPTFNSNLPISSSRFEKTSLSDSKLVSPEPLDDNKDIQFIKKPIYTRTSEPRPKPAGTFKIHAYTEGGKPLRTIYLPKLLKKVFLDVVKPNTKKNLETCGILCGKLRQNAFFITHLVIPLQEATSDTCGTTDEASLFEFQDKHNLLTLGWIHTHPTQTCFMSSVDLHTHCSYQLMLPEAIAIVMAPSKNTSGIFRLLDPEGLQTIVKCRKPGLFHPHEGKVYTMVAQPGHVREINSKLQVVDLRVK

SEQ ID NO: 27644 - protein, 144 aa, Triticum aestivum
VSDIVGPNGLVYAVEFSHRSGRDLVNMAKKRTNVIPIIEDARHPAKYRMLVGMVDVIFSDVAQPDQARILALNASYFLKNGGHFVISIKANCIDSTQAAEAVFASEVEKLKADQFKPSEQVTLEPFERDHACVVGGYRMPKKQK

SEQ ID NO: 27645 - protein, 360 aa, Glycine max
MLGVIRHKSIRPAFSAIRHLSSAAKEITVREALNSALDEEMSADPKVFLMGEEVGEYQGAYKISKGLLDKYGPERVLDTPITEAGFTGIGVGAAYYGLRPVVEFMTFNFSMQAIDHIINSAAKSNYMSAGQISVPIVFRGPNGAAAGVGAQHSQCYASWYGSCPGLKVLSPYSSEDARGLLKAAIRDPDPVVFLENELLYGESFPVSAEVLDSSFCLPIGKAKIEREGKDVTITAYSKMVGFALKAAETLAKEGISAEVINLRSIRPLDRSTINTSVRKTNRLVTVEEGFPQHGVGAEICTSVIEESFGYLDAPVERIAGADVPMPYAANLERMAVPQVEDIVRAAKRACYRSVPLAASA

SEQ ID NO: 27646 - protein, 398 aa, marine gamma proteobacterium HTCC2143
MLLKQAKPKIVWSTALLLGITGLTALIAVPWYELTVGFEWTHWLAFTIFAASNGLAITAGYHRLWAHNTYKARPVMRLLLALLGAASLQNSILVWCSQHRRHHRHVDDNQNDPYSANLGLWFSHIGWMLREYPNGADDFSNVKDLQRDKIVQWQHKHYYSIALIMNIAPPLILGAITGQYLAYFLLMGVLRLVYSHHTTFFINSLAHFWGRQPYTSDNTARDNDFLALLTYGEGYHNYHHIFQNDYRNGIRWFHYDPTKWLIKASSWVGLSYDLRVTPKFKIRQAMVTRQLEIANDKLTNPTLINTIKQRIGTIEYVQWRAAIDKQMAHEQQQLTELMNEWKTIHARWVLIKREQLAVAKQSMEASLDFHNLKHKLKELEFSLVQQYRRVSYVNGVLS

SEQ ID NO: 27647 - protein, 693 aa, Photobacterium profundum SS9
MYFRKRPSSRFLTFESFEFFGEINMEQNGLSRKVLANAIRALSMDGVQQANSGHPGAPMGMADIAEVLWRSHMNHNPQNPQWADRDRFILSNGHGSMLIYSLLHLTGYDLSISDLKNFRQLHSKTPGHPEYGYAPGIETTTGPLGQGLTNAVGMAIAEKAMADQFNRDGHKVVDHHTYTFLGDGCMMEGISHEASSLAGTLGLGKLVAFWDDNGISIDGKVEGWFTDDTPKRFEAYGWHVIPAVDGHDADAINAAIEAAKAETGKPTLICAKTIIGFGSPNKAGTHDCHGAPLGAEEIAAAREFLGWNHGPFEIPTDIAAEWDAKEAGSTKESAWDEKFAAYAAAHPALAAEFKRRTVGDLPANWEAETSKIIADLQANPANIASRKASQNALEAFGKLVPEFMGGSADLAPSNLTMWSGSKALEAGDFSGNYIHYGVREFAMTAIINGMALHGGFVPYGATFLMFMEYARNAMRMAALMKIQNIQVYTHDSIGLGEDGPTHQPVEQIASLRLTPNMSTWRPCDQVESAVAWKLAIERKDGPTALIFSRQNLAQQPRTDAQVANIAKGGYILKDCEGKPELILIATGSEVELVTEAYAQLTAEGRKVRVVSMPATDTYDKQDAAYRESVLPSDVTARIAVEAGIADFWYKFVGFDGRIIGMTTFGESAPAGELFKMFGFTVENVVNTAKELLA

SEQ ID NO: 27648 - protein, 411 aa, Rickettsia tarasevichiae
DSEFAELKIRGKIFKLPILKASIGEDVIDISRVSSEADCFTYDPGFMSTASCRSTITYIDGDKGILRHRGYDIKDLAEKSDFLEVAYLLIYGELPSSEQYNNFTKKVAVHSLMNERLHYLFQTFCNSSHPMAIMLAAVGSLSAFYPDLLKFKEADYELTAIRMIAKIPTIAAMSYKYSIGQPFIYPDNSLDFTENFLRMMFATPCTKYEVNPVIKNALNKIFILHADHEQNASTSTVRIAGSSGANPFACISTGIASLWGPAHGGANEAVINMLKEIGSSENIPKYIAKAKDKDDPFRLMGFGHRVYKNYDPRAAVLKETCKEVLKELGQLENNPLLQIAIELEASALKDEYFIERKLYPNVDFYSGIIYKAMGIPSQMFTVLFAIARTVGWMAQWKEMHEDPEQKISRPR

SEQ ID NO: 27649 - protein, 316 aa, Photobacterium profundum SS9
MSTKLEQLRALTTVVADTGDIEAISKYQPEDATTNPSLILKAAQIAEYAPLIDASIAYAKAQSNDKTQQVADTCDMLAVNIGKEILKVVPGRISTEVDARLSYDTEGSVIKARQLIKMYNDAGITNDRILIKLASTWEGIRAAEVLEKEGINCNLTLLFSFAQARACAEAGVFLISPFVGRIMDWYKAKEGRDFESSEDPGVVSVTGIYDYYKTYGYNTVVMGASFRNIGEILELAGCDRLTISPNLLQELEDATGEVVEKLIDTNGTKERPAAMTHAEFLWEHNQDPMAVEKLADGIRNFAVDQGKLEVMIAERL

SEQ ID NO: 27650 - protein, 221 aa, Triticum aestivum
  misc_feature (181)..(181): Xaa can be any naturally occurring amino acid
  misc_feature (207)..(207): Xaa can be any naturally occurring amino acid
  misc_feature (215)..(215): Xaa can be any naturally occurring amino acid
  unsure (1)..(221): unsure at all Xaa locations
KPTHHPPQGPSLSSSSSTTLEDRKMERLRTGFDKFKTEVYDKKPDLFEPLKDNQEPTYLLFACADSRVCPSVTLGLEPGEAFTVRNIGAMVPCYCKNKHTGVGSAIEYAVCALKVKVIVVIGHSRCGGIKALLSLKDGEDDSFHFVEDWVRIGFSAKKKVKDECCDLPFEDQCAVLEKEAXRVLQNLSTYPFVKEGVANGTLKLIGXHYDFVSGXFDTWEL

SEQ ID NO: 27651 - protein, 329 aa, Arabidopsis thaliana
MDEKKITMNVRNDELSEESKTLISSLPSDKNSTGVNVCKYQGCWYTPPILQGVLNFQKNFKPQDTDIIVASFPKCGTTWLKALTFALVRRSKHPSHDDHHPLLSDNPHVLSPSLEMYLYLCSENPDLTKFSSSSRLFSTHMPSHTLQEGLKGSTCKIVYMSRNVKDTLVSYWHFFCKKQTDDNIISSVEDTFEMFCRGVNFFGPFWDHVLSYWRGSLEDPNHVLFMKFEEMKEEPREQIKRLAEFLGCLFTKEEEESGLVDEIIDLCSLRNLSSLEINKTGKLHSTGRENKTFFRKGEVGDWKNYLTPEMENKIDMIIQEKLQNSGLKF

SEQ ID NO: 27652 - protein, 138 aa, Rickettsia conorii str. Malish 7
MNIIDRFEQENISKRTANKKIPDFEAGDTVKVTVKIIDRSIEKDGKEKLTERFQAYEGVVIAKRNRGITSSFLVRKISHGEGVERRFMTYSPMVHSIDVVKYGVVRRAKLYYLRNRSGKSARIKERHIPIAKTKAAKA

SEQ ID NO: 27653 - protein, 351 aa, Methylobacillus flagellatus KT
MKIAVLPGDGIGPEIVAQAVKVLKALDLDLELQEAPIGGAGYEAAGDPLPDATLKLAKEADAVLLGAVGDWKYDTLPRDKRPERGLLRIRKELNLFANLRPALLYPELASASTLKPEVVSGLDIMIVRELTGDIYFGQPRGISTLDNGEREGVNTMRYNESEIRRIAHVAFGIAQKRNKKVCSVDKANVLETTELWRQVMIEVAKEYPDVELSHMYVDNAAMQLIRAPKQFDVMVTGNIFGDILSDEASMLTGSIGMLPSASLDQGNKGMYEPSHGSAPDIAGQDVANPLATILSAAMMLRYTFNDEANASRVENAVKKALEQGYRTADIWTEGTSKVKCSEMGDAVVAAL

SEQ ID NO: 27654 - protein, 549 aa, Prochlorococcus marinus str. NATL2A
MFSTEFTQLTVKLNSPFTDQKPGTSGLRKSTLQFEETHYLESFIESILCSLPGVRGGVLVVGGDGRYGNKRAIDIIIRMAAAHGIQKVITTVDGILSTPAASNLIRINKAIGGIILSASHNPGGLEGDFGVKLNGSNGGPASESLTDEIYNYSKNLKEYKIIKCQSNNSFSLGKYKLASMIVEIIDGIDDYLDLMKRIFDFDLISSYINNDFPIVFDALNAVTGPYAKRLFVDHLGATAETVRNGIPLEDFGGLHPDPNLTYAKDLADLLLKGNLFSFGAACDGDGDRNMILGRGCFVNPSDSLAILAANYDCVPGYAKGLSGVARSMPTSSAVDVVAKHLGINCFETPTGWKFFGNLLDANQITLCGEESFGTGSDHVREKDGLWAVLFWLQILASKKKSVSEIMKNHWLFFGRHYYSRHDYESIPTEVANSLYSRLSNMLPTLIDESFAGRTIKNADDFSYTDPVDSSITLNQGLRILLDDGSRVLVRLSGTGTQGATLRVYFESFVPSDGDITQDPQLALDPLIKSIDSLAEISKRTGMSAPTVIT

SEQ ID NO: 27655 - protein, 289 aa, Aspergillus oryzae
MARFRPSNILGDPFALATISISILAWVIAFISSIVSAINARGYPTYSWWGVAYSLCIILGMTAVFGTDTGSVYGVAIVGYLSAGMVITTLGVNSLVYRSDSASQAAGAGFILMSMVIVIWIFYFGSTPQASHRGFIDSFALQKEHPGAYGNGRPMSTAFGNRPETTSSQAPQMYTSAQLNGFETSSPVSGYPGGAPGSENRSSSQPRFGNPSNANLTANGNENEVPQPTEYPYRAKAIYSYDANPEDANEISFTKHEILEVSDVSGRWWQARKSNGDTGIAPSNYLILL

SEQ ID NO: 27656 - protein, 500 aa, Arabidopsis thaliana
MAHIWLLPLIFLVCILLAVFNHKKHPKYRQFPCPPGFPIIGNLHQIGELPHQTLWKLSKKYGPVMHLMLGRVPTVVVSSSDTARQVLRVHDLHCCTRPSLSGPRELSYNYLDIAFSPYDDYWKEVRKLCVQELFSTKQVHSIQPIKDEEVKKMIDSIAESASQKNPVNLNNKCLELTVSVVCRTAFGVSFEGTVLNSDRFNKIVREALEMLGSFSAADFIPYVGWIIDVLTGLQGRRERSKRDLNAFFEQMFDLHKEGKKEGNEDFVDLLLRLEKEEAVLGNDKLTRNHIKAILLDVLLAGIDTSAITMTWAMTELARNPRVMKKVQSEIRTQMGNRSMISFEDMDQLEYLKMVIKETWRLHPTTPLLLPREAMSEFDINGYTIPVKTRLHVNVWAIGRDPDTWKDPEVFLPERFMDNNIDAKGQHFELLPFGGGRRICPAIYMGTTMVEFGLANLLYHFDWKLPEGVEVKDIDVEEAPGLTVNKKNELLLVPEMRRSCG

SEQ ID NO: 27657 - protein, 798 aa, Aspergillus oryzae
MAAAFDDEDLSVPLPSYDHDRRRERASGATSPNSNFAGMTMPPPSRPIGRGGDPSMQSPATTRDMQRLDQYQTVKVLGEGSFGKVKLAIHQPSGRQVALKIISRRKLLSRDMVGRVEREIQYLQLLRHPHIIKLYTVIATKTDIVMVLEYAERELFDYLVKRGRCNDAEARKFFQQIICAVEYCHRHKIVHRDLKPENLLIDSEKNVKIADFGLSNIMTDGNFLKTSCGSPNYAAPEVISGKLYAGPEVDVWSCGVILYVLLVGRLPFDDDYIPALFKKIAAGNFHMPPYISSGAARLIRSMLQVHPVHRLTIPEIRQDPWFQKDLPKYLQPPPEEFIATGVDPNKAIDPRKIAPGKPISVQHKIHQVAIAKLERNMGYGREDIEDALKNPEPSAIKDAFFIIVENEMMQTNSPTDENLMPPTPLPPSDRTSLSSAAAGRTTAAHSQGTRAGPPTRTRSGSQRQPFQLHQPSESDDLETSRVSHVRILPTSLPYVHDQLMEQRERERRARAADRLAEEQARSGSDALEDPHQSGLDGRSLEEQEATAKALKPHSRSIVDLDKLRLEPPEARNAPHQPRKTRKWQFGIRSRNQPYEAMLYLYKAIAAQRGRWEILPAESGTQIGSQSPDEPTPLQSKYPDLPSDYYIPKDPWFIRARLLKEGVKAPGSSGSVHSSRSDISELRRRFNLTGGASSVDEKSHSPSEHWSTSGPSSASQHHSIPRVAYGVWVFVDIQLYQLEENNYMVDFKCDGYQNVIRAESDTEWHPISKRFRNKEKEITSPYPFLDVASDLVAQLAVAS

SEQ ID NO: 27658 - protein, 92 aa, Brassica napus
  misc_feature (28)..(28): Xaa can be any naturally occurring amino acid
  misc_feature (34)..(35): Xaa can be any naturally occurring amino acid
  misc_feature (45)..(45): Xaa can be any naturally occurring amino acid
  misc_feature (47)..(48): Xaa can be any naturally occurring amino acid
  misc_feature (53)..(53): Xaa can be any naturally occurring amino acid
  misc_feature (57)..(57): Xaa can be any naturally occurring amino acid
  misc_feature (60)..(60): Xaa can be any naturally occurring amino acid
  misc_feature (71)..(72): Xaa can be any naturally occurring amino acid
  misc_feature (76)..(78): Xaa can be any naturally occurring amino acid
  misc_feature (80)..(80): Xaa can be any naturally occurring amino acid
  misc_feature (82)..(83): Xaa can be any naturally occurring amino acid
  misc_feature (88)..(88): Xaa can be any naturally occurring amino acid
  unsure (1)..(92): unsure at all Xaa locations
MSGRGKGGKGLGKGGAKRHRKVLRDNIXGITKSXXRRLGRRGGVXRXXGLIYXETRXVLXIFLENVIRDAXXYTEXXXRXTXXVMDAXYASE

SEQ ID NO: 27659 - protein, 130 aa, Pyrococcus horikoshii OT3
MTLLDPLANALSHITNSERVGKREIYIKPASKLIGEVLRVMQKYGYIGEFEFIDDGRAGVYRVQLLGRINKAGAIKPRFPVKATEYEKWEKRFLPAFEFGILIVSTSQGVMSHKEARDRGIGGRLIAYVY

SEQ ID NO: 27660 - protein, 345 aa, Arabidopsis thaliana
MTATNKQVVLKNYVSGFPKESDFDFKTTTVEFKLPGGSNSVLVKNLYLSCDPYMRIRMGKPDPSTAALAQAYAPGKPIFGYGVSRVIESGHPDYKKGDLLWGIVGWEEYSVITPMTHMHFKIQHTDIPLSYYTGLLGMPGMTAYAGFYEVCSPKEGETVYVSAASGAVGQLVGQFAKMMGCYVVGSAGSTEKVNLLKTKFGFDDAFNYKEEPDLSAALKRCFPTGIDIYFENVGGKMLDAVLLNMNPHGRIAVCGMISQYNLENQEGVHNLSNIIYKRIRIQGFAVFDFYEKYSKFLDFVLPHIKEGKITYVEDVADGLEKGPEALVGLFHGKNVGKQVVVIARE

SEQ ID NO: 27661 - protein, 369 aa, delta proteobacterium MLMS-1
MSFAQFDFDATLTANIAACGYQAPTPIQTQAIPEIRRGRDIMGLAQTGTGKTAAFVLPLLQKLSAGPRGRVRAVIVAPTRELAEQIHVNIGELGRQTGIRSVAVYGGVSKFGQLKAFKAGVEIIVACPGRLLDHLDSRDVNLGAVEMLVLDEADMMFDMGFMPAIKKLLKYLPAKRQNLLFSATMPAEIRHLADSILKDPARVQINHTQPTALVAHKLYRVEKQGKGALLKQVMQESAFSSALVFTRTKHAAKKLALNLEKAGHRAVALQGNMSQNKRKAAMEGFKQGRFNIMVATDIAARGIDVAGISHVINYDMPATVEAYTHRIGRTGRAERNGEAYTFATAEDKVIVRQIERAIGSRMITLETPR

SEQ ID NO: 27662 - protein, 436 aa, Bradyrhizobium sp. BTAi1
MKHVPMPDLQMGGGGRLRARLRTAFLVTLAIVSFLVIYSWWHIFIVIPPGFAGVRYSLFFGGTSDNMVYNEGLHLQWPWNSVRIYDTRLISRSYKVEALSQGGLTISVDVTVFATPATGKLAELNRQLGPDYFEKIVEPAISGGVRDVVGKITGDQLYLLSNQELESRVLSEAISEFPVDLVRLVKVIIRRVELPQQINEAIDHKLAEEQRAQAYMYILQSVEGEAARRRIEAAGIRDFQTIVGSSLTPALLTWQGIEATLQLAKSNNAKVVVIGNSSKELPLILGADMFKTNEALSGEKQDAAVGAAQPKPADAAQSTAPAQPAASAPASSSASPSPSTGPQSAVSPQPAAPLQPASPPQSAAPAQAPPQTLLYPQATAPSPPASRQFGVPRAQTGRGQPSPWSAPPRPTVLPSDPFGLPIQRNPLGSEPGRTAQ

SEQ ID NO: 27663 - protein, 340 aa, Xanthomonas campestris pv. vesicatoria str. 85-10
MKALVKREANKGIWLEQVPVPTPGPNEVLIKLEKTAICGTDLHIYLWDEWSQRTIRPGLTIGHEFVGRVAELGSAVTGYQVGQRVSAEGHIVCGHCRNCRGGRPHLCPNTVGIGVNVNGAFAEYMVMPASNLWLIPDQIPSELAAFFDPYGNAAHCALEFDVIGEDVLITGAGPIGIIAAGICKHIGARNVVVTDVNDFRLKLAADMGATRVVNVSKTSLKDVMADLHMEGFDVGLEMSGNPRAFNDMLDCMYHGGKIAMLGIMPRGAGCDWDKIIFKGLTVQGIYGRKMYETWYKMTQLVLSGFPLHKVLTHQLPIDDFQKGFDLMEEGKAGKVVLSWN

SEQ ID NO: 27664 - protein, 537 aa, Schizosaccharomyces pombe
MEPEYVSFSDKDTKSILNESKSSLKDVKPSLEEKSYITPGLVDDVEPKGKNFVVRFFDDFKPAKATGEDGTALKRSLKSRHMQMISIGGAIGTGLYVGSGSSLADGGPASVIINYSLIGIMMFFIVYALGEMAVAYPVAGGFNTYATRFIDPAWGFAVSWNYFINYFVTFPLELTTCAITFRYWTDINSAAWISIFLVVIIIVNLFGVRAYGEVEFILSTVKVVATFGFIILAIIINCGGVPTDHRGYIGGSIIKHKPFRHGFKGFCSVFTTAAFSFSGTEVIGLAAAEVDNPQKALPHAVKQVFWRIAIFYVVSLILIGLLISPDDPNLMGNGSTSVSPFVLAIKEANIKGLPSVFNAVIIISVVSVTNSSTYTAGRTLHGMANLKQAPSFFKYTDRLGRPLLAMIVVLLFGFFAYINEADKNGNDVSDTVFNWLLALSGLSNFFTWGSICLCHIIFRLAFKKQGHSLKELGFVSPMGIWGSCIGLFFNILCLMAQFYVSLFPIGGKPNANDFFQGYLAAPVTLAFFIGYKIYDRS

SEQ ID NO: 27665 - protein, 579 aa, Cryptococcus neoformans var. neoformans B-3501A
MVKTRAPDREHIPPLSNFDIDLHPDTVGYVQDSQALADAIGSNGLKDVFASPIVFMAAFSACMGGLLFGFDQGILSIVLTIPQFLKVFPETDISVTSSAGLNKGVMTALLELGAFLGAMQAGFISDKISRKRTIMVGACWFVVGSALQAGSKSFAMLVIGRFIGGIGVGVLSSTAPTYISEIAPPNVRGAFLALEGSSIVIGIVIMFYITYATRHILDSWSFRLPFTIQVVPCIALGIGLWLLPYSPRWLATVGRDQDALDSLVRLRQLPSSDPRLQAEWITIRAEAIQQREVVISAHPHLQGESGFVQDFKLEMHAWIDMFKPNIIARTMIGVMLMVFQQLQGINALIYYSPTLFEQLGLDYEMQLTMSGVINVSQCVATIVAFFLLDRIGRKPPLLIGSVVNAICHFTVAGLIAKYSDNWAAHQSAAWAGVGLLITFMFFFGIGWSPVPWALPAEIHSSSRRAKGVAITTCSNWFFNFIVGLITPPMLQSIRYGTFIFFGAFAVMSGIWAWFLCPETKGLTLEAVDQLFHNHAAQEELRQKHDIISRMIGMELTTTPQPELVDDEKKIYTVQHLESV

SEQ ID NO: 27666 - protein, 323 aa, Oryza sativa
MADEHDWWNSPCSARTGDDEAACSTADADESAVGSTPMSFGHGGQPASLSDAAASSSSSSFLLAGQHMDYWTQDFMGGRAAAAATASFDTLLQLQLQGGDAASRRLLLGDHAAAPPRHLVVPGAPYGGGGGDDTAAPPRGLSPTPYEAADNLQQQQSFPGGHHVVSNTDRLHDHHQDAGSPSPATRSSPGSPAAAKKPRIEAPSPMPTFKVRKEKLGDRITALQQLVSPFGPRVRASVLHEAIEYIKFLHDQVASLSSPYLRCGRPVQLQHQQGSHKVNGNCEGKQLDLRSRGLCLVPVASTYTVASETATEFWHPTFGGTFR

SEQ ID NO: 27667 - protein, 274 aa, Crocosphaera watsonii WH 8501
MTVAASKKLSYDWTIIIYMASIHLVALLAFLPGNFSWQAVGVTLLLYWVTGALGITLGFHRLVSHRSFKSPKWLEYLLVFFGTLACQGGPIQWVGLHRIHHKYSDTEPDPHDSNKGFWWSHMAWMLHQIPADNDVPRYTKDINEDPFYNFCQSFMIPIQIVLGLALYFLGGWSFVIWGIFVRLVMVFHFTWFVNSATHKFGYQSHESNDNSRNCWWVALLTFGEGWHNNHHAYQYSARHGLAWWEIDITWMTIQVLQFLGLAKNVKLAPVADKK

SEQ ID NO: 27668 - protein, 177 aa, Arabidopsis thaliana
MVCLASRTGRQFQRYNKGRRQVVGCVPYRFKLSNDGKISDEVEVLVISSQKGHALMFPKGGWELDESVEEAASRECLEEAGVLGNVEHQLGKWDFLSKSRGTYYEGLMFPMLVTEQLELWPEQHVRQRIWMNVTEAREACRDWWMKEALDVLVERLSSPMNQPKEEKTMSISIETMC

SEQ ID NO: 27669 - protein, 349 aa, Thermoanaerobacter tengcongensis MB4
MKALLLAGGLGTRLRPLTDDLPKPMVPIMGKPLLERIILNLKKSGVDEVVISTHYKSDYIENYFKGKSKELGVKIHYVTEETPLGTGGAIKNAEKFFDDTFLILNSDIVSDIDYADLVKYHKRRRAQVTIASIEVRDTSQYGVIEFDSKGFITAFKEKPKPGESNSKYINAGVYVFEPEVLKEIPANTQVSVERETYPLLLSKGYKMAIYKFTGYWMDIGTVDKYKKVHEDILKGKSRFVAGLSTRGIILGENVKIHPTASVIGPAYIGDNTEVDAYATVGPYTVIGSNCRIGQESKVSNSVLWDNIKVRRFARLENSVVTSECVVEVNMEIKNTVFTANKLADITLTP

SEQ ID NO: 27670 - protein, 66 aa, Oryza sativa
  misc_feature (23)..(23): Xaa can be any naturally occurring amino acid
  unsure (1)..(66): unsure at all Xaa locations
MMQLGCYCGIQSCSGIFKSGYPXRRGRAILQAVTHYSDPKILAEVSSGIGQAMGGINLSHPNVDRF

SEQ ID NO: 27671 - protein, 429 aa, Pseudomonas syringae pv. phaseolicola 1448A
MADKKAQLIIEGAAPVELPILTGTVGPDVIDVRGLTATGRFTFDPGFMSTASCDSKITYIDGDNGILLHRGYPIEQLAEQSDYLETCYLLLNGELPTAEQKAQFVAVVKNHTMVHEQLKTFFNGFRRDAHPMAVMCGVVGALSAFYHDSLDINNPQHREISAVRLVAKMPTLAAMVYKYSMGQPMMYPRNDLSYAENFLHMMFNTPCEIKPISPVLAKAMDKIFILHADHEQNASTSTVRMAGSSGANPFACIAAGIAALWGPAHGGANEAVLTMLDEIGDVSNIDKFIAKAKDKNDPFKLMGFGHRVYKNRDPRATVMKQTCDEVLKELGITNDPQLELAMRLEEIALTDPYFIERSLYPNVDFYSGIILKAIGIPTSMFTVIFALARTVGWISHWKEMLSSPYKIGRPRQLYTGNVQRDIVALQDRK

SEQ ID NO: 27672 - protein, 392 aa, Methylobacillus flagellatus KT
MSEHLMNTYARQPVTFTRGEGVWLWDTEGKRYLDALAGIAVNGLGHAHPRLVSAISEQAGRLIHVSNVYGIDEQARLAERLCEVSGMDKVFVCNSGCEANEAAIKLARLYGHGKGVESPEIIVMERAFHGRTLATLSATGNRKAQAGFEPLVSGFIRVPFDDLDAVRQVARHNKNVVAILLEPIQGEGGINLPRDSAAYLTGLREICDANGWLLMLDEVQSGMARTGTWFAFQHTDVKPDVMTLAKGLGSGVPIGACLAHGPAAEIFTYGKHGSTFGGNPLACSAALATLDIIESEGLLAHAEKLGNDIREAFTVSLQGVAGVTVIRNAGLMIGIELDRPCAELVGQALEAGLLINVTAEKVIRLLPPLIMSEQEAQQVVDILTPLIKKLLA

SEQ ID NO: 27673 - protein, 359 aa, Arabidopsis thaliana
MSSMYHDYDHLTASGKGLWSKFYGLVDAAVLLYDEIQRRGKIVSEEESQKRIFCLFPRRKRSSLVKRQQKLNGGFISFTSSSLIDLNQLPTDSEIEDPQTSDSQMKTLQNSSSEPCTSLVLFDYKTAESEKMEAKTLQNPSSELCSSLVLSDYKMAESEKMETKDPPNPLSLCLTGNTSRKRRAVEERKRTGGFKKAKVAPFPGTARDTPKWLVKVMRDMKEAKDAKLIFEKTLFVTDINPTQNRLSMPFNNLLQNDFLTSVESRIIKEDINNNKKIGVGAILVDQRSVKWGVMLKRWELKKESGKGSWNYNLICGWNDVVEANGLKEGDNISVWSFRCRGVLCFAMEQSSSSLALCLC

SEQ ID NO: 27674 - protein, 378 aa, Oryza sativa (japonica cultivar-group)
MGGLSMDQAFVQAPEHRPKASVAEADGIPVIDLSPLLAAGDGDADGVDALAAEVGRASRDLGLLRGVAPRCARGGVGARGGGAEDVLRAAAGAEGGRGAERGGADGVLRVRAHQERQGLEGGVRPRPAPDAAAADDRRGRRRPGVRQQVARRPAGIQVRSPHRSIVFFILASIQFNLIEFLSREAMEEYGEAVEELAFKLLELIARSLGLRPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 27675 - protein, 458 aa, Bacillus anthracis str. A2012
MGYVMNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRCPEGLTEEQYDDFMIEEFKNFFISEVAPETIAAVVMEPVQGEGGFIVPSKKFAQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKTPDKTLTANLCTEANKRGLLLLSAGTYGNVIRVLMPLVITDEQLEEGLTIIEESLQICYEKANTARV

SEQ ID NO: 27676 - protein, 126 aa, Azoarcus sp. BH72
MSRSIVSTPNAPAAIGTYSQAVKAGGTVYLSGQIGLDPATMQLVDGFEAQTVRVFENLKAVAEAAGGSLADVVKLTIYLTDLANFAKVNEIMARYFAEPYPARAAVGVKELPKGAVVEADAILVLG

SEQ ID NO: 27677 - protein, 647 aa, Bradyrhizobium sp. BTAi1
MCGLAGVWCWDTPIDRPAIARALGLLDHRGPDGNGLWISEDGKVALGHTRLSIIDLVTGEQPLSHPNGKLQLVVNGEFYDYERIRNDLTARGARFRTRSDSEIALWLYDESGTRCFADLNGEFAFILWDAGAGRLIAARDRFGIKPLFYAVQSGRILLASEIKALLAMGVPAQWDVEGYLDAAHVLQNGTLFSGIRQVPPGCYLSATRHGITIQRYWDAPFASALSPIEDEHGALDQIRAQMSRATRWRMRADVPVAAYLSGGIDSMSVLALAAATTNRAPDAFTIAYEDAAYDESHRAESFATQLGTRFHRVPVNGAALADHFATSLWHSETACFNPHGTAKFILSKAVRDAGYKVVLTGEGADEIFAGYAPSRVDALGGSAAMQAMIATRDRATYAVTPQHTATDQLPLIAQRFGTVPTWLRHQMAHLLGVADLLRDDLRTAWSTDRPLAAFLKYLEPWTVPALDTVDLGIALMLKTTLPNYVLVTLGDRMEMAHSIEGRLPFLDHQVVELAWRLPSHLKIRDGVEKFALRQAMRNLLPADAVDRQKHPFIAPPTATDAKHPFGAMIRDVLHGPALAALPFFEPRKVRKLIDRLTSLPPEDRLRLEPLLVEIASLCIIHDLFKMSSSSDPSAQLSIQMPSTEALA

SEQ ID NO: 27678 - protein, 240 aa, Asparagus officinalis
MDQPDLSQVGPVGLTQLSPLQIQQIQAQIQLNHQHQLMVSRTLQARNYHNTLGVKPQPMKLQASVAAPQSKPTKLYRGVRQRHWGKWVAEIRLPKNRTRLWLGTFDTAEEAALAYDKAAYKLRGDYARLNFPNLKHTHLAGNPLHSSVDAKLEAICQTLESPGKKKVSTGSKPEPVVSSPTVETEEESSSSSSVTGATNSPVSEIESLDFNEVPWDETEDFVLRKYPSYEIDWDSILSSA

SEQ ID NO: 27679 - protein, 569 aa, Kluyveromyces lactis NRRL Y-1140
MNDTSEHSSDVSPIIFDDISQSKLKDSSENETTDRIIIKPVNDEDDTSVMITFNQKISPFILILTFTASISGFMFGYDTGYISSALVSIGTDLDNKALTYGDKEIITAATSLGALISAVFAGISADIFGRKPCLMFSNILFVIGAALQVSAHSFWQMAVGRLIMGFGVGIGSLLAPLFISEIAPKHIRGRLTVINSLWLTGGQLIAYACGAGLNKVHNGWRILVGLSLIPTVVQFTCFSFLPDTPRFYVIKGNYKKAAEVLQKSYINAPQELIDQKIRELSDLNEAIPGKTPVHKFFNTVKELHTVPCNFRALVIGCALQGIQQFCGWNSLMYFSGTIFQTVGFENSTAVSIIVAGTNFVFTLVAFFAIDKVGRRAILLIGLPGMMVSLVMCAIAFHFLDIKFTGAGESEVSNGGFSSWGIVVIVFIMVYAAFYALGIGTVPWQQSELFATSVRGVGTSYCTATNWAGSLIIASTFLTMLQNITPTGTFSLFAALAAVSTVFCYLCYPELSGLELEEVQTILSDGFNIKASKQLAKKRKQQNSEMQRRFREKDMEAYQKDKPSDELLES

SEQ ID NO: 27680 - protein, 699 aa, Xanthomonas campestris pv. vesicatoria str. 85-10
MTSSSSSSRRDFLKRVAALTAAGALPPSIGRALALPANARTGTLRDLEHVVILMQENRSFDHYFGALRGVRGFGDPRALQLRDGHPVWSQPTSDGRRLLPFAFDSQHTCAPLIKSLDHSWKAGHGQEPARWAEYDAWVPYKGELTMGYFQRHDIPYYHALADAFTICDGYYCSLHGPTNPNRMYLFTGTSGPSVGNVGAQAVTNADDGNWTADMARDKPGYAALQWTTYAQRLQAAGVDWRVYQEYDNFGCNSLAYFSHYRDLRTDDERYRRARACVPGSTADNAATTQAEHLVAAIAADVQANRLPQVSWVIPPTAYCEHPEAPPAYGESLVARLIDALTANPEVWAKTALIINYDENDGFFDHVPAPLPAVDARMGRSNVDTRGEVYDGVPIGLGIRVPMLVISPWTRGGWVNSQVFDHTSVLRLLERRFGVAEPNISPWRRAVSGDLTSVFDFRKPDDSALSALPSVDDYRARTAAVRDKPLPSVPAAAAMPRQEPGQRPARALPYALQVHARVQEGAPVQLQFVNSGAAAAAFNVYSSAASGGPWYYTVLPGTQLEDAPVGATHAGAYALRVHAPNGFLREFAGQVPSASAPSAAPWVEARQEGDALVLEIGNAGQRACTVQLRALDYADPDARTLPLAAGQRETIRLALAASDHWYDLVVEQPGSAFRRRLAGHLETGRPSRSDPAFGRCAQTS

SEQ ID NO: 27681 - protein, 502 aa, Bacillus sp. TB-90
MMRLKQLNEMSASEFIHLLGGVFENSSWVAERAEPNRPYSSFQSLYNKMVEIVETASDNEQLKLIQMHPHLGTNVKITDFSQEEQKHAGLNELTKDEQNHLILLNQKYKDKFGFPFVMAVRGKIKQEIFRTIKERLQNNHQTEFKQALEEIKKIAMFRLQEIFREGENNSMTKHKERVMYYGKGDVFAYRTYLKPLTGVRTIPESPFSGRDHILFGVNVKISVGGTKLLTSFTKGDNSLVVATDSMKNFIQKHLASYTGTTIEGFLEYVATSFLKKYSHIEKISLIGEEIPFETTFAVKNGNRAASELVFKKSRNEYATAYLNMVRNEDNTLNITEQQSGLAGLQLIKVSGNSFVGFIRDEYTTLPEDSNRPLFVYLNIKWKYKNTEDSFGTNPENYVAAEQIRDIATSVFHETETLSIQHLIYLIGRRILERFPQLQEVYFESQNHTWDKIVEEIPESEGKVYTEPRPPYGFQCFTVTQEDLPHENILMFSDEPDHKGALK

SEQ ID NO: 27682 - protein, 126 aa, Glycine max
  misc_feature (13)..(13): Xaa can be any naturally occurring amino acid
  misc_feature (25)..(25): Xaa can be any naturally occurring amino acid
  misc_feature (27)..(27): Xaa can be any naturally occurring amino acid
  misc_feature (47)..(47): Xaa can be any naturally occurring amino acid
  misc_feature (60)..(60): Xaa can be any naturally occurring amino acid
  unsure (1)..(126): unsure at all Xaa locations
SSMICSPAGATVXRGGGGMVAPFAXLXSMGGLPTGETRADITCVASXGGRAPCFFFWPPXGAKKGEILSYLPEVGDAQLAKEVESLLRKGWIPCLEFELEPGFVSRAPGRAPRIYDGRSRSLGKLA

SEQ ID NO: 27683 - protein, 633 aa, Phalaenopsis hybrid cultivar
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDKEMGLIRTQEETGRHVRMLTHEIRSTLDRHTILRTTLVELGRTLDLAECALWMPSRTGLNLQLSHTLNNQIPVGSVVSINLPVVNQVFNSSRAVRIPHTCQLARFQPHTGRYVPPEVVAVRVPLLHLSNFQINDWPELSAKNFAVMVLMLPSDSARKWHVYELELVEVVADQVAVALSHAAILEESMRARDQLMDQNVALDLARREAEMAIRARNDFLAVMNHEMRTPMHAIIALSSLLLETELTPEQRLMVETILKSSNLLATLINDVLDLSKLEDGSFELEVTVFNLHTVFREVVNLIKPIAAVKKLSLIVSLSPDLPSCAVGDEKRLMQTMLNVVGNAVKFTKEGSISITASIAKPDSLRDPRDPEFYPIPSDGHFYLRVQIKDTGCGISPQELPHLFTKFAHAQNGSDKGYNGSGLGLAICKRFVNLMKGHIWLESEGIGKGCTTIFIVKLGISEDPAHRYQHKLLPPIRAGQSEADAFGSKRMPTDLIPLKNRYQRSL

SEQ ID NO: 27684 - protein, 967 aa, Cryptococcus neoformans var. neoformans B-3501A
MAEDNHNEPPPPNIPTPTFPQSKTINTAFARSPTTDSEIEPADEEEGDHRPFNPRTSTTDEHQTLFYQDASHFNVEHHVGRVCRSFAPLALLAIIALAFIPVASATDLDPYTSCPALPQKSTPILSTTGYVFNHVVRFIGLDDSFVGQHLANVKRNLDNTSIIEACMVPVLVLLSGMFAGLTLGYFSVDQTQLQVLAISGTPKHQEYARLIMPVRKNSHLLLTTLILGNMIVNEALPVVMDGLLSGVVSVVVSTAMVVIFAEIIPQSICSRYGLLIGARMAWPVRIMIWIAYPIAWPIAKLLEWVLGAHHGIIYRRGELRELIKMHAAGGEGGGDLDFDTVQITQGALDLARKTVKDSMTAIEQVFMLPIEAKLDYETLGHVVRSGHSRIPVYQMVEVPDIDLSAPTLGPTKTKMVKKVLGSLLVKSCVLLDPEDATPLASIPINAIPSIPFDEPLTNMLNVFQEGRSHMAIVSRRVRRVGPVDPEDAQSAMTAAAGGLRQRFFRRVAGISGNRSFSDGDSSASGEEDLEKGEGGKKKKRRRKNAEKHDRAGSCSSDNHTIVRPISSDDDGLTEADEIKRMAKEQQEAEMKQQRGKDSKKGSLVQAAKLTQLEQSVPADAQLSNDAVENFFDGLEGAPLGIITLEDVLEELIGEEIYDEYDEHGVPRSAASAFVPLEAMLAARKAALARQELAIAQSTPIPPVSDADVEQVVAAPTPGAGRRVKAKIQIPKFSLKKPVSQPGRPRTERLAANETPAATPPADPPCYTNKPDEKSTYSAQIITIPGELDEPPLACAQSDSRLVNRRLSTPLDSGATATPSPQPQYSLSVPGPASAVPTRLLPAGGTVSTPAVIPASHQPSLLNEAIFIGRERKRMAASHPGQVRSQSSGPTVSSKQPTPPISVYDFGIQAAGVNGERVEGQEIVSPRPIAAQQKKIPKFKSVPTPVATPSFGFDPSAESKSSSREEKE

SEQ ID NO: 27685 - protein, 123 aa, Cryptococcus neoformans var. neoformans
AAQIAFFFVFEDTFHYWAHRALHYGPLYKHIHKLHHEFSAPIGIAAEYAHPLEVLILAQGTISGPFLYAVFRNDLHILTVYIWITLRLWQAVDAHSGYDFPWSLRHFLPFWAGADHHDFHHAT

SEQ ID NO: 27686 - protein, 123 aa, Cryptococcus neoformans var. grubii
AAQIAFFFVFEDTFHYWAHRALHFGPLYKHIHKLHHEFSAPIGIAAEYAHPLEVLILAQGTISGPFLYAVFRDDLHIFTVYVWITLRLWQAVDAHSGYDFPWSLRHFIPFWAGADHHDFHHAT

SEQ ID NO: 27687 - protein, 218 aa, Oryza sativa
MDMDSWERLAADARLQGSCFDALIGMEEAEGSEGEEEAAEVACPFCDEEFDGFGLCCHIEDQHQAENRAGVCPICYDAVGMDLVSHITSEHPSFFKGKWRNRRVSHGSHSSTRATLKKDAAYLQYRYGGSTRAASHNTDPDPLLSSFVGNFTDTDLPKDVQQEFRDETDEKSDSLVQKEQKPVESADEPLLPEVKEERTRRSQFVQGLVLSLMFDDIL

SEQ ID NO: 27688 - protein, 708 aa, Oryza sativa
MSLPAISLYTSPPPGAVYSSEFDPSSRGSSPPCSTAPPSTSHRPPAAAGGLSCLFSSPAAAASAPRAPPHDELGALWQDRSDEPAFAGGGGGYSSSPLKWRDLHHHHHHSPVSVFQGPSSSPAASRSPPASWLAGRDRDRERLFAGFVRNALGSCVDYAPALSPRSEVGGGELAFELDENLAEASPACEPCARELLAGAQARHRIFHEELVVKTFFEAEKAHRGQTRASGDPYLQHCVETAVLLANIGANSTVVSAGLLHDTIDDSFIDYDHIFHMFGAGVADLVEGVSKLSHLSKLARDNNTASRIVEADRLHTMLLAMADARAVLIKLADRVHNMKTLEALPLGKQQRFAKETMEIFVPLANRLGIASWKDQLENLCFKHLNPEEHKDLSSKLTKSFDEVLITSAVDKLDRGLRDAGLSYHNLSGRHKSLYSIHNKMLKKNLTMDEIHDIHGLRLVFEKEEDCYRALDVVHELWPQVPGRFKDYISRPKLNGYRSLHTVVMSENVHPFEVQIRTKEMHLQAEYGFAAHWRYKEGTCRHSFVLQMVEWARWVLTWQCEAMNKERPASLGDSDAIRPPCPFPMHSEDCPYSYTRQCDHDGPIFVILLEHDKMSVQEFQANSTVMNLMDRVGTNTPRWSPYRIPMKEDLRPKVNHEPISDLNRKLSMGDVVELTPALPHESLPNYREEIQRMYDRGGFALATRGGSSRR

SEQ ID NO: 27689 - protein, 123 aa, Cryptococcus neoformans var. neoformans
AAQIAFFFVFEDTFHYWAHRALHYGPLYKHIHKLHHEFSAPIGIAAEYAHPLEVLILAQGTISGPFLYAVFRNDLHILTVYVWITLRLWQAVDAHSGYDFPWSLRHFLPFWAGADHHDFHHAT

SEQ ID NO: 27690 - protein, 395 aa, Triticum aestivum
  misc_feature (51)..(51): Xaa can be any naturally occurring amino acid
  misc_feature (394)..(394): Xaa can be any naturally occurring amino acid
  unsure (1)..(395): unsure at all Xaa locations
MAAAMSVSAVVPPAAAVARARTLLCVPATARAPREMAAEVAAAAALGADLXELRLDRLAGFAPRRDLPALLAKPRTLPALVTYRPKWEGGEYEGDDEPRFEALQLAMELGAEYVDIELKVADKFIKFMSGKKPENCKLIVSSHNYDNTPSAEELASLLAQIQATGADIVKIATTATEIVDVSRMFQILVHCQEKQVPIIGLVMNDRGFISRVLCPKFGGYLTFGSLEKGKESAPSQPTAADLINVYNIRQIGPDTKVFGIIGNPVGHSKSPILHNEAFRSVGLNAVYVPFLVDDLAKFLSTYSSPDFAGFSCTIPHKEAAVRCCDEVDPIARDIGAVNTIIRKPDGKLVGYNTDYVGAISAIEDGIRATQPTHSSTVSPLAGRLFVVIGAGGAXK

SEQ ID NO: 27691 - protein, 323 aa, Archaeoglobus fulgidus DSM 4304
MIALGIEGTAWSLSIGVVDEEGVIALENDPYIPKEGGIHPREASQHHSERLPSLLSRVFEKVDKNSIDVVAFSQGPGMGPCLRVVATAARLLAIKLEKPLVGVNHCLAHVEVGRWQTGARKPVSLYVSGGNSQVIARRGNRYRVFGETLDIGIGNALDKLARHMGLKHPGGPKIEELAKKGQKYHFLPYVVKGMDFSFSGMVTAAQRLFDSGVRMEDVAFSFQETAFAMLTEVTERALAYLDLNEVLLVGGVAANKRLQEMLRIMCEDRGAKFYVPPKELAGDNGAMIAYTGLLMYKHGHQTPVEKSYVRPDFRIEDVEVNWD

SEQ ID NO: 27692 - protein, 421 aa, Pseudomonas putida KT2440
MQDGFNDPLWRQVVSGAQMLFVAFGALVLMPLITGLDPNVALFTAGIGTLLFQLVTGRQVPVFLASSFAFITPIILAKGQFGLAETMGGVMAAGFVYTFMGLMVKIKGTGFIDRMLPPVVIGPVIISIGLAMAPIAANMAMGKGGDGTALMPYKTAMLISMPALLTTLIVAVFGKGIFRLVPIISGVLVGFALSFAFGVVDTARIAAAPWLEIPNFTAPAFNWQAILFIVPVALAPAIEHIGGVIAVGSVTGRDYLKKPGLHRTLLGDGLATTAAGLFGGPPNTTYAEVTGAVMLTKNYNPKIMTWAAVFAITLAFIGKFGALLQSIPVPVMGGILCLLFGSIAAVGMNTMIRHKIDLGEARNLVIVSVTLVFGIGGVLIGSGDGPDDWGLKGIALCAIVAIALNLILPGNDSWKHKKLDV

SEQ ID NO: 27693 - protein, 476 aa, Candida glabrata CBS 138
MSLSGNNFENPQNNGTSRLLKNVQRLALNNVTNTTAGPHVGFLGSQSQDNSALRSFKSSIANLKGDSVPTYKVNPLSRPALVNNERDLTKTKLGIQEEKETRNYEENKENHGPQKGHFTQYDERVEDKNQSESTVSSQTTTESTQITTSNGDDDQTEEENSEDADSKKKRPISTIVEQDIPKKFKSCNRFGTEEYEWEDLDAEDANDPFMVSEDVNDIFEYLHQLEIVTLPRKEDLYKHRNICQNRDILVNWLVKIHNKFGLLPETLYLAVNLMDRFLCKELVQLDKLQLVGTSCLFIASKYEEVYSPSIKHFASETDGACTEDEIKEGEKFILKTLEFNLNYPNPMNFLRRISKADDYDIQSRTLAKFLLEISLVDFRFIGVLPSLCAAAAMFLSRKMLGKGQWDGNLIHYSGGYTKNQLAPVCEMIMDYLVSPVVHDEFHRKYQSRRFMKASIISVQWALKVRKNGYDIMSLHE

SEQ ID NO: 27694 - protein, 532 aa, Halobacterium salinarum
MRVLGVEGTAWCASAALYDADAAADSVVIESDAYQPDSGGIHPREAAEHMREAIPAVIETVLGAADGDIDAVAFSRGPGLGPCLRIVGSAARALAQALDVPLVGVNHMVAHLEIGRHQSGFQQPVCLNASGANAHVLAYRNGRYRVLGETMDTGVGNAIDKFTRHVGWQHPGGPKVETHARDGEYTALPYVVKGMDFSFSGIMSAAKDAVDDGVPVADVCRGLEETMFAMLTEVAERALALTGRDELVLGGGVGQNDRLRGMLEAMCAARGASFHAPEPRFLRDNAGMIAVLGAKMAAAGATIPVADSAINSQFRPDEVSVTWRDPESPARDPGADAVRQGAEATVTFADDAVIKERAPKAYRHDRLDDRLRRDRTVLEARLTSDARRQGVPTPLVRDVDVPAATITLQHVGDADLRDALSPARVRAVGRHLATIHDGGFVHGDPTTRNVRVGAERTFLIDFGLGYYTDAVEDYAMDCHVFEQSLVGTAADADALVAAFEDAYEEAAASGRVLDQLRAVEGRGRYQDDPETA

SEQ ID NO: 27695 - protein, 172 aa, Neisseria meningitidis MC58
MTTHFVVMGVCGCGKTTAALSLQKHLGQCPYAEGDEFHTQANRDKMGAGIPLTDEDRYPWLGNLRDWMTQQAQNGANHTIVTCSALKRGYRDILRGAEGKAAFIHLSPPQDINLERMMSRKGHYMKAGMLDSQLEILEELGEGEYGVKIANPGTPEAVEADILNWVASENLL

SEQ ID NO: 27696 - protein, 258 aa, Arabidopsis thaliana
MMNTLHAFQTTLTPNFHVLFNASRHSLSRPQFLCLSKSGDGTSDSDSDPDPPKPEGDTRRQELLARIAMIQTSKVRLTDFLDERSEYLTKFAEEANAEFDKVGEDAMKDLDEASTRILENIESKMQAFEESAGLNRLEIEENDNKLAEFEEKIQVDRNEGLFFKSLRDKKPVDREQAREETEKIQEVTKESAGSKSRRNIYLGLIGIVVLAIADSFVSSPDWRKVAILGAILVPLLTQFVYEQTLLSEADKGKENKKE

SEQ ID NO: 27697 - protein, 532 aa, Crocosphaera watsonii WH 8501
MAQAPVSPVVLVILDGWGYRPTEEDNAVVMANTPVMDCLWTTYPRTLIKTSGKEVGLPQGQMGNSEVGHLNLGAGRIVPQELVRISDAVEEGAIYENKALVSLCEEVASRKGKLHLIGLCSEGGVHSHLDHLFGLLNLAQKQNLQDVCVHAITDGRDTNTTDGVKAIARIEDHIEKLGIGRIATVSGRYYAMDRDRRWDRVKLAYDVITQDGDGDGRSALELLKDFYSQDKTDEFIPPTRIAPGAIEAGDGVIFFNFRPDRARQLCSALTVPNFDGFERELITPLSFVTFTQYDPKLPVKVAFEPQNLNNILGEVVAREGLKQFRVAETEKYPHVTYFFNGGLEEPLEGEDRELIQSPMVATYDLSPAMSAEAVTKAACNAVDKAVYSLVVINYANPDMVGHTGNTEAAIEAIETVDNCLGKLLSSVSKLGGTVIITADHGNAETMKDENGNPWTAHTTNPVPLIFVEGEQRKIPGHGGLVELRDDGKLADIAPTILQILQLDKPSEMTGESLIKPAEIEIRANRTPVRIGR

SEQ ID NO: 27698 - protein, 229 aa, Glycine max
MGREKETTKVAYAVEQLVAFNRYNPDILPDLENYVNDQVSSQTYSLDANLCLLRLYQFEPEKMSSQIVARILVKALMAMPAPDFSLCLFLIPERVQMEEQFKTLIVLSHYLETGRFRQFWDEAAKSRHIVEAVPGFEQAIQGYAIHVLSLTYQRIPRTVLAEAINIEGLSLDKFLENQVANNGWVIEKSQGRAQLIVLPRNEFNDPALKKNAADSVPLEHITRIFPILS

SEQ ID NO: 27699 - protein, 472 aa, Oceanobacillus iheyensis HTE831
MQSYKMFVGGKWFGNNLEQIDVINPATNEQIGTIPNGGKEEAKQAVDAAHNALKEWSARTAEDRSNYLVKWHELIKEERETIAKIMTEEQGKPLKEAIGEVDYANGFISWYAEEGKRIYGDIIPASHTNKRIFVQKKPVGVVAAITPWNFPAAMITRKVGPALAVGCTVVIKPATQTPLTAFKLVELAEKAGIPRGVINIVTGSSSQIGKVWNDDGRVRKLTFTGSTEVGKILMKDAANTMKKISLELGGHAPFVVMEDADLDKAVAGVIASKFRNAGQTCVCTNRVYVHESIKDIFQDKLTEAVSKLKVGNGLEEGINIGPLIDQSAVDKVDEQVKDAISKGGRVTFGGKSLRGLYVEPTIVVDATDDMLCMYEETFGPLVPVTTFRDEEEVIARANNSPYGLAAYVFTENIGRAIRISEALEYGIVGLNDGAPSTPQAPFGGFKESGLGREGGYYGIEEFLEIKYISLAF

SEQ ID NO: 27700 - protein, 749 aa, Triticum aestivum
  misc_feature (256)..(256): Xaa can be any naturally occurring amino acid
  misc_feature (264)..(264): Xaa can be any naturally occurring amino acid
  misc_feature (588)..(588): Xaa can be any naturally occurring amino acid
  misc_feature (622)..(622): Xaa can be any naturally occurring amino acid
  unsure (1)..(749): unsure at all Xaa locations
MAAHSVAAAHATIAARAGAAPSSPAAAPAERLGFRLSSLAGRALRSPLPARRAAAAAAASSSRRSGTQRVRASAAVETVEAAATGELLDKSVNAIRFLAIDAVEKAVSGHPGLPMGCAPMGHILYDEVMRYNPKNPYWFNRDRFVLSAGHGCMLQYALLHLAGYDAVKEEDLKQFRQWGSSTPGHPENFETPGVEVTTGPLGQGIANAVGLALAEKHLAARFNKPDSEIVDHYTYCIVGDGCNMEGILTEACSLAXGHWGLGKXIVFYDDNHISIDGDTEIAFTEDVSGRFEALGWHTLWVKNGNDGYDEIRKAIQEAKSVTDKPTMIKVTTTIGFGSPNKANSYAVHGAALGTSEVEATRANLGWPYEPFFVPEDVKSHWSRHIPQGAALEADWDAKFAQYEQKYPEDAATLKSIITGELPAGWADALPQYTTESPADATRNLSQQCLNALAKVVPGLIGGSADLASSNMTLLKMFGDFQKDTPEERNVRFGVREHGMGAICNGIALHTPGLIPYCATFFVFTDYMRGAMRISALSEAGVIYVMTHDSIGLGEDGPTHQPIEHLVSFRAMPNMLMFRPADGKETAGXAYKVAVLNRKRPSILALSRQKLPHLPGTSIEGVXRGGYTISDNSTDNKPDYIIMSTGSEVEIAVKAAEELTKEGKTVRVVSFVCWELFDEQSDEYKESVLPEAVTARISIEAGSTLGWQKYVGSKGKTIGIDKFGASAPAPKIYKEYGITAENVIAAAKSL

SEQ ID NO: 27701 - protein, 126 aa, Podospora anserina
MTVHIFETAGQFKEAVAAHPVVVVDAFATWCGPCKAIAPQIAKWAEDPEFKDKIYFCKFDVDHLPELAQELGIRAMPTFIFYKDGDRVDELMGANPPALLNLLRKYLGGSGAGASSGGEHPEPPSL

SEQ ID NO: 27702 - protein, 83 aa, Oryza sativa (japonica cultivar-group)
MSPFEGAPEEFDQTIFPVDHKWSIGPVEGLALNFVKDEKRKRSYTDTANFTLRCGVCQIGVIGQKEAVEHAQATGHVNFQEYK

SEQ ID NO: 27703 - protein, 728 aa, Methylobacillus flagellatus KT
MIFKERLIHAAIFDMDGTMFDTERLRFTTIKQASAELFGETISDEILLGSLGLSAKKAEELAKSRYGEDYPYAAIRKRADELELAHVRKHGVPVKPGLYEILERLKRNGLLMAVATSSRRAIAEEYLINANVMKYFDITVCGDEVKQGKPHPEIFRTAAKELNCLPEHCLMFEDSENGLRSASGAGGLPILIKDIKEPRPDIKQLAYQAYDSMPDFLADLVRFTPNLPKPKLTDAFPQTINNMRAGIHGFGAMGGGYLAQIFSHWDGYTRPYEIIGASNNAILRSLVNAFGKYDVHYGNLAFHQTIDRIRLIDMADEAAVCEMYAVSEIIGLCLPESAIKQQAAMIAKGLVARYQNGAGPLTILVILNKLSGAAFVRRQVKEAMVRMLDEQRAEQIMAMAYFTETVVNRMVSKIPKEILLKQVRINFASFEKHTQKALGSGEGNVAPMHQEPALLAEPGLGKIVSQLRHASHLNRALDQLGVTLFESGPDMVLYAKKGGKILERLRQVQTVDNIAEIQAIKNRLLNGTHAIIAWYASLLGYQTIGQGMGDERVVMLVKRLVNNEIKPAMLQENPALAEYINTSFVNSFIARCKASFKDPCRRIGRDPLRKLQRKERIMGSIELAARHGIQTPMLEFGAALGILYSLRLITPEDKECQRIKALFEENGAVADVLAFSGDYHGKPYLGLDRQQDAALIERIAEHLRQLTDPTSAHWQWPLSYNYAEELAS

SEQ ID NO: 27704 - protein, 539 aa, Ustilago maydis 521
MVFQVRGTPIGALTIFIAALASMGGFLFGWDTGQISGLLEMSDFRARFATIDDPSATGGKSWNPWIEGVVVSLLSVGTAIGVLIGAPLADKLGRRYAMVVECIVFDIGVIIQVTSFYAWYQVAIGRLVTGLGVGALSAAVPLYQSETVPRQVRGALVGTYQLFITLGILLAYCTNIGTRDYSNSGQWRVPIALGIFFSSILAIGILFCPESPRWLAAQGRNEEAYKACAAVRGAKYGDGNPWVEAEYREIVSMVKADEKLEEAGWLDCFKPQHKTLYRTLLGMALQAGQQFTGANYFFYFGTAIFRSAGLDDSFVTQIILGAVNFVCTFLGLYVLERFGRRWPLIYGAAWQSFWLFVFAIAGVVGGPQPEQISSGIGKLLIVAACFFILGYASTWAPGIWIWIGESFSYRTRAKQASLATLSNWISNFLISYFSSPIANDINFAYGFVFAGCNLANCLIAFFFVYESADLTLEDVDAMYNDPNCKPWNSTKWVPAGYTSRDQIKEKDSGQASEVGEWSNSPSALPDEQEKNKSNPLQVA

SEQ ID NO: 27705 - protein, 399 aa, Candida glabrata CBS 138
MSSMSSSSMDSAQRKPSEDEKMDRPALTNVEVNRALPGGRKAQPLTEQEKKRHPMYRKPSRIRREDSDASYMANSKKRQVFQDNADDDEPTGKDQESRIKRAKVQDRQIKWVDLDSKEKNNIAMVVEYTNDIFDFLYEREKNTIPMHNYLLDRKSKYHLRPATRAVLVDWLVEVHDKFQCYPETLYLGINIMDRFLSQHKVDINKLQLLAVTSLFIAAKFEEINLPKLSEYAYITDGAASKDDIKVSEMFILTELKFSLDWPNPLNFLRRLSKADGYDGECRMIAKFILEYSLCSSKFVGEKPSELAAMAIFLARRILKRESPIWDDTFIHYSGGIDALNDNHFQNLCTIMINEIAQPATKLTALCDKYKSIKGGTIYDKTIKWCKDQMERNYENVFSC

SEQ ID NO: 27706 - protein, 231 aa, Boechera stricta
MKSRFVLFFFIVFSLLFFISSLIASDLGFCNDDMSLLGGVRDVPANQNSGEVESLARFAVDEHNKKENALLEFARVVKAKEQVVAGTLHHLTLEILEAGEKKLYEAKVWVKPWLNFKELQEFKPASAVTPSDLGCKKDEHGSGWREVPGDDPEVQHVAEHAVKTIQQRSNSLFPYELQEVVHANAEVTGETAKFNMLLKLKRGEKEEKFKVEVHKNHEGALHLNHMEQHHD

SEQ ID NO: 27707 - protein, 633 aa, Neisseria meningitidis MC58
MTTPKKTAKTSGNEARELADLSEDIGICFKYPNSERVYLQGSRDDIRVPLREIRQDDTYTAQGTEANPPIPVYDTSGVYGDPAAHIDLKQGLPHIRTAWLDERGDTEILPKLSSEYGIERAHDPKTAHLRFNQITRPRRAKSGSNVTQLHYARQGIITPEMEFVAIRERLKLDELSQKPEYAKLLEQHAGQSFGANIPTHPDQITPEFVRQEIAAGRAIIPANINHPELEPMIIGRNFRVKINGNLGNSAVTSSLTEEVEKMVWSLRWGADTIMDLSTGAHIHETREWIIRNAPVPIGTVPIYQALEKTGGIAEDLTWDLFRDTLIEQAEQGVDYFTIHAGVLLRYVPMTANRLTGIVSRGGSIMAKWCLAHHRENFLYTHFDEICEIMKAYDVSFSLGDGLRPGCIADANDESQFAELHTLGELTDKAWKHDVQVMIEGPGHVPLQRVKENMTEELQHCFEAPFYTLGPLVTDIAPGYDHITSGIGAANIGWYGTAMLCYVTPKEHLGLPDKEDVRTGIITYKLAAHAADLAKGWPGAQLRDNALSKARFEFRWRDQFRLSLDPERAESFHDETLPAEGAKIAHFCSMCGPKFCSMKITQEVRDYADKQKAQRQGMEEKAVEFVKKGAKIYS

SEQ ID NO: 27708 - protein, 335 aa, Xanthomonas campestris pv. vesicatoria str. 85-10
MTQTITVIRGDGIGPEIMDATLFVLDALQAGLTYEYADAGLVALEKHGDLLPESTLASISKNKVALKSPLTTPVGEGFSSINVAMRRKFDLYANVRPAKSFPNTKSRFADGVDLITVRENTEGAYLSEGQTVSEDGETAFSGTRITRKGSERIVRYAFELAKSTGRKKVTAVHKANIIKSTSGLFLKVARDVAAQYPDIEFQEMIVDNTCMQLVMRPEQFDIIVTTNLFGDIISDLCAGLVGGLGLAPGANIGLDAAIFEAVHGSAPDIAGQGKANPCALLLGAAQMLDHIGQPQNAERLREAIVATLEAKDSLTPDLGGTGNTMGFAKAIASRL

SEQ ID NO: 27709 - protein, 308 aa, Oceanobacillus iheyensis HTE831
MSTKYDAIKKRLRGSIAPVITPFKVNGDIDFKKQSELIEFQIENGTHAISVTGTSGEPSSLTTEERVQVMENAIKTINGRIPFAPGTGSTNHDETMYVTKKAEEMGADAAMVIVPYYNKPNQEALYDHFKTVADSVDIPIIIYNIPGRTAQNMEVKTMARLVKDCPNIVGAKESNKDFEHVNRVLLNCGRDFLLFSGIELLCYPMLAIGGAGSISATANVEPKKVAEMHNAWEEGDIKRAQDLHFELMNLNDVLFKDTNPAPVKAALGMMGMIEPVLRRPMGLPSDALQEEIRDTLVKYGKIEKIASV

SEQ ID NO: 27710 - protein, 507 aa, Oceanobacillus iheyensis HTE831
MSGNQEVDVLSGKHEELANKLDDIKLYINGEFMDAEDRGTFDNISPFSNEKINSVASGQAADIDKAVQSAKKAFKGEWGNLKQVERLEYVYKIGDLIEQHTDEIAILESLDTGLPISQTRKQVSRSANNFRFYADTVKSQMYGEVYQVDDEFINYTVRSAVGVAGLITPWNAPFMLETWKIAPALATGNTVILKPAEWSPLTANRMAEIIDQAGLPDGVFNIVHGFGETAGDALVKHPDVQLISFTGETTTGSTIMRNGADALKRFSMELGGKSPIIVFEDADLERALDAATWGIFSFNGERCTANSRLYLHESIADEFIEKLKQRVWNIRVGDPLENNTQIGPLIKTEHYNNVKKYLKIAEEEGCEIISGVIPKELNRGNYVAPTILLNASNEMRVVQEEIFGPVIAVMTFNDETEVIEKANDVRYGLAGYVWTNDMKRGHRVAHAIDSGMLWVNSQNVRDLRTPFGGSKDSGIGREGGHYAFEFYTEQKIIHVAIGDHHIPQFGK

SEQ ID NO: 27711 - protein, 498 aa, Magnetospirillum magnetotacticum MS-1
MKTYSIAAIPADGIGIEVIAAGIEVLDALAEKTGSFRFKFDHFDWGSDYYKRHGVMMPADGREQIKDHDAIFFGAVGAPDVPDHITLWGLRLAICQPFDQYANVRPTRILPGITSPLRHVTGPELNWVIVRENSEGEYAGVGGRVHQGHPNEVATDVSMMTRSGVDRIIRFAFKLAQSRPRKLLTVVTKSNAQRHAMVMWDEIAAEVARDFPDVTWDKMLVDAMTMRMTMKPETLDTIVATNLHADILSDLAAALAGSLGIAPTANINPERTYPSMFEPIHGSAFDITGKGVANPIATFWTACQMLGAPRRERRPADRLMRAVERVTGRSEPAHAAHLRGQGDDPPGHGRGHRTTPSVTTSRPVLRGHHPREPLCPAVPDRRATPRRNSTRPDRIRRNGGRPADGAAGRAGAPAAARPPLNHGSKPGDAARPPGKPQCQSIPARRQMRTITAKGLTTQKHNQKPGTNTHHHTQTRKESPHETTHPYDENKHTHPPRHQ

SEQ ID NO: 27712 - protein, 127 aa, Zea mays
MPAGGRALEFSSTKFKVTAAKLSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 27713 - protein, 225 aa, Triticum aestivum
MTNTLLLLGMTWMSVIMKPPSSTDPWMSVKIPKMLSSYKSPSLNLKLMFQLLLLPTTSILGLQVFFTNEGKGWGLRTLDGLPKGAFICELVGEVLTSSELHERKAKNSKHVDQVLLDASWGSEGVLRDEEALCLDPTFYGNVGRFVNHRCYDANLVIIPVEVETPDRHYYHLALFTAKKIEAFEELTRDYGIDFDGTDDLNKAFDCMCGRQVLSRRRSEEFKEED

SEQ ID NO: 27714 - protein, 104 aa, Glycine max
MQVVIYSPARTASQQGSGKVGKWKINFLSTQKWENPLMGWTSTGDPYSHVGDSALTFDSEEAAKAFAEKHGWEYSVKKPHTPLLKVKSYADNFKWKGPPKSGEE

SEQ ID NO: 27715 - protein, 290 aa, Legionella pneumophila str. Paris
MFSGSIVALVTPMRNDSVDVHHLRELVEFHIAKGTHALVAAGTTGEAGTLSHSEKLLVIKTVIEQAKERVPVIAGTAMNATKDCIELTQQAMEYGAHAALIMTPAYIKPTQEGLYLHYSHIAQSVAIPIILYNVPGRTACDILPETVARLAKISNIIGIKEATGQMTRLQQILRLCEGSLDVYSGDDLTAAQWLLAGAKGVISVTANVAAKLMAKMCDLAMDDDQAGCLRIQEQLMPLHELLFVESNPIPVKWAMNKMGLIGGELRLPMTELSEKHHQALEKVLKNLELI

SEQ ID NO: 27716 - protein, 123 aa, Cryptococcus neoformans var. grubii
AAQIAFFFVFEDTFHYWAHRALHFGPLYKHIHKLHHEFSAPIGIAAEYAHPLEVLILAQGTISGPFLYAVFRDDLHIFTVYIWITLRLWQAVDAHSGYDFPWSLRHFIPFWAGADHHDFHHAT

SEQ ID NO: 27717 - protein, 271 aa, Glycine max
MGTLTTVPVLPSKLNKPSLSPRHNSLFPYYGRRVGKKNKAMVPVARLFGPAIFEASKLKVLFLGVDENKHPGNLPRTYTLTHSDITAKLTLAISQTINNSQLQGWYNRLQRDEVVAQWKKVKGKMSLHVHCHISGGHFLLDILARLRYFIFCKELPVVLKAVVHGDENLFNNYPELQDALVWVYFHSNIPEFNKVECWGPLKEASAPIGGAKEESEQETLLSKEGLAIPQPCQEECECCFPPLTLSPIQWSQQVPSHHYEPCDGIETQQSL

SEQ ID NO: 27718 - protein, 341 aa, Pyrococcus horikoshii OT3
MIGVVQIPMGVAGPLKINGEYAKGEFYIPLATTEGALVASVNRGCSALTEAGGVVTTLIDDKMTRAPLIRCPNARRAREVAKWVEENLDYLQEKAVSKVTRHGKLRGVKPFIVGNNLYLRFEFETGDAMGMNMVTIASEEIMKVIEEEFPDVRYLALSGNLCVDKKPNAVNFILGRGKTVIAEAVVPRKIVEKKLKTTPELIAEVNYFKNLVGSAQAGSYGFNAHFANIVGAIFLATGQDEAQITEGAHGITIAEVTPDGDLYISITMPSLEIGTVGGGTRVPSQREALEIMGVAGGGDPPGINAKKFAEIVAGAVLAGELSLLAAIAAKHLARAHKMLGR

SEQ ID NO: 27719 - protein, 1130 aa, Hordeum vulgare subsp. vulgare
MSSSRPATSSSSRNRQSTQERMLAQTTLDAELNAEFEESSDSFDYSKLVEAQRDTPTVLQEGRSEKVIAYLQHIQRGKMIQSFGCLLALDEKSFNLIAFSENAPEMLTTVSHAVPSVDDPPRLDIGTNVRSLFTEQGATALHKALGFADVSLLNPILVQCKTSGKPFYAIVHRATGCLVVDFEPVNPTEFPATAAGALQSYKLAAKAISKIQALPGGSMELLCNTVVKEVFELTGYDRVMAYKFHEDNHGEVFAEITKPGLEPYLGLHYPATDIPQAARFLFMKNKVRMICDVRARTLKVIEDEALPFDISLCGSSLRAAHSCHLQYMENMNSIASLVMAVVVNESEEDDEAESEQPAQQQKKKILWGLVVCHHESPRYVPFPLRYACEFLAQVFAVHVNKEFEVQKQLREKSILRMQTILSDMLFKEASPLTIVSGTPNIMDLIKCDGAALLYGDKVWRLGNAPTESQIRHIALWLSEVHMDSTGLSTESLHDAGYPGASALGDMVCGIAVAKINSNDILFWFRSHTAEEIRWGGAKNDPSDQDDSRRMHPRLSFKAFLEVVKMKSLAWSDYEMDAIHSLQLILRGALDDVAKPTGKASLDEQIGDLKLDGIAELQAVTSEMVRLMETATVPILAVDGNGLVNGWNQKAAELTGLRVDDAIGRHILTLVEESSVPVVQRMLYLALQGKEEKEVRFDMKTHGPKRDDGPVILVVNACASRDLHDDVVGVCFVAQDMTVHKLVMDKFTRVKGDYMAIVHNPNPLIPPIFGADEFGWCSEWNAAMTKLTGWHREEVLDKMLLGEVFDSSNASCLLKNKDAFVGLCVLINSALAGEETEKAPFGFFDRSGKYTECLLSVNSRANEDGLITGVFCFIHIPSHELQQALQVQQASEQASLRRLKAFSYMRHAINNPLSGMLYSRKALKNTDLNEEQMRQIHVSDNCHHQLNKILADLDQDNIMENSSCLDLEMAEFVLQDVVVAAVSQVLIACQGKGIRISCNLPERFMKQLVYGDGVRLQQILSDFLSISVKFSPVGGSVEISAQATKNSIGENLHLIDLELRIKHRGLGVPAELMAQMFEEENTEQSEEGLGLLVSRNLLRLMNGDVRHLREAGMSIFILTAELACAPTAMRQ

SEQ ID NO: 27720 - protein, 145 aa, Saccharomyces cerevisiae
MKLDRDSSGSIDKNEFMSIPGVSSNPLAGRIMEVFDADNSGDVDFQEFITGLSIFSGRGSKDEKLRFAFKIYDIDKDGFISNGELFIVLKIMVGSNLDDEQLQQIVDRTIVENDSDGDGRLSFEEFKNAIETTEVAKSLTLQYDV

SEQ ID NO: 27721 - protein, 221 aa, Zea mays
  misc_feature (61)..(61): Xaa can be any naturally occurring amino acid
  misc_feature (70)..(70): Xaa can be any naturally occurring amino acid
  misc_feature (109)..(109): Xaa can be any naturally occurring amino acid
  unsure (1)..(221): unsure at all Xaa locations
AFASNYISVYEREENATENAGREVTREWLLKYADLQHISAPKPAMLPAAFSRCMSRSSAHXEDRAFETAXTVGDVLKSKGKSADGSCFWRTTEDIDYDAVKSMTHHNEXDLVADKPEQNKSISGIVTERDYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 27722 - protein, 1749 aa, Gibberella zeae PH-1
MTVSQRNQLLLEKSILPGTTDVSKMSKDDLYSLFPASRRTKEDDLVAPEIFHSFSLANVENDRTLLTTILDWVDKEIDLCRLANIHNFLWIAGRPMPPRPIHQQRLLNREIFITERLDLHLVWTTDRIFLKPLPRFLLDPRFWERFLYCHTVPVLNGEQCSCRGRRERALGFLFSYAALMAHESDFYIAKEAHLIPEEVQWSAWRKAVREILGTSPIYPAIDPRFHYGELRLSRLNKIYFYWKTPLSGYASRWNQYGSFFHDNFALLASSTVYIAVVLTAMQVGLATEALQNNTAFQSASYGFTIFSIVGPLAATGLVMITFCYLFIGNWIATQRYPHTSRPLVMARNWKLLVKPQRGNEAVDRLNDEDLRRCRVCSTGQIRKAFGRLDGVPSVTRGAFFAAGVVAVFVTVYPLAAKVQRRNETSRPDGITIVHDPPSPKFEIVAVHGLGAHPVHTWEGKPSTGSLSKLHLLRDLLREDFPTARISSFAYNSDWLVDAPEKTAQQIGRRLLEKLSQHRGDSQRLPIIFIGHSFGGIVIKEIVDRESARGSSIEPVGIDTDHAGLNKFDSPKHPGYRALKDAVKKLRVKSLLEQADDHIREKHYTSERLKIERLSGDPLLMDQCYINLSIVDHIKTNAKARNQSEDSNSTSQLSPFSLFARQKVEMPIAEIQVRLADVFNERKEPDGNILLPRRVLVRGRAGVGKTTLCKKMVHDFIRNKMWHETFDRVLWVPLRNLKQRAGLGYDLRTLFDHEFFRFSGEHKKSDGTRFARELYKTLTLGRTLFILDGWDEVAGTSKDDDMFAFLYELLSQPNVIITSRPSATLPHGIDVDLELETIGFSPAQVDEYIEKTHGENVDELKAFLRSHQLVRGLVRIPVQLDAFCYCWGDIGSDREKKPETMTTLYQAIQTSLCKKDAARLEKIKAESLTTASQSFIEKYVKDELRFLEHLAFAGLAADKIEFNLSDRNRVNEDSSLLLDLDKSLPCLSFLRTSDPSAKSAHQLYHFIHLTFQEYFAARYFVRHWTEKREKREMQYTLFEKKSTRVVHPIDFLQKHKYDAGYDIMWRFVAGLLDDADEYQSARFFEEIEKEPADLLGPTHQRLVMHCLSEATSLPDEIRGSRERRLAEWVLFEIDYTGSSTLVVLGALGSSERVFSHSITTALTQLLKDKDSDVRYYAARAIGKQSILSDTTVAALVELFKDKDSDARYHAAEAIGKQSTLSDTTVAALMELFKDKDRSIRSSAARAIGKQSILSDTTVAALMELFKDKDRSVRSSAAEAIGKQSILSDTTVAALIELIKDKDSIARSYAAEAIGKQSILSDMTVAALMELFKDKDSSIRSSAARAIGNQSTLSDTTVAALVELLKDEDRSVRYHAARAIGKQSTLSDTTVAALMELFKDKDRSVRSSAAEAIGNQSILSDTTVAALMELFKDKDSSIRSSAARAIGNQSILSDTIVAALVELFKDKDSDIRYYAARAIGKQSILSDTTVAALVELFKDKDSDARYHAAEAIGNQSILSDTIVAALVELIKDKDSDARYHAAEAIGNQSILSDTTVATLVELIKDEDSDIRSSAARAIGKQSILLDTTVAALIKLLKHEDRSVRYHAAEAVGNEPTLIGRIAEVLGLSAQSQSQTPGATQTLRHIQHIEPLYKSFLRQGFKQQFSLYNSDSLLIINQSSGLRMALLDKNKDAFRVSVRNGQRELREAYDYLIWESLEGMSSQEQVSSTRRGLKSDLTKSHFAEVPQPSGQP

SEQ ID NO: 27723 - protein, 331 aa, Oceanobacillus iheyensis HTE831
MITITKTKQLTLIQAITDGMRTMLHEREEVVVLGEDVGKNGGVFRATDGLQEEFGEKRVFDTPLSEAGIIGSSIGMAINGLLPVAEIQFSGFIYPAYEQIMTHATRMRYRTKGVFTVPLVIRAPYGAGVRAPEIHSDSMEALFTHMPGIKVVCPSSPYDAKGLLISAIEDPDPVLFLEPLKLYRAVRGEVPEEKYEIEIGKGKYLREGDDVTVIAWGAMVPVAMKAAEQAAEKGITCEVIDLRTLYPIDRAIIAESVQKTGRCVVVHEAPATGGLGNDIISIVNDTSFLYMKSPIERVTGADVHVPFWALEEHNIPTPARVMDAINQVINF

SEQ ID NO: 27724 - protein, 379 aa, Oceanobacillus iheyensis HTE831
MKQLEFVKPKEKNTFEKIANHEQVVFCNDPATGLQAIIAIHDTTLGPALGGTRMYPYKSVDDALEDVLRLSEGMTYKCAASGLDFGGGKAVIIGDPEKDKSPALFRSFGQFVDSLNGRFYTGTDMGTTTDDFVEAFKETNFINGIPEVYGGSGDSSISTACGVIHALEATNEYLFNNNDLGNRTYAIQGLGKVGYKVAEQLLEAGAKLYITDLNQDVMTQLNTKAKDTNGEVEQVDSEAIYSTDADIFIPCAMGAIINDQTIGQLKVKAIVGSANNQLQSPAHAKMLQEKGILYAPDYIVNAGGLIQVADELYGPNTKRVLVKTKAIYRSLLDIYVQAELDAITTVEAANRKVRSVLEEQRNRNNFYSRKRRPKWNIRE

SEQ ID NO: 27725 - protein, 332 aa, Cenarchaeum symbiosum
MYRIALIEGDGIGPEISRSVTDVLGALKEPKLSIERFDAGDRALKEHGTALPPETIRGVEESDACLKAPVGESAADVIVALRRRLDLYANVRPAKSHPGMPAIRDDIDLLIARENTEDLYTGNEFFIDGAAVALRTITERASERIARYALKAAMTRRRKVTCVHKANVMRVTDGLFASTCRRVAAEYPDVEFGEMYVDACAMNLIRRPEWFDVIVTTNLFGDILSDESSQAAGGLGMAPAGNIGDKFAIFEPVHGAAFDIAGKNEANPSSFLLSAAMMLGWLGGRNDDATCLVAATRLNAAVYGAVKEGIKTKDMGGSAGTDKFTAEIISRL

SEQ ID NO: 27726 - protein, 153 aa, Vibrio harveyi
GQFVGWVVTQYDIFRKEAESTTTHGKLKDINVNIEGNHVYLVFEYVTGDASGQNMVTIATHKVFHYILEHSPIAPVDAYLDGNLSGDKKANAHTLRSVRGKKVSAEVTIPAALVEKYLHTTPEAMVKFGKMNTVGGLLSGTIGINAHYANALA

SEQ ID NO: 27727 - protein, 340 aa, Streptococcus pneumoniae R6
MTVTIDWENLGFSYMKLPYRYLAHFKNGQWDQGELTEDATLHISESSPSLHYGQQAFEGLKAYRTKDGSVQLFRPDENAKRLQRTCDRLLMPQVPTDMFVEACKAVVRANEEYVPLYGIGGTLYLRPLLIGVGDIIGVKPAEEYIFTIFAMPVGNYFKGGLVPTNFLIQDEYDRAAPNGTGAAKVGGNYAASLLPGKMAKSRHFSDVIYLDPSTHTKIEEVGSANFFGITADNEFVTPLSPSILPSITKYSLLYLAEHRLGLTPIEGDVPIDNLDRFVEAGACGTAAVISPIGGIQHGDDFHVFYSETEVGPVTRKLYNELTGIQFGDIEAPEGWIVKVD

SEQ ID NO: 27728 - protein, 268 aa, Karenia brevis
HEATLGLPDSPGVPKGATSGTLVAQYNDLESVEALLKEHEVAAVVLEPVVGNSGFIPPTREFLQGVRELTTKYGALLVFDEVMTGFRISYGGAQAYFGVTPDLTTMGKVIGGGLPVGAYGGRKDIMQLVAPAGPMYQAGTLSGNPLAMTAGIETLKKLKAPGSYEHLTRITGKLIDGILSAAREAGHSVCGGNISGMFGFFFTEGPVTCFADAAKSDMNKFAKWHRMMLERGVYLAPSQYEAGFTCLAHTDEDVERTIAIAKEVFAEL

SEQ ID NO: 27729 - protein, 587 aa, Oryza sativa
  misc_feature (152)..(152): Xaa can be any naturally occurring amino acid
  misc_feature (451)..(451): Xaa can be any naturally occurring amino acid
  misc_feature (459)..(459): Xaa can be any naturally occurring amino acid
  misc_feature (466)..(466): Xaa can be any naturally occurring amino acid
  unsure (1)..(587): unsure at all Xaa locations
MHRMASLLLPPQFLCSLPCSTNSIRSHLHYKPHFLGNIMTKPKAKMRLLNRNVSSMAKKSSQDVAEGSSDDESDGETSKTKKRAPRRGRKKATIQASEGETQEGQVSTEEDESPEGTKKIKRRGRKKAATTASSSEEKDKAKKKKKRGRRKXKTVEELSDNEGEDLGEDLVPSNDRQEKISANDLESKIAALLLEDTDDNDINNLIPLVCCFGPAKYSFIPSGRPANRLIDHEIHEGMKDMFWSPDQFVRAPGGSSSNVALALAASGGRVEFMGKLGDDDYGQSTLYHLNVNGVQTRAIKMDPSAFTAMSLMKVTEDCFVQTDINPAVLKEAKMFYYNSSALLEPTTRSSLSKAIEVSKKFGGVTFFDLNLPLPLWSSSKETKSLVKEAWEAADIIEITKQELEFLCGIKPSEKFGTKDNDKSKFTHYSPEVVTKLWHENLKVLFVTNGIXKMHLTHKXHDGWVSXTVDASITPFTGDMSQSGDAIVAALMKMLAINPHLVTDKDYLHTAMKHAITCGVIDQWLLARERGFLPRERADPTSEQFGVRFVTEKEYRTLPDSIHTEDSSESELLYVELNKENAEACNFQ

SEQ ID NO: 27730 - protein, 440 aa, Bacillus cereus ATCC 10987
MKQHPFKIASLGMQHMLAMYAGAIIVPLIVGGGLGLNQKELTYLVSIDLLMCGVATILQALSNRFFGIGLPVVLGCTFTAVGPMIAIGKQYGVSSIYGAIIAAGLFVVIFAKLFGKLVKLFPPVVTGSVVTVIGVTLVPAAINDMAGGVGSKDFGSLENLALAFGVLLFIIIMYRFFDGFIRSISILLGLLFGTIVAAFMGKVSLQAVGEADWFHGIQPFYFGTPTFELTPIITMILVACVGIVEATGVYFALSDICNKKIGEKELTKGYRAEGLAMVLGGIFNAFPYTTYSQNVGLVQLTGVRNRVIIYTCGGMLIVLGFIPKIAAITTIIPKSVLGGAMLAMFGMVMAYGIKMLSSVDFGRQENLLIVACSVGIGLGVTVVPTLFSQLPESIRILTDNGIVLGSASAVLLNIVFNMVPQRKVKVKDEPVPIQSAVREA

SEQ ID NO: 27731 - protein, 191 aa, Oryza sativa (japonica cultivar-group)
MDMIGMASPAESPGGGGTARPSRYESQKRRDWQTFGQYLRNHRPPLELSRCSGAHVLEFLRYLDQFGKTKVHAHGCPFFGHPSPPAPCPCPLRQAWGSLDALVGRLRAAFEEHGGRPESNPFGARAVRLYLRDIRDTQSKARGIAYEKKRRKRAAASHTKQKQQQQQLVEQAAAAAEAHAAGCMMPLSVFN

SEQ ID NO: 27732 - protein, 141 aa, Vibrio proteolyticus
VAQYEQFKEIAEATTSHGQLKDMNVNIEGNHVYLVFEYLTGDASGQNMVTIATNAVYRFILSHSPIVPVEAFLDGNLSGDKKPNAHTLRSVRGKKVSAEVIIAAELVEKYLHTSVARMVSFANKTTVGGLLSGSVGINAHY

SEQ ID NO: 27733 - protein, 706 aa, Candida boidinii
MALAKAASINDDIHDLTMRAFRCYVLDLVEQYEGGHPGSAMGMVAMGIALWKYTMKYSTNDPTWFNRDRFVLSNGHVCLFQYLFQHLSGLKSMTEKQLKSYHSSDYHSKCPGHPEIENEAVEVTTGPLGQGISNSVGLAIASKNLGALYNKPGYEVVNNTTYCIVGDACLQEGPALESISFAGHLGLDNLVVIYDNNQVCCDGSVDIANTEDISAKFRACNWNVIEVEDGARDVATIVKALELAGAEKNRPTLINVRTIIGTDSAFQNHCAAHGSALGEEGIRELKIKYGFNPSQKFHFPQEVYDFFSDIPAKGDEYVSNWNKLVSSYVKEFPELGAEFQSRVKGELPKNWKSLLPNNLPNEDTATRTSARAMVRALAKDVPNVIAGSADLSVSVNLPWPGSKYFENPQLATQCGLAGDYSGRYVEFGIREHCMCAIANGLAAFNKGTFLPITSSFYMFYLYAAPALRMAALQELKAIHIATHDSIGAGEDGPTHQPIAQSALWRAMPNFYYMRPGDASEVRGLFEKAVELPLSTLFSLSRHEVPQYPGKSSIELAKRGGYVFEDAKDADIQLIGAGSELEQAVKTARILRSRGLKVRILSFPCQRLFDEQSVGYRRSVLQRGKVPTVVIEAYVAYGWERYATAGYTMNTFGKSLPVEDVYEYFGFNPSEISKKIEGYVRAVKANPDLLYEFIDLTEKPKHDQNHL

SEQ ID NO: 27734 - protein, 1130 aa, Hordeum vulgare subsp. vulgare
MSSSRPATSSSSRNRQSTQERVLAQTTLDAELNAEFEESSDSFDYSKLVEAQRDTPTVLQEGRSEKVIAYLQHIQRGKMIQSFGCLLALDEKSFNVIAFSENAPEMLTTVSHAVPSVDDPPRLDIGTNVRSLFTEQGATALHKALGFADVSLLNPILVQCKTSGKPFYAIVHRATGCLVVDFEPVNPTEFPATAAGALQSYKLAAKAISKIQALPGGSMELLCNTVVKEVFELTGYDRVMAYKFHEDNHGEVFAEITKPGLEPYLGLHYPATDIPQAARFLFMKNKVRMICDVRARTLKVIEDEALPFDISLCGSSLRAAHSCHLQYMENMNSIASLVMAVVVNESEEDDEAESEQPAQQQKKKILWGLVVCHHESPRYVPFPLRYACEFLAQVFAVHVNKEFEVQKQLREKSILRMQTILSDMLFKEASPLTIVSGTPNIMDLIKCDGAALLYGDKVWRLGNAPTESQIRHIALWLSEVHMDSTGLSTESLHDAGYPGASALGDMVCGIAVAKINSNDILFWFRSHTAEEIRWGGAKNDPSDQDDSRRMHPRLSFKAFLEVVKMKSLAWSDYEMDAIHSLQLILRGALDDVAKPTGKASLDEQIGDLKLDGIAELQAVTSEMVRLMETATVPILAVDGNGLVNGWNQKAAELTGLRVDDAIGRHILTLVEESSVPVVQRMLYLALQGKEEKEVRFDMKTHGPKRDDGPVILVVNACASRDLHDDVVGVCFVAQDMTVHKLVMDKFTRVKGDYMAIVHNPNPLIPPIFGADEFGWCSEWNAAMTKLTGWHREEVLDKMLLGEVFDSSNASCLLKNKDAFVGLCVLINSALAGEETEKAPFGFFDRSGKYTECLLSVNSRANEDGLITGVFCFIHIPSHELQQALQVQQASEQASLRRLKAFSYMRHAINNPLSGMLYSRKALKNTDLNEEQMRQIHVSDNCHHQLNKILADLDQDNIMENSSCLDLEMAEFVLQDVVVAAVSQVLIACQGKGIRISCNLPERFMKQLVYGDGIRLQQILSDFLSISVKFSPVGGSVEISAQATKNSIGENLHLIDLELRIKHRGLGVPAELMAQMFEEENTEQSEEGLGLLVSRNLLRLMNGDVRHLREAGMSIFILTAELACAPTAMRQ

SEQ ID NO: 27735 - protein, 191 aa, Candida albicans SC5314
MTTTTTNTTVIVVGGPAGTGKTTQGELISKHFQCPFIEGDALHPQENVDKMSQGIPLTDEDRWGWLKQLSQVSSSKAHESENTTKIAVVSCSILKKKYRDFIKENSVDPLIKFRFVFLYTTFEELMSRVENRKGHYMKSDMVKSQYDIMEIPHNGELLQNGGDAITVDTSGKSPEEIFKEIIVTDNILSKN

SEQ ID NO: 27736 - protein, 814 aa, Hordeum vulgare subsp. vulgare
AVAQYTLDAGLHAVFEQSGASGRSFDYSQSLLAPPTPSSEQQIAAYLSRIQRGGHIQPFGCTLAVADDSSFRLLAFSENAADLLDLSPHHSVPSLDSSAAPPPVSLGADARLLFSPSSGVLLERAFAAREISLLNPLWIHSRVSSKPFYAILHRIDVGVVIDLEPARTEDPALSIAGAVQSQKLAVRAISRLQALPGGDVKLLCDTVVEHVRELTGYDRVMVYKFHDDEHGEVLAESRRGDLEPYLGLHYPATDIPQASRFLFRQNRVRMIADCHAAAVRVIQDPAMPQPLCLVGSTLRSPHGCHAQYMANMGSIASLVMAVIISSGGEDEHNMTRGVIPSAMKLWGLVVCHHTSPRCIPFPLRYACEFLMQAFGLQLNMELQLAHQLSEKHILRTQTLLCDMLLRDSPTGIVTQSPSIMDLVKCDGAALFYHGKYYPLGVTPTEAQIKDIIEWLTVCHGDSTGLSTDSLADAGYPGATALGDAVCGMAVAYITPSDYLFWFRSHTAKEIKWGGAKHHPEDKDDGQRMHPRSSFKAFLEVVKSRSLPWENAEMDAIHSLQLILRDSFRDAGEGTSNSKAIVNGQVQLGELELRGIDELSSVAREMVRLIETATVPIFAVDTYGCINGWNAKVAELTGLTVEEAMGKSLIKDLIFKESEEIVEKLLSQALRGEEGTNVEIKLKTFGSEQSKGPIFVIVNACSSRDYTKNIVGVCFVGQDITGQKVVMDKFVNIQGDYKAIVHNPNPLIPPIFASDENICCSEWNTAMENLTGWSRGEVVGKLLVGEVFGNCCRLKGPDALTKFMIALHNAIGGQD

SEQ ID NO: 27737 - protein, 443 aa, Leptospira interrogans serovar Lai str. 56601
MISPLRWLLPAKAKPLLSKELIDRSYPRFRWRILEATFIGYATFYLVRNNFPVISKEMGEALHYSQEQITNILAVTAITYGIGKFLMGILSDRSNPKYFMPLGLILTAICNLFFGASNQYEVHFYLWALNGLMQGMGWPPCGRSLGHWFGVSERGSKFAIWNIAHNVGGGLVGIIAAYSASWWGWRNAFYIPALIAIVTAIYLLFRLVDTPQSVGLPPIEEYQKDPEKEVRLSIQEQEKELSFREIILGSVLKNHYVWTFAFANFFVYVVRYGLTDIGPTYLKLSKGASLEKGGISTLIYEFAGIASTLLVGWGSDKLGGKRGMVSLLCMLPILFALISLLFTPLGFLWLDLVLFGIIGFFIYPPVMLLGVAGLDFTSKKAVGAAAGFIGLFGYLGRTILSKSVGWLSKQTGFHWEQPMYLMIGATLISIALLAITWNWKPKA

SEQ ID NO: 27738 - protein, 336 aa, Candida albicans SC5314
MPSFELDSLPYLNPNVDRRIAFITGGSSGLGFYSVLQLYLHGYTVYIAGRSKSRCLKSIKELKNKAIDIRSEYTSSQLNERFLGDLRFLEVDLSNLNSVISAVENFKKLEDHLHILINNAGAMALPYTLTIDKFEIQLQTNFVSPLVLTTKLLPILQKTADKFPKLPTPRIIYLGSFGHQFALPYFNLSNNLNHYPNFIFTWIRYGMAKVAGIHFMKMLTLRNPKVLFLTVHPGLVMNTNLFSYWTRLPIVGIIFWFAFYLFGYFFGVTSKEGADVVIKCALDENLTVENDNGKYFGPDGKESQPSSIATNMDYAARTWIWTIKELSQRGIDIPNP

SEQ ID NO: 27739 - protein, 702 aa, Oryza sativa (japonica cultivar-group)
MASTTTKNALLLLLLLLLLFPLLHSSLADVAAAAPSSASAAEVDALMELKAALDPSGRLLPSWARGGDPCGRGDYFEGVSCDARGRVAAVSLQGKGLAGAISPAVAMLPGLTGLYLHYNELAGAIPRQLGDLPMLAELYLGVNNLSGTIPVELGRLPALQVLQLGYNQLSGSIPTQLGQLKKLTVLALQSNQLTGAIPASLGDLPELARLDLSSNRLFGSIPSKLAAIPKLATLDLRNNTLSGSVPSGLKKLNEGFHFDNNSELCGAHFDSLKPCANGDEDDNEEGSKMARKPESTNVKPLQAPQTMNVNRDCDNGGCSRSSSSSTTLSSGAILAGTIIIIGGAAACGISVISWRRRQKQKVGGGGTVESLEGRASSSNASSSLINVEYSSGWDTSSEGSQQGLRLSPEWSPSVRYNMEEVECATQYFAGANLLGRSGFAATYRGAMRDGAAVAVKSIGKSSCKAEEADFLRGLRAITSLRHDNLVALRGFCRSRARGECFLVYEFMANGSLSRYLDVKDGDVVLDWATRVSIIKGIAKGIEYLHSSKANKAALVHQNICADKILMDHLFVPHLSGAGEHKLLADDVVFSTLKDSAAMGYLAPEYTTTGRFTDRSDVYAFGVVVFQVLTGRKAVSSELRLLGGGGGAEYSGKLDDLVDPRLGGRFSRPEAAKLAGIALLCTSESPAQRPAMAAVLQQLGATQ

SEQ ID NO: 27740 - protein, 291 aa, Bifidobacterium longum
MTQNRAELNRNLAQMLKGGVIMDVTTPEQAKIAQDAGACAVMALERIPADIRAAGGVSRMSDPAMIKGIQEAVSIPVMAKVRIGHIAEARILQAIEIDYIDESEVLSPADDVYHIDKNQFDVPFVCGAKNLGEALRRIAEGAAMIRTKGEPGTGDVIQAVRHMRTMNKQIRELVGLRDDEVYEAAKQLAVPYDLAKYVHDNGRLPVVNFAAGGVATPADAALMMELGAEGVFVGSGIFKSGDPAKRAAAIVKATANWQDADLLAKLSENLGEAMVGINEDEIQTIMAARGE

SEQ ID NO: 27741 - protein, 562 aa, Pseudomonas aeruginosa PAO1
MIENFWKDKYPAGIAAEINPDQYPNILSVLKESCQRFATKPAFTNLGKTLTYGELYKLSGDFAAYLQQHTDLKPGDRIAVQLPNVLQYPIVVFGAMRAGLIVVNTNPLYTARELEHQFNDSGAKAVVCLANMAHLVEGVLPKTGVKQVIVTEVGDILPPLKRFIVNFVVKHIKKMVPAYSLPQATKLTDALARGAGKSFQEAAPQADDVAVLQYTGGTTGVAKGAMLTHRNLVANMLQCKALMGANLNEGCEILIAPLPLYHIYAFTFHCMAMMLTGNHNILITNPRDLPSMLKDLGQWKFTGFVGLNTLFVALCNNETFRKLDFSALKLTLSGGMALQLATAERWKEVTGCAICEGYGMTETAPVVSVNPFQNIQVGTIGIPVPSTLCKVIGDDGQEVPLGERGELCVKGPQVMKGYWQRQEATDEILDADGWLKTGDIAIIQEDGYMRIVDRKKDMILVSGFNVYPNELEDVLATLPGVLQCAAIGIPDEKSGESIKVFVVVKPGATLTKEQVMQHMHDNLTGYKRPKAVEFRDSLPTTNVGKILRRELRDEELKKAGQK

SEQ ID NO: 27742 - protein, 1139 aa, Hordeum vulgare subsp. vulgare
MSSSRSNSRSACSRGSSARSRHSERVVAQTPVDAQLHAEFESSHRHFDYSSSVSALNRSGASTSSAVSAFLQNMQRGRYIQPFGCLLAIHPESFALLAYSENAAEMLDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIHDGNLSQPISLCGSTMRAPHGCHAQYMANMGSIASLVMSVTVNEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSAPSEGEIKKIAAWLLECHDGSTGLSTDSLLEAGYPGASALGEVVCGMAAIKISSKGFIFWFRSHTAKEIKWSGAKHEPGDADDNGRRMHPRSSFRAFLEVVKWRSVPWEDVEMDAIHSLQLILRGSLQDEDANDNNVRSIVEAPSDDVRKIQGLLELRIVTNEMVRLIETATAPILAVDIVGSINGWNGKVAEITGLPTTEAIGMLLVDLVEGDSVEVIKQMLNSAMQGTEEQNFEIKLKTFHQQESNGPVVLMVNACCSRDLSDKVVGVCFVAQDLTGHKMVMDKYTQIQGDYVAIVKNPNELIPPIFMINDLGSCLEWNEAMQKITGIKREDAIDKLLIGEVFTLHDYGCRVKDQATITKLSILMNTVISGQEPEKLAFGFFSTDGKYMESLLTANKRTDAEGKITGALCFLHVPSPELQHALQVQKMSEQAAARSFKELTYIRQELKNPLNGMQFTRKLLEPSDLTEEQRQLFASNVLCQEQLKKILHDNDLEGIEQCYMEMNTVEFNLEEALNTVLMQGMSLSKEKQISLDRDWPVEVSSMYLYGDNLRLQQVLADYLACTLQFTRPAEGPIVLQVIPKKEHIGSGMRIAHLEFRVVHPAPGVPEALIQEMFRHGPGVSREGLGLHISQKLVKTMSGTVQYLREAESSSFIVLVEFPVAQLNSKRSKPSTSKSNF

SEQ ID NO: 27743 - protein, 413 aa, Bradyrhizobium sp. BTAi1
MSIEAAGSPAESQRLLRSLSLTQAVLYGLGVTIGAGIYVLVGIAAARSGMHAPLAFIGAALVMAFSAASFAELGTRMPVSASEAAYVQAAFGRKWLSLGVGLLVVATATISAATISVGSSGYVAVFLPISAPWIISGVVLAMGVVACLATAQSVTFAGIMTVVEVGGLVLIIVTGLGHGTDVVTRLPEMWPPTRDTEAWIGLGGTALIAVFSFIGFEHVVNIAEEMKEPSRTLPRALFLTLGLTALIYALVVWIAVTAVPPQELARSSAPLALVFERLTGLPLVTMSAIAIVATLNGIIVHMIMIGRVIYGLADQGNLPRVFARLNSVTQTPLLATAFGIGAILVLSLAVPLGGLADLTARFTLVVFAIVNIALIRIKGRRQPAPSGAFICPMWVPCFGLASSLLLLVVDLVA

SEQ ID NO: 27744 - protein, 993 aa, Zea mays
MFDSCTRKPTAKAASGDRQGACENGALKLQLRLREDSVASMDASPIAPAASQLLFPLASGQEPQKRIARRGSPGERSQQKVLRQAIDLAASGLRGCRRFHRFPRLLGSSIFTILPLSILGWGMTEGESGVRRWLVDISRWRPSPAQFDAAAALLPPHERPAISRFVKEDDRKRALVSRLLQYSLVHHLLRIPFHLINIRRTTEGKPYLQNNSSAFPNFNFSTSHHGDYVGIASEPLCLVGLDIVSVSEPHGETAAEFVSNFSSCLTDHEWSCIVRAGTPRDVLTEFYRYWCLKEAFVKAIGAGVGFGLRRLEFHHEGWTNISIRIDGEVSKKWRFWLFKLDETHLASIAKGDPEDAINTFKKTLSNVIIAEDQLSSALDSPEEAFTLQAVEELTQSQGTGQQHAFPAAAMGQCCSKGQCCSKGAEAAAAAKANAPIRGASASNADGQRPSSSCAAPGGGGGGGGGATKPASPTGGARASKPAAAAVGTVLGRPMEDVRATYSMGKELGRGQFGVTHLCTHRTSGEKLACKTIAKRKLAAREDVDDVRREVQIMHHLSGQPNVVGLRGAYEDKQSVHLVMELCAGGELFDRIIARGQYTERGAAELLRAIVQIVHTCHSMGVMHRDIKPENFLLLSKDEDAPLKATDFGLSVFFKEGELLRDIVGSAYYIAPEVLKRKYGPEADIWSVGVMLYIFLAGVPPFWAENENGIFTAILRGQLDLSSEPWPHISPGAKDLVKKMLNINPKERLTAFQVLNHPWIKEDGDAPDTPLDNVVLDRLKQFRAMNQFKKAALRIIAGCLSEEEITGLKEMFKNIDKDNSGTITLDELKHGLAKHGPKLSDSEMEKLMEAADADGNGLIDYDEFVTATVHMNKLDREEHLYTAFQYFDKDNSGYITKEELEHALKEQGLYDADKIKDIISDADSDNDGRIDYSEFVAMMRKGTAGAEPMNIKKRRDIVLYKCVFQKTTAGIYYSNWPRKNTDDAFERTICNKIY

SEQ ID NO: 27745 - protein, 377 aa, Solanum tuberosum
MADGEDIQPLVCDNGTGMVKAGFAGDDAPRAVFPSIVGRPRHSGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDSLMKILTERGYSFTTSAEREIVRDVKEKLAYIALDYEQELETSKTSSSVEKSYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 27746 - protein, 377 aa, Solanum tuberosum
MADAEDIEPLVCDNGTGMVKAGFAGDDAPRAVFPSIVGRPRHTGVMVGMGQKDAYVGDEAQSKRGILTLKYPIEHGIVSNWDDMEKIWHHTFYNELRVSPDEHPVLLTEAPLNPKANREKMTQIMFETFNVPAMYVAIQAVLSLYASGRTTGIVLDSGDGVSHTVPIYEGYALPHAILRLDLAGRDLTDCLMKILTERGYSFTTSAEREIVRDMKEKLAYVALDYEQELETAKSSSAVEKSYELPDGQVITIGAERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWITKGEYDESGPSIVHRKCF

SEQ ID NO: 27747 - protein, 688 aa, Bdellovibrio bacteriovorus HD100
MFSESLLISPAIAGVVGLIVALALYLRVKAQPAGNETMNRIASYVREGSMAFLVREYKVLFVYAIVVGLALWFALGGIAAGSFILGAFLSLLAGFFGMKAATYANVRTSQAAAGGSKAAALLVALDGGAVMGLSVAGLGLIGLGGLYVAFQGDAHLGTILHSFAVGASSIALFARIGGGIYTKAADVGADIAGKVVENIPEDDPRNPGVIADNVGDNVGDVAGMGADIYESMVAAIVSAMAIALTIPAEGLSALMTGADAETVRVAGVALPILLSTLGLVISIIVIFAARAFKNGKPATVLRNALIFPPILLTIAAYIILPMFGINQSVTVALAAGAFGGALIGLITEYYTAARPIRLVAEAALTGAGTGVIRGLAVGMESTAIPMLIVVIAAYVADQALGLYGIAMAAVGMLAGTAVVMTVDAYGPIADNAGGISEMSGLGKDVRAITDELDAVGNTTAAIGKGFAIGSAILTVVALFSAFNMEVNHVREGAGLAKMSLDLTSSGVLIGILLGSILPFLVGATTMTAVGKAAQKIVQEIARQFKEIPGLREGKAEPQPAKIVDIATQAALFEMILPGMIAILAPVAVGFLLGPQALAGLLAGGLAVGATMSLFMANAGGAWDNAKKYIEKGGLPGHPKGSDAHKAAVVGDTVGDPFKDTSGPGVAILIKVMSVVSLLIAQLIATIGG

SEQ ID NO: 27748 - protein, 475 aa, Bordetella parapertussis 12822
MSTQYRSFVAGQWQDGGEPVALYNPSDLQEEAGVYMHAPVEMVNQAVRAAEEALDAWRGLHAMARSRLLDGIADGLVGRRDELAMAIAREQGKPLRDALAEATRAADIFRYFASETIRQKGYTYASIRPGVRVEVQRNPVGVVALVTPWNFPVVIPAWKAAAALAYGNTVVMKPSEIAPCGAWILADVMREAGLPAGVFNLVLGAGQAGAALVAHEAVAAVSFTGSVATGKRIAAAAAGKRIQLEMGGKNPLIVLDDADLDTAVACAIDGAFLYAGQRCTASSRIIVTEGIHAAFVKRLLAQTASLAVGHALDEATVIGPVVNAEQFEKNRRYADLARQEGGTVAGGRALSRPTRGHYFEPCLVTGLDNSATVCREEVFGPFACVLTARDYEHALAIANDTPFGLSSGLCTTSMKHAQHFKAHTKSGLASINTSTSGVDFHVPFGGNGASSYGPREQGEFAIEFFTTLRTVYIGD

SEQ ID NO: 27749 - protein, 320 aa, Oryza sativa (japonica cultivar-group)
MTRRFWSSHHGSTKLCHCHYSGNFSRYLIAIAISVGLPDSVGGVLSGPVSNVATRWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDKHAVGGCGDITVWLGDLNYRLQGISSIPARKLIEENRQSKLRGKDQLLQEAEKGEVFNGYCEGTLLFKPTYKYNIGSSNYDTSYKIRVPSWTDRILFKVDHTSGLDAVLNSYEALDCIRSSDHKPVRAHLCLKVHGDSA

SEQ ID NO: 27750 - protein, 380 aa, Alnus glutinosa
MSSTAGQVIKCKAAVAWEAGKPLVIEEVEVAPPQANEVRVKILFTSLCHTDVYFWEAKGQTPLFPRIFGHEAGGIVESVGEGVTDLKLGDHVLPVFTGECKECRHCKSEESNMCDLLRINTDRGVMLNDGKTRFSINGKPIYHFVGTSTFSEYTVIHVGCLAKINPAAPLDKVCVLSCGISTGLGATLNVAKPKKGQSVAVFGLGAVGLAAAEGARIAGASRIIGVDLNPARFEEAKKFGVTEFVNPKDHDKPVQEVLAEMTDGGVDRAVECTGSIQAMISAFECVHDGWGVAVLVGVPSKDDAFKTHPMNLLNERTLKGTFFGNYKPRTDIPGVVEKYMNKELELEKFITHSVPFSEINKAFDLMLHGKSIRCIITMGA

SEQ ID NO: 27751 - protein, 368 aa, Malus x domestica
MGKGGQSCNGMVRQAKPVEQENMAAWLVDVNTIKILPFKLPSIGPNDVRIRIKAVGICGSDVHYLKTMKCADFEVKEPMVIGHECAGIVDKVGSEVKHLVPGDRVAVEPGISCARCQQCKGGRYNLCPDMKFFATPPVHGSLANQIVHPADLCFKLPENVSLEEGAMCEPLSVGVHACRRANVGPETTVLIIGAGPIGLVSVLTARAFGAPRIVIVDMDDKRLAMAKSLGADEAVKVSTKMEDLDDEVAEIKKAMISEVDVTFDCVGFNKTMSTGLNATRPGGKVCLVGMGHGVMTVPLTPAAAREVDVVGVFRYQNTWPLCLEFLRSGKIDVKPLITHRFGFTEKEVEEAFATSARGGNAIKVMFKL

SEQ ID NO: 27752 - protein, 1139 aa, Hordeum vulgare subsp. vulgare
MSSSRSNSRSACSRGSSARSRHSERVVAQTPVDAQLHAEFESSHRHFDYSSSVSALNRSGASTSSAVSAFLQNMQRGRYIQPFGCLLAIHPESFALLAYSENAAEMLDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDGNLSQPISLCGSTMRAPHGCHAQYMANMGSIASLVMSVTVNEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSAPSEGEIKKIAAWLLECHDGSTGLSTDSLLEAGYPGASALGEVVCGMAAIKISSKGFIFWFRSHTAKEIKWSGAKHEPGDADDNGRRMHPRSSFRAFLEVVKWRSVPWEDVEMDAIHSLQLILRGSLQDEDANDNNVRSIVEAPSDDVRKIQGLLELRIVTNEMVRLIETATAPILAVDIVGSINGWNGKVAEITGLPTTEAIGMLLVDLVEGDSVEVIKQMLNSAMQGTEEQNFEIKLKTFHQQESNGPVVLMVNACCSRDLSDKVVGVCFVAQDLTGHKMVMDKYTQIQGDYVAIVKNPNELIPPIFMINDLGSCLEWNEAMQKITGIKREDAIDKLLIGEVFTLHDYGCRVKDQATITKLSILMNTVISGQEPEKLAFGFFSTDGKYMESLLTANKRTDAEGKITGALCFLHVPSPELQHALQVQKMSEQAAARSFKELTYIRQELKNPLNGMQFTRKLLEPSDLTEEQRQLFASNVLCQEQLKKILHDNDLEGIEQCYMEMNTVEFNLEEALNTVLMQGMSLSKEKQISLDRDWPVEVSSMYLYGDNLRLQQVLADYLACTLQFTRPAEGPIVLQVIPKKEHIGSGMQIAHLEFRVVHPAPGVPEALIQEMFRHGPGVSREGLGLHISQKLVKTMSGTVQYLREAESSSFIVLVEFPVAQLNSKRSKPSTSKSNF

SEQ ID NO: 27753 - protein, 409 aa, Campylobacter upsaliensis RM3195
MLIIEDVRAFEVLDSRGNPSVKAEVILSDGSSGSAIVPSGASTGSKEALELRDGEARFGGKGVLKAVSNINENIADEITGLDAFNQTQLDTILRELDGTKNYSKLGANATLGVSMANARAVANSLGMPLYRYLGGANASVLPVPMCNIINGGAHANNSVDFQEYMIMPYGFTSFKEGLRAVCEIYAILKKELANGGHSTALGDEGGFAPNLANNTEPIEFLMTCIKKAGYEKQIKIALDVASTEFHKDGKYHLEGRTFTSDELIARYVELCAKYPICSIEDGLAENDFEGWIKLTKELGNKIQLVGDDLFVTNEEILKEGIEKKMANAILIKPNQIGTLTQTMRTVRLAQRNNYKCIMSHRSGESEDAFIADFAVALNTGQIKTGAPARADRTAKYNRLLEIELENDEI

SEQ ID NO: 27754 - protein, 756 aa, Schizosaccharomyces pombe
VCPHIEHGFQIMSKSLSSLVGEILTNINRYLKDQLQGPDTDDSALITSFYIKVLDCVRIRFRKLMSFTRILKAHLENSCEYVIKENSLSLLIQRLEESNHVLTYTASIEHEGAYVIVPGHLVDSPNILREVLSMTFNKGDNNFESVPPYAVVLAPDSSICWNGHVTDLDIPEVSISIAPNCVRLVTLATANQLSVIEDYFISIVGDTVSLVDSAKANSSKINKQMTKIKRNSLKLALSLLDVIQTIRTRYHGMNCQNLIHYSFSYAIEFAQRLMRLSILDASSIGLIRRKMIQLAISWVGFIYEDCSPTDRNTFRWTVTALEFAMIMTYGSNILMIDKKSFEELKEKVGKCVALLLLHFDVMGTKHAGRSMDQQAGDIPARLVRNNSDRSRLSDNELASFVKEEVMHRIIELESNRRDRLYKSQLIGRVLDDTTKENRLLKELASSKSNITIRWQQGGLIGSGSFGTVYRAVNLDTGDLMAVKEVALHKPRISRPMIKRIKGEMLVLELFDHPNVVSYYGIEVHREKVNIFMELCQGSSLFEFLRYGRIEDELVIQVYVLQLLEGLAYIHSCGVSHQDVKPENILFDHNGIMKFTDFGSAKMSGSASTKIFEQLTQQEEEEFEKDSEFLQHLDQNRGYSLTGTPTYMAPELILGNPSERVGAMDIWSLGCVIVEMATGSPPWPRLDNHFSLMYHIAAHNPPIIPADDQLSPLGQNFLKRCFVSDPNQRATAAELLMDPWVYPLRAGTEFDLMNSSV

SEQ ID NO: 27755 - protein, 519 aa, Oryza sativa (japonica cultivar-group)
MNGEEAPAGSGGGGGGRAEIDTSAPFESVREAVDHFGGGAAAVWSSCLVNRMLTPPKEHDQMNGQTLQLEKELIIKESQTLDVLKELESSKRIISDLKLKVQNDSAITGHPGQTEAPGAGPEERRSSENVETDGELGGLDSQNLQPPSSVLMQLEQAKAYLTRTTADLAEIRASVESLCNEIAKEKILVERSREKVCSNTSLISSLEGELDRTTHKLQTLNDRQRRREDSSHILMEIKKVTSEIEQLKSASNASKSEATMLAAEIEQTKASIATAEVRCLAAKKMEDAARAAEALALAEIKALLSGEASAGDLQGTDGVNLSLEKYFELASKAQECDVSSRKKIEAAMLQVEEANRSKSNSLNKLEEAKLEFEKCKIALQDALKRAHAANRGKLAVEESVRRWLSESGYKRHSFHDSSKLKNAADITDVSKSFLKPTLSIGQILNLKLMGPDGYDKSVWDDTTEASNVSLGQILNRRNAVFCNSDITSQKILSGKRKKFAFTGLSVLLAKQAKRQEQEK

SEQ ID NO: 27756 - protein, 641 aa, Oryza sativa
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWYFTFFSHPALIFIYDPSMALMNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWEILYSIKPELIDYPSSFKSPVSSGTKTVLLPEARARVFKSNYSQSLGELKILRSSWLVASFSESGKAGFSSFWLLVHFLDFTTTASQNLDQKLDCLGELLIMGEAAAARSSPNRPFVSLYQQPW

SEQ ID NO: 27757 - protein, 577 aa, Bacillus cereus E33L
MNRGRDVMSKFTVASNGSLETTLRGVEILSTPFLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDLSGIEEAFANIGATAENIDLVVVTDGEGILGIGDWGVGGINIAIGKLAVYTAAVGIDPSRVLPVILDVGTNREELLDNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMEDLLDFQMPYARKEAEVSEWKENGVIGLAEVVKQVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENLSDNDIKIAVKEAIWEPEYRQIKAVEKVTI

SEQ ID NO: 27758 - protein, 129 aa, Triticum aestivum
MDQGDVAVAVPPAAPSSSCAGAGCKKGKRFEIKKWNAVALWAWGKLLSLARSLWAWDIVVDNCAICRNHIMDLCIECQANQASATSEECTVAWGVCNHAFHFHCISRWLKTRQVCPLDNSEWEFQKYGH

SEQ ID NO: 27759 - protein, 495 aa, Oryza sativa (japonica cultivar-group)
MGPPQQARGGGIDIEACARPIAVDHRIKLPYYFRIAGNLLRQAKIYRDENNLVDLYVILLRYSRWKLIEVLSELESLKPVVQRQITEHNRARGGAIESNSINGTIAVNNITKQHMTNPYTYQPFVGSNNGSFERPVPGGNHQMAPLMSAQPDRLTRKQLANLPFPKEETLARHSILGPNGLHGQWTGPVTAIKVQYPSNLDIIKSDVSSLFPSVLNQDGQNGPSTISTDSTQIENDDMKSVLSLDDGRWSKLAEECASVPSVSLEEELSQLSIKQPSPPPVLAELERRPIAPSEVADPTPGLAVSETGRYQNLHVPVKLMECFLRVAEANTKRSLETCGVLAGTLKKRTFYVTALIIPKQKSTSDSCEATNEDELFDVQDKGSLFTLGWIHTHPTQSCFLSSIDLHNHYSYQNIIAYPDMVMLPEAIAIVMAPTDTRRKHGIFHLSDPGGMGVIHDCPERGFHPHKAPLDGSPIYEHCSHVYMNPDVKFDVIDLR

SEQ ID NO: 27760 - protein, 421 aa, Campylobacter upsaliensis RM3195
MSNTITLIDNRNGKSCEFPIYNATLGPSVVDMSSFYKQTGMFCYDEGLTSTATCKSQITYIDGEKGILKHRGYSIEWLAENKLFLDVVHLLLYKELPSAERLESFRYELKKRSFIHEGMHKLFDAFPDNAHPMAVLQGAVSSLSAFYPDHLNMNVKEEYMEMAARIVAKIPTIVATAYRYKNGFPMAYPNLDRGFTENFLYMLRTYPYDHVKLRPIEIKALDTVFMLHADHEQNASTSTVRAVGSTHAHPYACISAGIGALWGHAHGGANEGVIRMLEMIGTPDRVDEFIKKAKDKNDPFRLMGFGHRVYKNFDPRAKVLKKLRDQLIDELDIDTNLIKVATKIEEIALQDDYFVQRNLYPNVDFHSGLILKALGIPNEMFATLFVIGRTPGWVAQWIEQKEQESLKIVRPRQLYLGEVEK

SEQ ID NO: 27761 - protein, 56 aa, Brassica napus
DWLVEVSEEYKLASDTLYLAVNLIDRFLSNNYIEKRRLQLLGVTCMLIASKYEEIY

SEQ ID NO: 27762 - protein, 359 aa, Cenarchaeum symbiosum
MARARHGMYIYPREWPAAVKAAFVSDQSVEVREVDDPVPGPGEVLVEMAACGICGSDVERVYGSYSQPSMRLGHEPAGTVVQSRAGGISGGDRVFTHHHVPCYSCHYCTRGSETMCTEYSKSNLSPCGLAQRYVVPRHNIMHGGIIRLPEKITFEDAALIEPLACCIRAWRKAPISEGDAIGIIGVGATGMMHAMLAKSMGASKVFCIDTNPFRLEFARKCNVGEPIGATDPDRMDKILDGTENRGVDVAMVATGNIGALQEGIQMVRKGGTAVMFGVPSTGAAMNLDMAGLYSREVTLASSYAASDRDTREALKLMSSGGIDVSPLITHRYPLEDSQRAFEHARGGADSMKIVITGKA

SEQ ID NO: 27763 - protein, 589 aa, Legionella pneumophila str. Paris
MNQEISNFSTFNFSSALNKALEDMKFITPSPIQAQTIPLILEGRDAIALAQTGTGKTAAFALPILQNLSPEISTTQALILAPTRELAIQVAEQFELLSKYQRNVTIAVLCGGQEYGRQLKQLRSGAQVVVGTPGRILDHIDKGTLLLNNLKTFILDEADEMLRMGFIEDVETILEKLPEKKQMALFSATMPYRIRQIANTYLNDPASIEIRMETATVKSIEQRFLFASVHQKPDALIRVLEVEDYQGVIVFVRTKSSTEEVAELLQQHGLRAMAIHGDITQSLRERIIAQFKQGAIDILVATDVAARGLDVERVTHVINYDMPHDNETYVHRIGRTGRAGRSGVTILFVTPKESRLISSIERHTRQRIEKVQVPNDHMIQMARQQRFMSNITTRLNHEHVYSYKRIVEEYIKEHDVSAVDVAAALALLLHKDMPWRKELNMPKAASAFKEERARVGEKGLDLRGRFKEDRKSSFADRKGARGSKKDFAKDFSNERKKFNDGRKAVNQESVAQDLFRIDVGKIHGVKPGNIVGAIANEAGLQSRYITGLKIHEDHSTVRLPKGMPKEVMKDLTKAWVCGRQLNLTLIGSA

SEQ ID NO: 27764 - protein, 284 aa, Malus x domestica
ILPFKLPAIGPNDVQIRIKAVGICGSDVHYLKTMKCADFEVKEPMVIGHECAGIVDKVGSEVKHLVPGDRVAVEPGISCAHCQQCKGGRYNLCPDMKFFATPPVHGALANQIVHPADLCFKLPENVSLEEGAMCEPLSVGVHACRRANVGPETTVLIIGAGPIGLVSVLAARAFGAPRIVIVDMDDKRLAMAKSLGADDTVKVSTKMEDLDDEVAEIKKAMISEVDVTFDCVGFNKTMATGLNATRPGGKVCLVGMGHGLMTVPLTPAAAREVDVVGVFRYKNT

SEQ ID NO: 27765 - protein, 273 aa, Bdellovibrio bacteriovorus HD100
MNHFEKYESYIPFDLLVPQNFLLATLALTSVVLIRYLALTTCFYVAFYRKSWPWAKSRQIYPTLPDKKIQLFEIKWSVISSGIFGLGGVLLGILWQTGWARFYLPLDEYGWGYLLLSGFLLSLLHDFYFYVTHRALHIPWLYRRFHAVHHASLQPSPWASFSFHPVESIIEALPLPLILLFLPLHPLVLLVYLTLMTLSAIVNHLGFELLPRGSARHPLGKWLISGTHHSGHHRYYKYNFGLFYTIWDHLLGTQHPAYEAQFMKNTGETDQST

SEQ ID NO: 27766 - protein, 376 aa, Mesorhizobium loti MAFF303099
MKADFYETLGVQKGADEKELKSAFRKLAMQFHPDRNPGDHSCEHKFKEINEAYETLKDPQKRAAYDRFGHAAFEQGGMNGGAQGFGAGGFADIFEDIFGDMMGGRQRRSSGGRERGADLRYNMEISLEEAFAGKTAQIRVPASISCTECSGSGAKPGTQPVTCSMCHGHGKVRATQGFFSIERTCPQCQGRGQTIKDPCPKCAGQGRVTEERSLSVNIPAGIEDGTRIRLANEGEAGLRGGPSGDLYIFLAVKPHEFFQRDGADLYCKVPISMTTAALGGSFEVTTLDGTQTKVKVPEGTQNGRQFRLKGKGMPVLRQPNVGDLYIQTAVETPQNLSRRQRELLEEFEQLSSQDNSPQSSGFFARMKDFFESFGER

SEQ ID NO: 27767 - protein, 388 aa, Oryza sativa
MMASSSSSSSLCDNHLLQDDLIPWPSMPFAPAPNTFGLNHQWSQPPMLSSSTDQLSSYELESLQSVESQLAAAAPPTLSPHLQAHQLSTVLMMQELGFQWSSCAAPADQHSIASSTNNNSNVMMNEEELRPRPDQSLISNPRSCSATTLLPPPHLHLDGAVLPSINVSRLQKLAAGDEPLQICCKRQAAAAAVVGHSSIRDEHVPCPYAGPPAHLIQGPSNTLQMKRNTNAAAQGRGGRHGSSTEHRSSTALPPSSKKPRLESHSSSMLPSFKVRKEKLGDRIAALQQLVSPFGKTDTASVLMEAIGYIKSLQDQVETLSGPYLRSSKNSKKLACRAAQQQRKGTSNGGDAAAKLDLRSRGLCLVPLSCTSYVTNENGVWPPPNFRGN

SEQ ID NO: 27768 - protein, 1118 aa, Arabidopsis thaliana
MNSQQSTRTKQMLQQSSTHLLCGVVLLQLFAAQVDAQRSTSPWQTLSGDAPLVIARGGFSGLFPDSSLAAYQFAMVVSVADVVLWCDVQLTKDGHGICFPDLNLANASNSEEVYPNRQKSYPVNGVTTKGWFPIDFSLTELQKVLFSLIRGILSRSGKFDENGYSISTVQNVATQMKPALFWLNVQHDEFYEQHNLSMSSFLLSTSRTVSIDFISSPEVNFFRKIAGGFGNNGPSFVFQFMGKEDFEPTTNRTYGSILSNLSFVKTFASGILVPKSYILPLDDKQYLLPHTSLVQDAHKAGLKLYASGFANDVDIAYNYSWDPVSEYLSFVDNGNFSVDGMLSDFPLTASASVDCFSHIGRNATKQVDFLVISKNGASGEYPGCTKLAYEKAIKDGSDVIDCPVQMSSDGIPFCSSSIDLVNSTTVGQTHLRNRSIIVPEISSVAGIFTFSLTWHEIQSLTPAISNPFRENGMSRNPNERNSGNLISLYEFLNLAKNSTSLSGILISLENVVYLREKKGLDVVKVVLNRLTETGYIVGTLKVMIQSTTRLVLVDFKNQSTYKTVYKIKETIGNITDSAIEDIKKFANAVVINKASVFPNSDSFLTGQTTNVLERLQKFQLPVYVELFQNEFVSQPFDFFADETVEINAYIFGAGINGTITEFPYTAARYKRNRCLGREEVPPYMLPVNPGGVLTLISTSSLPPAQDPNPIFTHDDVTEPPLPPVIAKSPTSTLGTPSTIAKPLRNFLKVIRIVSWSVAGVVLFLVLLTLVFCFHRKRETRLRQQKLKALIPLEHYTYAQVKRITKSFAEVVGRGGFGIVYKGTLSDGRVVAVKVLKDTKGNGEDFINEVATMSRTSHLNIVSLLGFCSEGSKRAIIYEFLENGSLDKFILGKTSVNMDWTALYRIALGVAHGLEYLHHSCKTRIVHFDIKPQNVLLDDSFCPKVSDFGLAKLCEKKESILSMLDTRGTIGYIAPEMISRVYGNVSHKSDVYSYGMLVLEIIGARNKEKANQACASNTSSMYFPEWVYRDLESCKSGRHIEDGINSEEDELAKKMTLVGLWCIQPSPVDRPAMNRVVEMMEGSLEALEVPPRPVLQQIPISNLHESSILSEDVSVYTEG

SEQ ID NO: 27769 - protein, 440 aa, Davidiella tassiana
MPISKIHSRYVYDSRGNPTVEVDIVTETGLHRAIVPSGASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSAAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYKQLAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKAVYAGDNFRTAINL

SEQ ID NO: 27770 - protein, 181 aa, Zea mays
  misc_feature (84)..(84): Xaa can be any naturally occurring amino acid
  misc_feature (146)..(146): Xaa can be any naturally occurring amino acid
  misc_feature (153)..(153): Xaa can be any naturally occurring amino acid
  unsure (1)..(181): unsure at all Xaa locations
MASASMLARSLLRTPDPTQTSHPNRRSAAVVSFPRRHRRLSVRASVSTASPSPPPQPAAAAAGVPKHCFRRGADGYLYCEGVRXEDAMTAAERSPFYLYSKPQILRNFAAYRDALQGLRSIIGYAVKGNNNLPVLRVLRELGCGAXVLVSGNXELRLALQAGFDPARVHINREMGKTLETS

SEQ ID NO: 27771 - protein, 130 aa, Arabidopsis thaliana
  misc_feature (91)..(91): Xaa can be any naturally occurring amino acid
  misc_feature (103)..(103): Xaa can be any naturally occurring amino acid
  unsure (1)..(130): unsure at all Xaa locations
CWSQTPRVPDLEEFYAVFRSMVVSPAQATMVCPFNGLKNSDDLPATQQANNDITSISCNGGRVNCMQVCAPHVKKKCETLYYLPDLTEYEXAKEVDYLIHNKXIPYVEFELEHGFVNREHVNSPGYYDGR

SEQ ID NO: 27772 - protein, 93 aa, Zea mays
  misc_feature (63)..(63): Xaa can be any naturally occurring amino acid
  misc_feature (76)..(76): Xaa can be any naturally occurring amino acid
  misc_feature (78)..(78): Xaa can be any naturally occurring amino acid
  misc_feature (81)..(87): Xaa can be any naturally occurring amino acid
  misc_feature (89)..(90): Xaa can be any naturally occurring amino acid
  unsure (1)..(93): unsure at all Xaa locations
MVRISVLNDGLKSMYNAEKRGKRQVMIRPSSKVIIKFLIVMQKHGYIGEFEYVDDHRSGKIVXELNGRLNKCGVIXPXFDXXXXXXXGXXSYL

SEQ ID NO: 27773 - protein, 259 aa, Euphorbia esula
MDSSKDRETFVYLAKLAEQAERYDEMVESMKKVANLDVELTVEERNLLSVGYKNVVGSRRASWRILSSIEQKEESKGNEINAKRIKEYRNKVESELSTICSDIMTVIDEHLIPSCNAGESTVFYYKMKGDYYRYLAEFKAGNDKKEAADQSLKAYQTASTTAETDLPPTHPIRLGLALNFSVFYYEIMNSPERACHLAKQAFDEAISELDTLSEESYKDSTLIMQLLRDNLTLWTSDIPEDGDQKMETSGKASGGEDAE

SEQ ID NO: 27774 - protein, 489 aa, Nocardia farcinica IFM 10152
MTQSSGDPIQVSHLIGGQWRPASDGATFESRDPHDDSLLAVVPRGTAEDGTAAITAARTAFDEGPWPRLAPKERAAILHAVADAVDAHRDELAELETRDGGKTISQARHAEIPRVAHNLRFFADYAAMAANEAYPAGDLFSYVLYPPAGVVSAISPWNAPLMLATWKIAPALAFGNTAVLKPAPQTPLTAHRFAQLALEAGLPEGVLNVVHGFGGEAVAGPLTSDPRVDRITFTGSSATGVKILQAAAANHTPVSAELGGKSANIVFADADLDVAVPMAIRAIFGGNGQVCLAGSRLLVQHSIMDEFLARFTEEANKLTVGDPKDPATFLGPLIEARHLDKVHGYVELAQDEGGKVVTGGARLTGPDHAAGHYYPPTIITGLTNDSRTAREEIFGPVETVLGFDTEDEALRIANDSPYGLAGMLFTQNLDRAHRMAARWRAGTVWINCFFERDLRLPFGGEGASGVGREGGQYSREFFTEPRAVTLRLR

SEQ ID NO: 27775 - protein, 361 aa, Glycine max
  misc_feature (26)..(26): Xaa can be any naturally occurring amino acid
  unsure (1)..(361): unsure at all Xaa locations
MVAEAEVVCQQNVGVLDVKHFPNKVXVKSADRISDAALESAVLQFIPCIRSGSFADIGPRRYMEDEHIRIDDLSSHLGSLYNFPKPSAFYGVFDGHGGPEAAAYIRKHVIKFFFEDVSFPQTSEVDNVFLEEVEDSLRKAFLLADSALADDCSVNSSSGTTALTALIFGRLLMVANAGDCRAVLCRKGEAIDMSEDHRPIYLSERRRVEELGGYIEDGYLNGVLSVTRALGDWDMKLPKGAPSPLIAEPEFRQVVLTDDDEFLIIGCDGIWDVMSSQHAVSLVRKGLRRHDDPEKCARDLVMEALRLNTFDNLTVIIVCFSSLDHAEPEPSPPRQRKLRCCSLSAEALCSLRSLLEGSASN

SEQ ID NO: 27776 - protein, 410 aa, Triticum aestivum
MELRLRAPVSRASASPRGTSVSPSPRPHPGLPSQPIQKRLSGSAVSVSRRGTAARSSPCSALMTASYNTGTPDLVDFDWETLGFQLVPTDFMYIMKCSSDGVFTKGELVPYGPIELNPAAAVLNYGQGLLEGLRAHRKEDGSVVVFRPKENALRMRIGADRLCMPAPSVEQFLSAVKHTILANKRWVPPTGKGSLYIRPLLIGSGAMLGVAPAPEYTFVVYVCPVGHYFKDGLSPISLLTEEEYHRAAPGGTGDIKTIGNYASVVSAQRRAKEKGHSDVLYLDPVHKKFVEEVSSCNILMVKDNVISTPLLTGTILPGITRRSIIEIAQNLGIQVEERLIAIDELLDADEVFCTGTAVVLSPVGSIVYHGRRVEYGGGKVGAVSQQLYSALTAIQKGLVEDSMGWSVQLN

SEQ ID NO: 27777 - protein, 450 aa, Botryotinia fuckeliana
MSNLPSEPEFEQAYNELASTLENSTLFEKNPEYRTALKVVSIPERVIQFRVVWEDDKNQVQVNRGYRVQFNSALGPYKGGLRFHPTVNLSVLKFLGFEQIFKNALTGLNIGGGKGGADFDPKGKSDNEIRRFCVSFMRELSKHIGADTDVPAGDINVGGREIGFLFGAYKAIQNKWEGVLTGKGGSWGGSLIRPEATGYGLVYYVAHMIQYAGQGSFQGKRVAISGSGNVAQYAALKCIELGATVVSLSDSQGSLIAEGDAYFTPEDVGKIAELKLKRQSLTAFEHGGKYKYIEGSRPWTHVKVDVALPCATQNEVSKEEAESLVASGARYIAEGSNMGCTQEAIDVFEAERKEKKDKAIWYAPGKAANAGGVAVSGLEMAQNSARISWTQEEVDEKLKDIMKNAFETGLETPKKYVEAKDGEYPSLVAGSNIAGFVKVASAMHNHGDWW

SEQ ID NO: 27778 - protein, 418 aa, Gibberella zeae PH-1
MSLSNKLSIADVDVKGKKVLIRVDFNVPLDADKNITNNQRIVGALPTIKYALENGAKSVILMSHLGRPNGSPNEKYSLKPVVAELEKLLSKKVTFAPDCVGPEVEEIVNKAEDGSVILLENLRFHIEEEGSSKDKEGNKTKADKAQVEAFRKGLTALGDVYINDAFGTAHRAHSSMVGVDLPQKASGFLVKKELEYFAKALENPQRPFLAILGGAKVSDKIQLIDNLLDKVNTLIICGGMAFTFKKTLENVSIGNSLFDEAGSKTVGNLVEKAKQKGVKLVLPVDYITADKFDKDANTGYATDKDGIPDGWQGLDCGEESVKLYKEAIADAKTILWNGPAGVFEFEKFASGTKATLDAVVDAVQKDGKIVIIGGGDTATVAKKYGVEDKISHVSTGGGASLELLEGKELPGVTALSSK

SEQ ID NO: 27779 - protein, 634 aa, Ustilago maydis 521
MVPFARCPRSVPIVSSQPFCLAGTWRLVPSGSCSQRSLSRCRGIASTPTVLSPSSIPNSKPYYVTTPIFYVNADPHIGHLYSDVIADALARYHGYMRSGYSTYNHCDGPNPSTNSMTDMVRPMFSTGTDEHGLKMQKVAEAASEDPRALCDRISQRFKHLADAANISYTHFIRTTDTDHKVAVEHLWRTLRDKGHIYQGSHEGWYAVSDEAFYPEGQVKTVVGEDGKEVRQSIETGAKVEWSQEVNYKFRLSNFQKPLVEWLRANPKAIQPAQKHAEVLAEVEAGLTDLSISRPSSRLSWGIRVPEDDEHSIYVWVDALTNYLTAAGYPFAASTGQAEGNVALSSAWPADVHVVGKDIVRFHAIYWPAMLLAAGLPLPRTILAHSHWTMNKAKMSKSRGNVANPFEAIDTFGLDALRFFLLRVGGNFGSDSDYNPTVLVEYHRKYLQGQLGNLVSRICAPKIHARLNDFARDAATHVLHRPLKEQVELHMDSESLSLCTALETSLTQLPANVDALMSDFEVAKVLELILESVIASTNELIQRLEPWSASTHPVVVLETVVLVTESLRISALLLQPFMPQKMSALLDTLKIPQGSRRHPKDLVVTDTDGRLVSHVVQRSESEGKPHPLFPRIEVA

SEQ ID NO: 27780 - protein, 239 aa, Glycine max
MALSVSSPSCVRVPSCFWKPNGKSCKERTKVSCAAHNDNKNPLVGIGIGVVTSCVMGLTALDADATRIEYYATVAEPLCEYNYVKSGLGYCDIAEGFGDEAPLGELINVHYTARFADGIVFDSSYKRARPLTMRIGVGKVIKGLDQGILGGEGVPPMRIGGKRKLQIPPHLAYGPEPAGCFSGDCNIPANATLLYDINFVESNEMDILLENMDQLVWQNLLPDYNYLKLLFLVSGVVHD

SEQ ID NO: 27781 - protein, 438 aa, Arabidopsis thaliana
MRRRSKKIKTENNSNPETSEERNKFDEIPHDLVIEILERLPLKSVARFLTVSKLWATTIRSPDFRKSYRGGSSSEPRTLIVSDLNFKEPNPKLHFFRPSISSPSFLSSLTCPFTYPRHEEYYYHHVNGLISVGYGTDQIVINPTTGKFITLPRPKTRRKLVISFFGYDSVSDQYKVLCMTERLRGHPEEASSQHQVYTLGAKQKSWKMINCSIPHRPWSWNAVCINGVVYYIAKTGEGMFRRCLMRFDLKSDNLDLCTILPEEIQTSLHDYFLINYKGKVAIPNQPNFYTYDVWVMNQEGGKIEWLKNITFTIKPRKGFVRYLFVTGTTHTGEFILAPTSYTDEFYVFHYNPDMNSFRKIRVQAPGVKFSFAQKASVVFSDHSLLRLDNLHIRGSTHTATGEFILAPRFYSDDLNVIHFNPDTNSFRSTKVEVYEDYE

SEQ ID NO: 27782 - protein, 517 aa, Triticum aestivum
MAASSPPKSQPITMGPLPPLVLALFLLPLLYLFFRGGSKGRSTQGARNAPGPPKQLPVLGNLLQLGGRPHRYFQSLTQKYGPVVQVQLGRVRMVVVASPEAAKEVLRTNDLHCCSRPNSPGARMLSYNFLDVAFGPYSDYWREMRKLLVLELLSVRRVQSFAYARAAEVDRLVSSLAGTPPGTPVDLSEQLYALSDGIIGTVAFGKMYGSESFERTSFQRMMDETLRVLGSFTFEDFFPSSALARWADALTGVASRRRRVFLRIDRFFDAVIDKHLEPGRLAAGVQEDMVDALVKMWRDQDGALALTRDNIKGILMDTFAGGIDTCAVTTIWIMAELMRNPRVMRKAQSEVRAAVGNKSRVYEEDAQGLKYLKMIVKENFRLHPPGPLLIPRETMQSCEIAGYSVPAGTRIHVNVWAMGRDPDIWDRPEEFFPERFEEAHVDFRGLHFELLPFGSGRRACPAIAMGVANVEVVLANLLYCFDWELPEGMKEDDIDMEETGQLVFRKKVALELVAVKR

SEQ ID NO: 27783 - protein, 255 aa, Oryza sativa
  misc_feature (225)..(225): Xaa can be any naturally occurring amino acid
  misc_feature (249)..(249): Xaa can be any naturally occurring amino acid
  unsure (1)..(255): unsure at all Xaa locations
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKXPDVDGFLVGGASLKPEFIDIINSXATVKSA

SEQ ID NO: 27784 - protein, 116 aa, Xanthomonas campestris pv. vesicatoria str. 85-10
MTDTIFGKIIRREIPATIVYEDDEVLGFEDIAPQAPVHVLFIPKQHAFPTLDDVPPEQALLVGKLAIAAATYARAQGLAQDGYRIVMNCREHAGQTVFHLHLHLLAGAPLGRFGTP

SEQ ID NO: 27785 - protein, 294 aa, Erwinia carotovora subsp. atroseptica SCRI1043
MSKNITGVLTAIVTPFDNQGEFNPAAMRLQVQRQMRYGNGIFCNGTNGEFFVLHTDEKVAVTETCVDEVAGKVPVVGHIGEISTRETIKLGKRIAALGVDAVSVITPYFIPLKQEELIAHYTAVADALTVPVFLYNIPARTGNTLAPETVRTLADHPNIIGIKDSAGSYESLSGYVQAVKGVQGFNVLNGPDSLIHQGFVDGCSACISGLANVAPEAISQIWHRFHAGDIEGSRQAQEQVAELRKTLYAIAFSPAVVKKALAIMGEDVGVSRYPIQFSAQDEDNIRNILSQFSQ

SEQ ID NO: 27786 - protein, 764 aa, Mycobacterium tuberculosis H37Rv
MTIPRSQHMSTAVNSCTEAPASRSQWMLANLRHDVPASLVVFLVALPLSLGIAIASGAPIIAGVIAAVVGGIVAGAVGGSPVQVSGPAAGLTVVVAELIDELGWPMLCLMTIAAGALQIVFGLSRMARAALAIAPVVVHAMLAGIGITIALQQIHVLLGGTSHSSAWRNIVALPDGILHHELHEVIVGGTVIAILLMWSKLPAKVRIIPGPLVAIAGATVLALLPVLQTERIDLQGNFFDAIGLPKLAEMSPGGQPWSHEISAIALGVLTIALIASVESLLSAVGVDKLHHGPRTDFNREMVGQGSANVVSGLLGGLPITGVIVRSSANVAAGARTRMSTILHGVWILLFASLFTNLVELIPKAALAGLLIVIGAQLVKLAHIKLAWRTGNFVIYAITIVCVVFLNLLEGVAIGLVVAIVFLLVRVVRAPVEVKPVGGEQSKRWRVDIDGTLSFLLLPRLTTVLSKLPEGSEVTLNLNADYIDDSVSEAISDWRRAHETRGGVVAIVETSPAKLHHAHARPPKRHFASDPIGLVPWRSARGKDRGSASVLDRIDEYHRNGAAVLHPHIAGLTDSQDPYELFLTCADSRILPNVITASGPGDLYTVRNLGNLVPTDPDDRSVDAALDFAVNQLGVSSVVVCGHSSCAAMTALLEDDPANTTTPMMRWLENAHDSLVVFRNHHPARRSAESAGYPEADQLSIVNVAVQVERLTRHPILATAVAAADLQVIGIFFDISTARVYEVGPNGIICPDEPADRPVDHESAQ

SEQ ID NO: 27787 - protein, 335 aa, Streptococcus pneumoniae R6
MKRIAVLTSGGDAPGMNAAIRAVVRQAISEGMEVFGIYDGYAGMVAGEIHPLDAASVGDIISRGGTFLHSARYPEFAQLEGQLKGIEQLKKHGIEGVVVIGGDGSYHGAMRLTEHGFPAIGLPGTIDNDIVGTDFTIGFDTAVTTAMDAIDKIRDTSSSHRRTFVIEVMGRNAGDIALWAGIATGADEIIIPEAGFKMEDIVASIKAGYECGKKHNIIVLAEGVMSAAEFGQKLKEAGDISDLRVTELGHIQRGGSPTPRDRVLASRMGAHAVKLLKEGIGGVAVGIRNEKMVENPILGTAEEGALFSLTAEGKIVVNNPHEADIELSSLNKSLS

SEQ ID NO: 27788 - protein, 395 aa, Erwinia carotovora subsp. atroseptica SCRI1043
MSSETITVERSGKVHHAEGDAARLDAYIPSECPQNHAANLLHLPNGDVLCVWFGGTQEGIADISIYMSRLVKDSGSWSKAAKLSEDATRSEQNPVLFLAPDNVLWLLYTAQKSGNQDTAIVRYRQSTDLGATWGEIGTLLDQPGTFIRQPITVLENGDWLLPVFYCRVQPGEKWVGNDDDSAVKISSDQGKTWREYPVPNSTGCVHMNITPLQDGTLLALYRSRWADFIYQSRSTDGGKTWSEPVATDLPNNNSSIQVTTLKNGHLALVFNHMSAADATDRRLSLYDEIEDEEDKASGAKMPEVQAGDRSAFWGAPRAPMTLAISEDGGKSWPYQRNIEVGDGYCMTNNSTEKLNREFSYPSVKQAPDGKLHVAFTYFRQAIKHVVVSEEWVKAG

SEQ ID NO: 27789 - protein, 402 aa, Oryza sativa (japonica cultivar-group)
MATKRSVGTLGEADLRGKKVFVRADLNVPLDDAQKITDDTRIRASVPTVKFLLEKGAKVILASHLGRPKGVTPKYSLKPLVPRLSELLGVDVVMANDCIGEEVEKLAAALPEGGVLLLENVRFYKEEEKNDPEFAKKLAAVADLYVNDAFGTAHRAHASTEGVTKFLKPAVAGFLMQKELDYLVGAVANPKKPFAAIVGGSKVSTKIGVIESLLAKVDVLILGGGMIFTFYKAQGYAVGKSLVEEDKLELATSLIEKAKAKGVSLLLPTDVVVADKFAADAESKTVAASAIPDGWMGLDVGPDAIKTSSEALDTCNTIIWNGPMGVFEFEKFAAGTDAIAKKLADLTTTKGATTIIGGGDSVAAVEKAGLADKMSHISTGGGASLELLEGKTLPGVLALDEA

SEQ ID NO: 27790 - protein, 205 aa, Triticum aestivum
  misc_feature (175)..(175): Xaa can be any naturally occurring amino acid
  unsure (1)..(205): unsure at all Xaa locations
MTRGRLLRSSSPASLSFCPHLSPAHGSDAMAAPLRRVFPSLGRALLSPTPARMLSAEASDALVEIKPGEIGMVSGIPEEHLRRKVLIYSPARTASQQGSGKVGRWKINFVSTQKWENPLMGWTSTGDPYANVGEAGLTFDSAESAKAFAEKHGWEYVVRKRHTPLLKPKTYAENXKWKGPRRRRKQLNCGLLSGDLKDLFSLPLG

SEQ ID NO: 27791 - protein, 264 aa, Nicotiana tabacum
NPILREEMAKESYEQAIAALEKLLSEKGELGPIAAARVDQITAELQSSDGSKPFDPVEHMKAGFIHFKTEKYEKNPALYGELSKGQSPKFMVFACSDSRVCPSHVLNFQPGEAFVVRNIANMIPAYDKTRYSGVGAAIEYAVLHLKVENIVVIGHSACGGIKGLMSLPADGSESTAFIEDWVKIGLPAKAKVQGEHVDKCFGDQCTACEKEAVNVSLGNLLTYPFVREGLVKKTLALKGGHYDFVNGGFELWGLEFGLSPSLSV

SEQ ID NO: 27792 - protein, 176 aa, Wolbachia endosymbiont of Drosophila mojavensis
  misc_feature (9)..(9): Xaa can be any naturally occurring amino acid
  misc_feature (175)..(176): Xaa can be any naturally occurring amino acid
  unsure (1)..(176): unsure at all Xaa locations
MEHLSGLNXGVKENFNVNYFDLNAFAATSGPGLIGGLIVGTMMVKAIAHVAQKPFIAVNHLEAHALVIRLLHEVKFPFLVLIISGGHCQFLIAQDVGKYIKLGETLDDSLGEAFDKVAKMLGLSYPGGPLIEKLAKKGNGARFKLPRAMIKRYGCNFSFSGIKTAVKNLVQELKXX

SEQ ID NO: 27793 - protein, 416 aa, Mycoplasma genitalium
MLSSNMLNFKTLQAIDFQNKTVVLRSDFNVPMINGVISDSERILAGLDTIKFLVKKNCKIVLLSHLSRIKSLEDKLNNKKSLKPVAELLQQLLPTVKVQFSCKNTGAEVKQKVQALAFGEILLLENTRYCDVNDKGEIVKLESKNDPELAKFWASLGEIFVNDAFGTAHRKHASNAGIAKYVAKSCIGFLMEKELKNLSYLIQSPQKPFVVVLGGAKVSDKLKVVENLLKLADNILIGGGMVNTFLKAKGKATANSLVEKELIDVAKQILDKDTHNKIVLAIDQVMGSEFKDQTGITLDVSDKIQEQYQSYMSLDVGSKTIALFESYLKTAKTIFWNGPLGVFEFTNFAKGTSKIGEIIAKNKTAFSVIGGGDSAAAVKQMQLSDQFSFISTGGGASLALIGGEELVGISDIQKNS

SEQ ID NO: 27794 - protein, 369 aa, Rhodococcus sp. RHA1
MAGWPTKLEGSTIPVTSTAAPGDYLAYTVREPVGVVAAIVAWNFPLLLAAWKLSPALAAGNTVILKPAEQTPLSAALLGDVLREAGIPDGVVNIVQGDGENVGAALSAHPGVDKVSFTGSTEVGRHIVGAARGNLKKVTLELGGKSPNIVFDDADIDAAIEGAAMAIFFNQGEACEAGSRLFIQSTVYDQVVEGVAKIASTLKVGDSLDPDTQMGPVVSEKQLDTVLGYLDSGRAEGATAVTGGGRKGDIGYFVEPTVLVDTTPNMRVVKEEIFGPVVTAIPFDDIDDIVRTANDTEYGLAAGIWTSDVSKAHNVAARIKAGTVWINSYHVLDPALPFGGYKQSGWGREHGAAVFDAYTETKTVILKKG

SEQ ID NO: 27795 - protein, 230 aa, Cryptococcus neoformans var. neoformans JEC21
MSSKPQQELAVPTHLPDPVLIIVMGPASCGKSTVGQDVADHFHIPFIDGDSLHPKSNIAKMSSGTPLTDEDRLPWLALIRSTAEKMCKEQSDEIAGKTRSEEDGGLGRAGVVIACSALKKWYRDILRGVVKADPPPAEDLNDALPDDAQVPATASLKTYFVYCYGTPELLKQRIASRKGHFFGQQMLDSQLAVLEDPSEEEGVTVANIDGTKEEVGERAVNGMKKLLGIN

SEQ ID NO: 27796 - protein, 483 aa, Saccharomyces cerevisiae
MARASSTKARKQRHDPLLKDLDAAQGTLKKINKKKLAQNDAANHDAANEEDGYIDSKASRKILQLAKEQQDEIEGEELAESERNKQFEARFTTMSYDDEDEDEDEDEEAFGEDISDFEPEGDYKEEEEIVEIDEEDAAMFEQYFKKSDDFNSLSGSYNLADKIMASIREKESQVEDMQDDEPLANEQNTSRGNISSGLKSGEGVALPEKVIKAYTTVGSILKTWTHGKLPKLFKVIPSLRNWQDVIYVTNPEEWSPHVVYEATKLFVSNLTAKESQKFINLILLERFRDNIETSEDHSLNYHIYRAVKKSLYKPSAFFKGFLFPLVETGCNVREATIAGSVLAKVSVPALHSSAALSYLLRLPFSPPTTVFIKILLDKKYALPYQTVDDCVYYFMRFRILDDGSNGEDATRVLPVIWHKAFLTFAQRYKNDITQDQRDFLLETVRQRGHKDIGPEIRRELLAGASREFVDPQEANDDLMIDVN

SEQ ID NO: 27797 - protein, 484 aa, Bacteroides thetaiotaomicron VPI-5482
MNNTTNEGSKLYLYSITSVAILGGLLFGYDTAVISGAEKGLEAFFLSASDFQYNKVMHGITSSSALIGCVLGGALSGVFASRLGRRNSLRLAAVLFFLSALGSYYPEVLFFEYGKPNMDLLIAFNLYRVLGGIGVGLASAVCPMYIAEIAPSNIRGTLVSCNQFAIIFGMLVVYFVNYLIMGDHQNPIILKDAAGVLSVSAESDMWTVQEGWRYMFGSEAFPAAFFGLLLFFVPKTPRYLVLVQQEEKAYTILEKINGKKKAQEILNDIKATAQEKTEKLFTYGVTVIVIGILLSVFQQAIGINAVLYYAPRIFENAGAEGGGMMQTVIMGIVNIIFTLVAIFTVDRFGRKPLLIIGSIGMAVGAFAVAMCDSMAIKGVLPVLSIIVYAAFFMMSWGPICWVLISEIFPNTIRGKAVAIAVAFQWIFNYIVSSTFPALYDFSPMFAYSLYGIICVAAAIFVWRWVPETKGKTLEDMSKLWKKNK

SEQ ID NO: 27798 - protein, 516 aa, Oryza sativa (japonica cultivar-group)
MIKQILGRLPKKEKPGKSGEKDLAGVGSSLPDARTTTDLTMSSRIANPNNYTAAVTNPGQNYTVKNAHHGGAGVSNGFLAPPVFEALPSLRDAPAPEKPSLFLRKVVMCYVVFDFTDPTKDVKEKEIKRQTLLELVDYVTSATGKFPEPAVQEVIKMVSTNLFRVPNPAPRENKPLESFDMEEEEPVMDPAWPHLQIVYELFLRFVQSPETDAKLAKRYVDHGFIIKLLDLFDSEDPREREYLKTILHRIYGKFMVHRPFIRKAINNIFYRFIFETEKHNGIAELLEILGSIINGFALPLKEEHKLFLVRALIPLHKPKCVSMYHQQLSYCVTQFVEKDCKLADTVIRGLLKYWPITNSAKEVMFLGELEEVLEATQPAEFQRCMVSLFCQIARCLNSSHFQVAERALFLWNNDHIEVLIKQNSKVILPIILPAIERNTKEHWNQAVQSLSLNVRKIFMDHDPVLFEECLKKFEEDEAKETALRSKREATWKRLEEIASSKTISSEPAVPPEATVH

SEQ ID NO: 27799 - protein, 248 aa, Zea mays
  misc_feature (224)..(224): Xaa can be any naturally occurring amino acid
  unsure (1)..(248): unsure at all Xaa locations
RVQRRGRTTAAPPSAVLSEMAAAAPAACKGKRKRHLSEDDVWLLLHRYHPGTILTALQEVAQHADGRRIDWRAVVAKSATGITSAREYQMLWRHFAYHHDVDESVDADDQPLDDDSDLELELEPDPNLTKEALCEASALAKALISGSSQASGHRINLDTHVLNTRNEKIVRVPSEKQLAQSHRVTNVAGPVSNFKQLAHIGPSAGLLDPNGPSKKRKKPKAWSXRKMQTLAAGVQKYGEGNWGGYFCI

SEQ ID NO: 27800 - protein, 474 aa, Ralstonia eutropha JMP134
MSKQFDVLVIGAGPGGYIAAIRAGQLGLNVACCEGNAYDDPKNEPRLGGTCLNVGCIPSKALLASSEEFENAQHHLADHGITVGDVKVDVSKMLKRKDDIVGKMTKGIEFLFRKNKVTLLKGYGKFVGKTAEGFQVEVAGEVVTAKQVIIATGSKARHLPGITVDNDLVSDNEGALKFPAVPKKLGVIGAGVIGLELGSVWRRLGAEVTVLEALPAFLGAADEGVAKEAQKQLTKQGLKFSLGVKVDEVTTGKSGVTVKYTDKDGAAQTLEVDRLIVSVGRVPNTDNLGLEAVGLAADQRGFIEVDDHCATKVPGLWAIGDVVRGPMLAHKAEDEGVAVAERIAGQKPHIDYNCIPWVIYTFPEIAWVGKTEAQLKAEGREFKAGQFPFMANGRALGMGHPEGFVKMLADAKTDEILGVHIVAANASDLIAEAVVAMEFKAASEDIGRVCHPHPSMSEVMREAALAVDKRQLNM

SEQ ID NO: 27801 - protein, 419 aa, Ralstonia eutropha JMP134
MAIVDVKVPQLSESVAEATMLNWKKKPGEAVAQDEILIEIETDKVVLEVPAPSAGVLSQIIKNDGDTVVADELIAKIDTEATAGAAAPAAAAPAPAAAAPAAAAAAAPAAAGAVAMPSAAKLMAEAGLSAGQVAGTGKDGRITKGDVLGASAAPAPAPAAKAAPAPAAAKPALPQVAANVDFAALGDRPEERVPMSRLRARIAERLVQSQSTNAILTTFNEVNMKPVMDLRNKYKDRFEKEHGVKLGFMSFFVKAAVHALKKYPVINASVDGNDIVYHGYFDIGIAVGSPRGLVVPILRNADQMSLADIEKKIAEFGAKARDGKLSLEELTGGTFSISNGGTFGSMLSTPIINPPQSAILGVHATKDRAVVEDGQIVIRPMNYLAMSYDHRIIDGREAVLGLVAMKEALEDPARLLLDL

SEQ ID NO: 27802 - protein, 645 aa, Magnaporthe grisea 70-15
MAGLSVGGGGPGNGPRSYIPPHMRGKVGGPGMNGPQNGPQNGGGPPGHDGPPSSVNNGLNNSAWAGNQNHDARGGNWGNQGGGPPPRNNNWNRPSFNPNAYGGGNQGGGHGGGGGGGYARGSGDGQWRDGKHIPGPVNARVERELFGTPDDPSKQHTGINFEKYDDIPVEASGHDVPEPVYTFSNPPLDDHLISNIELARYKVPTPVQKYSVPIVMGGRDLMACAQTGSGKTGGFLDLGGYGRQRKAYPTSLILAPTRELVSQIYDESRKFAYRSWVRPCVVYGGADIGSQLRQIERGCDLLVATPGRLVDLIERGRISLCNIKYLVLDEADRMLDMGFEPQIRRIVEGEDMPNVQDRQTLMFSATFPGYIQQLARDFLKDYIFLSVGRVGSTSENITQRVMEVKHRDDKISHLLDLLSTHGGGLTLIFVETKRNADELSDFLQNQNLPATSIHGDRTQRERERALEMFRTGRCPILVATAVAARGLDIPNVTHVINYDLPTDIDDYVHRIGRTGRAGNTGIATAFFDMKDNSGVAQELLNILKEAKQDIPPFLETAARMKSYGGGRGRGGGGRGRGGGGNRDFRKFGGGGGGGFNGGGGGGFSGGGYGGGGGGYGGGGGGYGGGGYGGGGGGSYGNPGGGQSWW

SEQ ID NO: 27803 - protein, 351 aa, Nocardia farcinica IFM 10152
MRAAVYYGPNKVDVVDVPEPEPGPGEVKLRVGFNGICGTDLHEYYAGPIFVPTEPHPLTHRQLPLVLGHEFSGTVTEVGSGVTGIEPGDRVAVEPLYTCGHCGPCRAGTYNICRRIGFHGLMSDGGMAEYTVVPAHMIHRLPDSVPLELGALVEPMSVAYHAATLGDPKPEDTAMVFGAGPIGIGLWFALRAKGLDDIYVVEPSPTRRAAIEALGATTLDPTAVDVPAFIDNATDGAGADATYDAAGVQPAVETALACLGARRPLISVAIYEKPLTTPLQRLVMNESRIQGSLCYTSADYRAVIDLMAQGRYDATGWVETIALEQVIDEGFEALHAGTKMKVLVDPAEVAA

SEQ ID NO: 27804 - protein, 877 aa, Oryza sativa (japonica cultivar-group) [sequence omitted]

SEQ ID NO: 27805 - protein, 290 aa, Novosphingobium aromaticivorans DSM 12444
MSTSPKTLPYAEVIGDPIAQSKSPVIHGFWLEALGLEGDYRRAHVRAGELADYLAARRADTDWRGCNVTMPHKQAVIPLLDRLDPLAARIGAVNTIVPEDGALVGYNTDAPGFLEPLRPLLDQVHYFRMARVLGTGGAARAIIAALADEHMVIVLAGRNVEKARALLDELHPEGEHHVAPLEHFSDETDFVFDDREGCLDLVVNASSLGMTGQPPLAFDMTHAPPGSVFYDIVTSPLETDFLKTAKAAGFRTVDGLSMLIGQADHAFRRFFGAVPPRGEADAQLRERLLA

SEQ ID NO: 27806 - protein, 694 aa, Vibrio cholerae O1 biovar eltor str. N16961
MQQQGGFATIAATDFPHPFISLTSHLGVDMSSRKQLANAIRALSMDGVQKANSGHPGAPMGMADIAEVLWRSHLNHNPQNPNWADRDRFVLSNGHGSMLIYSLLHLSGYELSIDDLKNFRQLHSKTPGHPEYGYAPGIETTTGPLGQGITNAVGMAIAEKALAAQFNKPGHDIVDHFTYVFMGDGCLMEGISHEACSLAGTLGLGKLIAFWDDNGISIDGHVEGWFSDDTPKRFEAYGWHVIPAVDGHDADAINAAIEAAKAETSRPTLICTKTIIGFGSPNKAGSHDCHGAPLGNDEIKAAREFLGWEHAPFEIPADIYAAWDAKQAGASKEAAWNEKFAAYAKAYPAEAAEYKRRVAGELPANWEAATSEIIANLQANPANIASRKASQNALEAFGKLLPEFMGGSADLAPSNLTMWSGSKSLTAEDASGNYIHYGVREFGMTAIINGIALHGGFVPYGATFLMFMEYARNAMRMAALMKVQNIQVYTHDSIGLGEDGPTHQPVEQIASLRMTPNMSTWRPCDQVESAVAWKLAIERKDAPSALIFSRQNLAQQPRSAEQVANIAKGGYILKDCAGQPELILIATGSEVELAVAAYEQLSAEGKAVRVVSMPSTDAFDKQDAAYREAVLPAAVTKRIAIEAGIADFWYKYVGFGGRIIGMTSFGESAPAGELFKLFGFTTENVVKQAKELLA

SEQ ID NO: 27807 - protein, 148 aa, Triticum aestivum
  misc_feature (87)..(87): Xaa can be any naturally occurring amino acid
  misc_feature (119)..(119): Xaa can be any naturally occurring amino acid
  misc_feature (139)..(139): Xaa can be any naturally occurring amino acid
  unsure (1)..(148): unsure at all Xaa locations
MASLVAVQPVAVRGLAGSSISGRKLAVRPASAAVSRSTRRARGAAVVAKYGEKSVYFDLDDIANTTGQWDLYGQATPRRPTTALQSXKFFNTFAAPFTKRGAGCSRSCCSGGRLAARPXVSATASPDLLPIKKGPQLPXPTPGPRGKI

SEQ ID NO: 27808 - protein, 392 aa, Vibrio cholerae O1 biovar eltor str. N16961
MRGQIMSVIKMIDLDLAGKRVFIRADLNVPVKDGKVTSDARILASLPTIKHCLEAGAKVMVTSHLGRPTEGEYAEEFSLLPVVNYLNDALDCEVRLVKDYLDGVELNAGELVVLENVRFNKGEKKNEEALSKKYAALCDVFVMDAFGTAHRAQASTHGVGMFAPIACAGPLLADELEALGKAMDKPARPMVAIVGGSKVSTKLTVLESLSKIADQLVVGGGIANTFIAAAGHNVGKSLYEADLVETAKKLMEECAIPVATDVACAKAFDENAEAEIKHVSEVQDDDMIFDLGPNSTAELAEILKNAKTILWNGPVGVFEFKNFEAGTRGIAEAIAQSEGFSVAGGGDTLAAIDKFGIKADVSYISTGGGAFLEFVEGKKLPAVEMLEARAKA

SEQ ID NO: 27809 - protein, 154 aa, Sorghum bicolor
MEYGQQGQHGHGTTGLDQYGNPVAARNRGMRTGTGHGAMLGLSTACSLAWVEHGQFQPAREGAKDRMHLHRSGSSSSSSSETDGMGGRRKKGIGEKIKEKLPGAHKDNQHATAPAAAAYGQQGHTGVRTYGTEGTASEKKGIMDKIKEKLPGQH

SEQ ID NO: 27810 - protein, 125 aa, Bdellovibrio bacteriovorus HD100
MKKVIHTDNAPKAVGPYSQAIQIGDMLFCSGQISIDPKTNEVFTGDIKTQTEMVLKNIEAVLAAANMKYSNIVKTTIFLTSMSDFATVNEIYSKAFTDAPPARSTVAVAGLPKGVNVEIEVIAHR

SEQ ID NO: 27811 - protein, 1530 aa, Schizosaccharomyces pombe
MNQNSDTTHGQALGSTLNHTTEVTRISNSSDHFEDSSSNVDESLDSSNPSSNEKASHTNEEYRSKGNQSYVPSSSNEPSPESSSNSDSSSSDDSSVDRLAGDPFELGENFNLKHYLRAYKDSLQRDDIITRSSGVCMRDHSVYGVGSGYEFLKTFPDIFLQPYRAITEKQVVEKAILSHCHALANAGELVMVLGQPGSGCSTFLRSVTSDTVHYKRVEGTTHYDGIDKADMKKFFPGDLLYSGEHDVHFPSLTTAETLDFAAKCRTPNNRPCNLTRQEYVSRERHLIATAFGLTHTFNTKVGNDFVRGVSGGERKRVTISEGFATRPTIACWDNSTRGLDSSTAFEFVNVLRTCANELKMTSFVTAYQASEKIYKLFDRICVLYAGRQIYYGPADKAKQYFLDMGFDCHPRETTPDFLTAISDPKARFPRKGFENRVPRTPDEFEQMWRNSSVYADLMAEMESYDKRWTETTPASSEAPEKDNFGSDISATTKHELYRQSAVAEKSKRVKDTSPYTVTFSQQLWYCLARSWERYINDPAYIGSMAFAFLFQSLIIGSIFYDMKLNTVDVFSRGGVLFFSILFCALQSLSEIANMFSQRPIIAKHRASALYHPAADVISSLIVDLPFRFINISVFSIVLYFLTNLKRTAGGFWTYFLFLFIGATCMSAFFRSLAGIMPNVESASALGGIGVLAIAIYTGYAIPNIDVGWWFRWIAYLDPLQFGFESLMINEFKARQFECSQLIPYGSGYDNYPVANKICPVTSAEPGTDYVDGSTYLYISFNYKTRQLWRNLAIIIGYYAFLVFVNIVASETLNFNDLKGEYLVFRRGHAPDAVKAAVNEGGKPLDLETGQDTQGGDVVKESPDNEEELNKEYEGIEKGHDIFSWRNLNYDIQIKGEHRRLLNGVQGFVVPGKLTALMGESGAGKTTLLNVLAQRVDTGVVTGDMLVNGRGLDSTFQRRTGYVQQQDVHIGESTVREALRFSAALRQPASVPLSEKYGYVESVIKLLEMESYAEAIIGTPGSGLNVEQRKRATIGVELAAKPALLLFLDEPTSGLDSQSAWSIVCFLRKLADAGQAILCTIHQPSAVLFDQFDRLLLLQKGGKTVYFGDIGEHSKTLLNYFESHGAVHCPDDGNPAEYILDVIGAGATATTNRDWHEVWNNSEERKAISAELDKINASFSNSEDKKTLSKEDRSTYAMPLWFQVKMVMTRNFQSYWREPSILMSKLALDIFAGLFIGFTFYNQGLGVQNIQNKLFAVFMATVLAVPLINGLQPKFIELRNVFEVREKPSNIYSWVAFVFSAIIVEIPFNLVFGTLFFLCWFYPIKFYKHIHHPGDKTGYAWLLYMFFQMYFSTFGQAVASACPNAQTASVVNSLLFTFVITFNGVLQPNSNLVGFWHWMHSLTPFTYLIEGLLSDLVHGLPVECKSHEMLTINPPSGQTCGEYMSAFLTNNTAAGNLLNPNATTSCSYCPYQTADQFLERFSMRYTHRWRNLGIFVGYVFFNIFAVLLLFYVFRVMKLRSTWLGKKITGTG

SEQ ID NO: 27812 - protein, 360 aa, Acetobacterium carbinolicum
FTGDFHAIGAANNLLAAMLDNHIKQGNELKIDAKKITWRRCVDMNDRQLRNIVDGLGGSGDGVVREDGFDITVASEVMAAFCLASDISDLKERLGRIIVGYSFAGDPITASQLKANGAMAALLKDALKPNLVQTLEGTPAFIHGGPFANIAHGCNSVIATRMAMHFADYVVTEGGFGADLGAEKFLDIKCRMANLKPDAVIIVATVRALKYNGGVPKADLNNENLEALKAGLPNLLKHVENITQVFKLPAVVAINEFPLDTPAELALVKDECQKLGVNVAISQVWAKGGEGGEELAREVVRLIDESEGTFEYCYELDMPIKEKIEAIATRIYGADGVDFTPIATKEMERLTALGFDKVPI

SEQ ID NO: 27813 - protein, 384 aa, Burkholderia thailandensis E264
MQSAAAPRSKLPDVGTTIFTVIGQLAAEHQALNLSQGAPSFAPDPALVERAARAMRDGHNQYAPMAGVAALRDALAVKTERLYGGRYDPDSEVTVVASASEGLYAAISALVHPGDEVIYFEPSFDSYAPIVRLQGATPVAIKLSPDGFRVNWDEVAAKITPRTRMLIVNTPHNPSATILGDADIAHLARLTAGTDIVVLSDEVYEHVVFDGARHHSMARHRALAERSVIVSSFGKSYHVTGWRVGYCLAPAELTRELRKVHQFMTFAADTPMQHAFAEALAEPASYLELGAFYERKRDLLASELAGSRFELQRSEGSFFMLARFRHFSDESDADFVLRAIRDARVATIPLSAFYADGTNTGCIRLSFSKDDATLIEGARRLRSL

SEQ ID NO: 27814 - protein, 122 aa, Ostreococcus tauri
MTSTSSRQLTSRLPPEVNRILYVRNLPFNVTSEDMHEIFGKFGALRQIRLGSQKNTKGTAYVVYEDIWDAKTACEHLSGFNVANRYLIVMYHQSARMRESVEKKREETRRLQETHGVTGDQR

SEQ ID NO: 27815 - protein, 367 aa, Acetobacterium carbinolicum
FTGDFHAIGAANNLLAAMLDNHIKQGNELKIDAKKITWRRCVDMNDRQLRNIVDGLGGSGDGVVREDGFDITVASEVMAAFCLASDISDLKERLGRIIVGYSFAGDPITASQLKANGAMAALLKDALKPNLVQTLEGTPAFIHGGPFANIAHGCNSVIATRMAMHFADYVVTEGGFGADLGAEKFLDIKCRMANLKPDAVIIVATVRALKYNGGVPKADLNNENLEALKAGLPNLLKHVENITQVFKLPAVVAINEFPLDTPAELALVKDECQKLGVNVVISQVWAKGGEGGEELAREVVRLIDESEGTFEYCYELDMPIKEKIEAIATRIYGADGVDFTPIATKEMERLTALGFDKVPICMAKTQY

SEQ ID NO: 27816 - protein, 607 aa, Bacillus cereus E33L
MCGITGWVNWNKDLSNEHVILKKMANRIQHRGPDAEGFWFSPRAAFAHRRLIVIDPEGGAQPKTFRAGDYTYALTYNGEIYNFRELREHLQKCGHTFETHSDTEVLLHAYLEWKEDCVQHLNGIFAFALWDDQKQRLFLARDHLGVKPLFYTERNDSIIFGSEIKALLAHPSVPAEIDANGINEIFGLGLFRTPGCGVFKHIEEVRAGHSITFTRDKKVVTKYWNLESKVHTDSIEDTSSHILSILQDTVKRQLIADVPLVCMLSGGLDSSGITALAGKEFAAENKTLHTYSVDFVNSAKDFELTFARTGLDAPWVKRVSEHVGTSHHDIIVNAEELANRLFVPLRAKDLPSAGEMETSLYLLFCEMKKDATVALSGESADEVFGGYPWFHQEELLYVDKFPWLTNWKNTSPLLLHEVSNQCNLENYIDTRFQKAILEVPTLEGESKKSAKQRQMFYLFLTRFLPFLLDRKDRMSMAVGFEVRVPFCDYRLVEYLWNVPFNIKSIDNIEKGILRRALKPALPDDVRNRRKSAYPTSQDPHYLQTIRNLTLDMCSNKNNPIFSLINHSTLLAIANQSNKEINNFEARSAIEYMLQVNEWLKTYHIHIA

SEQ ID NO: 27817 - protein, 427 aa, Nocardioides sp. JS614
MPRVLRMPEVAANATEAVLAEWLVSENAEFGALDTIATVETEKALVDVEAEDAGVVLKTLVPPGALVEVGAPIAVLGAPGEAVGDLGAVLAELGVAEPVDHVLPERRSLVEPVDPVVEPVEAPAPTQGSNHRVFASPLARRLARLAEIPVEEIAGTGPRGRILRRDVEAAVAARPATPVVEQRAPASVVETPAPTQGSASKVEPVDVPHSRLRRAVANRLAESKQTAPHFYLRATVRADRLVDLRAELNEGAETRVSLNDLVVKAVAAAHARVPEMNVVWTPDAVRSFSSVDVAVAVATDRGLVTPVLRDVTSLTVTAVAAKVQDLAARAREGRLKQDELEGGTISVTNLGMYGVEEFAAIINPPHAAILAVGAVREEPVVEDGAVVPGKVLTVTLSVDHRPVDGVVAARWLAAFVDLVEHPARILA

SEQ ID NO: 27818 - protein, 680 aa, Saccharomyces cerevisiae
MTQFTDIDKLAVSTIRILAVDTVSKANSGHPGAPLGMAPAAHVLWSQMRMNPTNPDWINRDRFVLSNGHAVALLYSMLHLTGYDLSIEDLKQFRQLGSRTPGHPEFELPGVEVTTGPLGQGISNAVGMAMAQANLAATYNKPGFTLSDNYTYVFLGDGCLQEGISSEASSLAGHLKLGNLIAIYDDNKITIDGATSISFDEDVAKRYEAYGWEVLYVENGNEDLAGIAKAIAQAKLSKDKPTLIKMTTTIGYGSLHAGSHSVAGAPLKADDVKQLKSKFGFNPDKSFVVPQEVYDHYQKTILKPGVEANNKWNKLFSEYQKKFPELGAELARRLSGQLPANWESKLPTYTAKDSAVATRKLSETVLEDVYNQLPELIGGSADLTPSNLTRWKEALDFQPPSSGSGNYSGRYIRYGIREHAMGAIMNGISAFGANYKPYGGTFLNFVSYAAGAVRLSALSGHPVIWVATHDSIGVGEDGPTHQPIETLAHFRSLPNIQVWRPADGNEVSAAYKNSLESKHTPSIIALSRQNLPQLEGSSIESASKGGYVLQDVANPDIILVATGSEVSLSVEAAKTLAAKNIKARVVSLPDFFTFDKQPLEYRLSVLPDNVPIMSVEVLATTCWGKYAHQSFGIDRFGASGKAPEVFKFFGFTPEGVAERAQKTIAFYKGDKLISPLKKAF

SEQ ID NO: 27819 - protein, 136 aa, Schizosaccharomyces pombe
MARTKQTARKSTGGKAPRKQLASKAARKAAPATGGVKKPHRYRPPTVALREIRRYQKSTELLIRKLPFQRLVREIAQDFKTDLRFQSSAIGALQEAVEAYLVSLFEDTNLCAIHGKRVTIQPKDMQLARRLRGERS

SEQ ID NO: 27820 - protein, 726 aa, Nocardioides sp. JS614
MPEHHPLAPASPWVEVVATEADWDAADPQLLRTIYAQLVWIRTFEQYVLDLAASGLIHGPAHSSIGQEGGAVGSVLALTSADSVNGSHRGHHQFLAKALHHVEPKGMDPLEAPSEQVRDVLLRTLAEICGLDRGWSHGRGGSMHLQWKEAGAMGTNAIVGGGVPQAAGFAWSHRQAGTDAVSVTYFGDGAVNIGSTLETMNLAGAWSLPVCFFIENNRYAVSTSVDEATAEPRLSARGLGFNLASWKVDGMDPLAVHLAMSEAVEHMRRGRGATVVEVDTYRFFHQNGGFAGSAFGYRDKEEERAWRARDPLTQTAAHLERRGIMTAEETAEAITRAKAVMEEIGRELVEPLPDGKPGQRRIRPAEWPDPDWVDVGVRGDLSELDGARIVAADGFAVPVQETKFIDAVAAVMGRRMETDQGIVVMGEDVHRLNGGTNGATRGLTELFPGRILGTPISENAFTGLAGGIALDGRYTPVVEFMYADFMWVAADQLFNQIGKARHMYGGASGVPLVLRSKVAMGTGYGSQHSMDPAGIFATNPGWRIVAPSTPYDYVGLMNTALRCADPVVVLEHVDLYGSTGPGPVDDYDYCLPVGKAAIRRPGKDVTILTYLGMVPFVLGAVEEFGQVDAEVIDLRWLDRASIDWDTIEESLTKTNQVLIAEQGAVGTSYGGWLADEIHRRFFDLLDAPVRRVTGAEASPSISKVLERAAIAQQDEVIAELAEIARY

SEQ ID NO: 27821 - protein, 577 aa, Alkaliphilus metalliredigenes QYMF
MNRGMTMFKGTGASPGIAIGRALVYQEQELNIKKESVEGLEKELDKFQSSIKKSKVQLEYVKQEAMKKLGADKASIFEAHIMVLDDPELINQVKDKITNEKVSAEYAVNEVINSFITLFEGMDNEYMKERAADIRDVGNRILKNLLNVEIINLATLTDEVILVANDLTPSDTATMNKEKVLGFITNIGGRTSHTAIMAKSLEVPAIVGLKSITDEVKSGDLLIFDGGEGFGHINPDEQLLADFREKKQQYEFIRKELEKLKSEPSVSKDGRRVELGANIGTPKDVKGVLDNGGEGIGLYRTEFLYMNRDHMPSEEEQYEAYKEVLQKMEEKPVIIRTLDIGGDKELPYLNLPKELNPFLGYRAIRICLDQPEIFKVQLRALLRASVYGNLKIMYPMISSVEEVRAANEILQEVRGELDQKGIEYSKEIEVGIMVEIPATVVIGDMLIKEVDFFSIGTNDLIQYTTAVDRMNEKISHLYEPFHPAILRMIKMVIDHAHGGGKWAGMCGEMAGDPKIVPILLGLGLDEFSMSPISILQARKIIRGLSYSEMKKIAEKALNFPTAAEVKKFVAEEIDKIS

SEQ ID NO: 27822 - protein, 232 aa, Brassica napus
  misc_feature (158)..(158): Xaa can be any naturally occurring amino acid
  unsure (1)..(232): unsure at all Xaa locations
MAGATSSLILSPWQATLDHYNNKTKRFFVKGYPFPCHHSEPICNSFIIKRRVLPSSSSSSIFKDNHVVTHSSSSSDKLQTHFSMSGCGCSWIQDNSMLHYPATSNWTSKKCSALPTTKTVDVSSVSDLFEFICSGPLVDKIGITPEKVGQAIDKMVAXYGSQLCRLFQLNELKLTIPQKARLYHYYIPVFVWCQDQIALHSSKFNDGDDVPPLVIGFSAPQGCGKTTLVFAL

SEQ ID NO: 27823 - protein, 358 aa, Oryza sativa (indica cultivar-group)
MSAYCGKYKDELIKNAAYIGTPGKGILAADESTGTIGKRFASINVENVEDNRRALRELLFCTPGALQYISGVILFDETLYQKTKDGKPFVDVLKEAGALPGIKVDKGTIEVAGTDKETTTQGHDDLGKQCAKYYEAGARFAKWRAVLKIGPNQPSQLAIDLNAQGLARYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 27824 - protein, 396 aa, Rhodococcus sp. NCIMB 9784
MTMAQPSNDIVIVGGGLAAVRTAQGLRTLGYDGPIRLYSNESEPPYDRPPLSKDFLTGELDTDGLHLLHDKALARLDLDIHLDSEVVALDPAGRRLALADGTTVPYGRLVVATGAQARRLPGLSPSARIHYLRTVDDARALRTALADASRITVVGTGFIGLEVASSARHLGLEVDVVAADEGPMIGIVGRRLSQWLTELHTAHGVRLTNSVVVSSVDESATGVTLTLDDGTSRSSDIVAVGVGVGRELQWLREAGLEVDRGLVCDVDGRTSDPFVFGVGDIVCMHIGPEHEDLQHWTAAADSARRTAHALMEAEHSHDPGDGFFWTEQHGHRLQFVGAGGTDAEVDVLSGSIDEGKFVAHLRCGSTVTGVFASNSPREFLEARLAFQKQAAAGAVG

SEQ ID NO: 27825 - protein, 400 aa, Staphylococcus aureus subsp. aureus MRSA252
MRIVQPVIEQLKAQSHPVCHYIYDLVGLEHHLQHITSSLPSNCQMYYAMKANSERTILDTISQYVEGFEVASQGEIAKGLVFKPANHIIFGGPGKTDEELRYAVSEGVQRIHVESMHELQRLNAILEDEDKTQHILLRVNLAGPFPNATLHMAGRPTQFGISEDEVDDVIEAALAMPNIHLDGFHFHSISNNLDSNLHVDVVKLYFKKAKAWSEKHQFPLKHINLGGGIGVNYADLTSQFEWDNFVENFKTLIVEQEMEDVTLNFECGRFIVAHIGYYVTEVLDIKKVHGAWYAILRGGTQQFRLPVSWQHNHPFDIYRYKDNPYSFEKVSISRQDTTLVGQLCTPKDVFAREIQIEAISTGDVIVFKYAGAYGWSISHHDFLSHPHPEFIYLTQTKEDE

SEQ ID NO: 27826 - protein, 371 aa, Malus x domestica
MGKGGMSDGDHADRCCGEAINGDVQQENMAAWLLGVKNLKIQPYKLPNLGPHDVRVRLKAVGICGSDVHHFKNMRCVDFIVKEPMVIGHECAGIIEEVGSEVEDLVPGDRVALEPGISCKRCNLCKQGRYNLCRKMKFFGSPPNNGCLANQVVHPGDLCFKLPDNVSLEEGAMCEPLSVGIHACRRANVCQETNVLVVGAGPIGLVTLLAARAFGAPRIVIADVNDERLLIAKSLGADAVVKVSTNIEDVAEEVAKIQKVLENGVDVTFDCAGFNKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 27827 - protein, 1312 aa, Klebsiella aerogenes
MGTTTMGVKLDDATRERIKSAASRIDRTPHWLIKQAIFNYLEKLENDETLPELPALLSGAANESDDASEPTEEPYQPFLEFAEQILPQSVRRAAITAAWRRPETDAVPMLLEQARLPQPLGEQAHKLAYQLAEKLRNQKTASGRAGMVQSLLQEFSLSSQEGVALMCLAEALLRIPDKATRDALIRDKISNGNWQSHIGRSPSLFVNAATWGLLFTGKLVSTHNETSLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPFVIDYLIDLATRSRRRLMIRLVKGAYWDSEIKRAQMEGLEGYPVYTRKVYTDVSYLACAKKLLAVPNLIYPQFATHNAHTLAAIYQLAGQNYYPGQYEFQCLHGMGEPLYEQVVGKVADGKLNRPCRIYAPVGTHETLLAYLVRRLLENGANTSFVNRIADNTLPLDELVADPVSAVEKLAQQEGQAGLPHPKIPLPRDLYGSGRSNSAGLDLANEHRLASLSSSLLNSALHKWQALPMLEQPVAEGEMQPVVNPAEPKDIVGYVREASDAEVQQALTSAINNAPIWFATPPQERAAILERAAVLMESQMPTLMGILVREAGKTFSNAIAEVREAVDFLHYYAGQVRDDFDNETHRPLGPVVCISPWNFPLAIFTGQIAAALAAGNSVLAKPAEQTPLIAAQGVAILLEAGVPPGVIQLLPGRGETVGAALTSDERVRGVMFTGSTEVATLLQRNIASRLDPQGRPTPLIAETGGMNAMIVDSSALTEQVVIDVLASAFDSAGQRCSALRVLCLQEEVADHTLTMLRGAMSECRMGNPGRLTTDIGPVIDAEAKENIERHIQAMRAKGRTVYQAVRENSEDAREWRHGTFVPPTLIELDSFDELKKEVFGPVLHVVRYNRNELDKLVEQINASGYGLTLGVHTRIDETIAQVTGSAKVGNLYVNRNMVGAVVGVQPFGGEGLSGTGPKAGGPLYLYRLLSSRPQDAVGVTFARQDAERPLDAQLKTLLEKPLQALQQWAAGRPELQALCQQYSEQAQSGTQRLLPGPTGERNTLTLMPRERVLCVADNEQDALIQLAAVLAVGCEVLWPDSALQRDLAKKLPREVSERIRFAKAEQLPVQAFDAVIYHGDSDQLRELCEQVAARDGAIVSVQGFARGETNLLLERLYIERSLSVNTAAAGA

SEQ ID NO: 27828 - protein, 368 aa, Malus x domestica
MGKGGQSCNGMVRQAKPVEQENMAAWLVDVNTIKILPFKLPSIGPNDVRIRIKAVGICGSDVHYLKTMKCADFEVKEPMVIGHECAGIVDKVGSEVKHLVPGDRVAVEPGISCARCQQCKGGRYNLCPDMKFFATPPVHGSLANQIVHPADLCFKLPENVSLEEGAMCEPLSVGVHACRRANVGPETTVLIIGAGPIGLVSVLAARAFGAPRIVIVDMDDKRLAMAKSLGADEAVKVSTKMEDLDDEVAEIKEAMISEVDVTFDCVGFNKTMSTGLNATRPGGKVCLVGMGHGVMTVPLTPAAAREVDVVGVFRYQNTWPLCLEFLRSGKIDVKPLITHRFGFTEKEVEEAFATSARGGNAIKVMFKL

SEQ ID NO: 27829 - protein, 471 aa, Ralstonia eutropha JMP134
MAQSVADVMKLVKENDVKFVDFRFTDTKGKEQHVSVPTSHFDDDKFESGHAFDGSSIAGWKGIEASDMLLMPDSNTAFIDPFYEEPTLVLTCDVVEPSDGKGYDRDPRSIAKRAEAYLKSTGLGDTAFFGPEPEFFIFDGVTWNVDMQGCFVKVHSEEAPWSSGKEFEHGNSGHRPGKKGGYFPVAPIDTFQDMRSEMCLILESLGIPVEVHHHEVAGQGQNEIGTRFSTLVQRADWTQLQKYVIQNVAHTYGKTATFMPKPIVGDNGSGMHVHQSVWKDGQNLFAGNGYAGLSEFALYYIGGIIKHARALNAITNPGTNSYKRLVPGFEAPVKLAYSARNRSASIRIPYVANPKGRRIETRFPDPLMNPYLGFSALLMAGLDGVMNKIHPGEAADKNLYDLPPEEDAKIPTVCNSLDQSLEYLDNDREFLTRGGVFSNSMLDAYIELKMEEVTRFRMTTHPVEFEMYYSL

SEQ ID NO: 27830 - protein, 403 aa, Mycobacterium tokaiense
MTTPRHVAVVGGSLAGLRSAEQLRALGHTGPITVFSAERHLPYNRPPLSKEALGEFESATAEELAGRLAFRRRASIADVDIRLATPVATADLGAHRLTLDSGDEQAYDALVIATGLRPRRLVAPGPARGRHVLRTVEDCVGLRAALRPRSRAVVIGGGFIGCEVAGTLRTLGHHVTVVEPAGPPMQRVLGSDLAAAVQGHLTARGIEFVIGTGVDSFTGDDAVTGVELATGETLSADIVVEAIGSTCNVEWLYGQGLDLSDGVLTDNRLAVAGVADTVAVGDLARFPNPLFDDVPRRVEHWSIPGDTANRAAATLVGPHDNDAPFAPVPAFWSNQLDLRLQSYGSPALADAVHLEEGSVDDLTGGVILTYHRDHRHVGTVAANLSPARLRELRSAFTAVQLPA

SEQ ID NO: 27831 - protein, 355 aa, Zea mays
  misc_feature (302)..(302): Xaa can be any naturally occurring amino acid
  unsure (1)..(355): unsure at all Xaa locations
FFISSSILDLTIVGIDYTEGDSTLQGQQPHYLKTSCKPSLDHGSPVYLLGHTGKKELVIGEGKVVIGTDNLIKLSAEGHWQGSLDEVSKPKLPLVRLMSSRSDHSSTSFTRRHVFKPDDENDDASVCSKPKHQQVSGSTATARISHEANPIVDLRTSCEQGVTTPEIYESPRRSSCQAQKNAAAPIQLLDINFPPRVPKTIFLPLPLKQMLSDENNVETSKPKYRSKDNGFPSGLIWHRNIEAECRDPPVALQHMDCSSEGQSSSSPAEIPEYGCQDQYDSEEETMYSAETMESRNIPSPRXEKHVGRSQSCVTYSRWSSPRTSSMQNGTLRKQHTLIPVRKTHSQNTTLPQRSH

SEQ ID NO: 27832 - protein, 1002 aa, Oryza sativa (japonica cultivar-group)
MGSGSLLLSLLLVLVVVNVGVAVNQDGLSLLDARRALAAPDGALADWNARDATPCSWTGVSCDAGVGGGAVTGISLAGLNLTGSFPAALCRLPRVASIDLSYNYIGPNLSSDAVAPCKALRRLDLSMNALVGPLPDALAALPELVYLKLDSNNFSGPIPESFGRFKKLESLSLVYNLLGGEVPPFLGGVSTLRELNLSYNPFVAGPVPAELGNLSALRVLWLAGCNLIGAIPASLGRLGNLTDLDLSTNALTGSIPPEITRLTSVVQIELYNNSLTGPIPVGFGKLAELQGVDLAMNRLNGAIPDDFFEAPKLESVHLYANSLTGPVPESVAKAASLVELRLFANRLNGTLPADLGKNSPLVCVDMSDNSISGEIPPAICDRGELEELLMLDNKLSGRIPDGLGRCRRLRRVRLSNNRLDGDVPAAVWGLPHMSLLELNDNQLTGVISPVIGGAANLSKLVLSNNRLTGSIPPEIGSASKLYELSADGNMLSGPLPGSLGGLEELGRLVLRNNSLSGQLLRGINSWKKLSELNLADNGFTGAIPAELGDLPVLNYLDLSGNRLTGEVPMQLENLKLNQFNVSNNQLSGALPPQYATAAYRSSFLGNPGLCGDNAGLCANSQGGPRSRAGFAWMMRSIFIFAAVVLVAGVAWFYWRYRSFNNSKLSADRSKWSLTSFHKLSFSEYEILDCLDEDNVIGSGASGKVYKAVLSNGEVVAVKKLWGLKKGTDVENGGEGSTADNSFEAEVKTLGKIRHKNIVKLWCSCTHNDTKLLVYEYMPNGSLGDVLHSSKAGLLDWSTRYKIALDAAEGLSYLHHDYVPAIVHRDVKSNNILLDAEFGARVADFGVAKVVEATVRGPKSMSVIAGSCGYIAPEYAYTLRVNEKSDIYSFGVVLLELVTGKPPVDPEFGEKDLVKWVCSTIDQKGVEHVLDSKLDMTFKDEINRVLNIALLCSSSLPINRPAMRRVVKMLQEVRAEATRPRLEKDGKLSPYYYEDTSDQGSSV

SEQ ID NO: 27833 - protein, 564 aa, Cryptococcus neoformans var. neoformans JEC21
MSGGYDFSHLFPANTLAFSPGTTFLAVAHQNRIIVRSTSTLQVVRTWECTLPSESTIFRSKEPCVASSATEATSEAFIIDTLQWSGDSTYLLVHSKEAKMAWVYGVAQEGEAAHVGGMGVEGLSKVEWGKGNREVLAWTEIDSRLYIYSLSSGETRLIQNVKPTADGYTYSPDSRYLAVTEKHLGKDYIGVYDILDGYNLLRHFPLLTVDVQGVSWSPCGKYIAAWDLPLSYSLHIHSAIGPHLTHLNPSSPAFSLAPNETPGLGLRTLAWAPGGRWIAVGGWDGKVRIVESDGWRCVCVITCGTRANKTAAVWREPNDWLRDTRGRGIVQFDRQPHPVTFPALRPDITKPYPRMGISQLTFDREATLLLIRLDSQPNVVHIYSFLPTPTSEQPTIAHIVSSIFSREIKKAKWSPVKSKLSVVTRGGGVYFWDRESGWIEEESGGSFECDREIDVATGGMMEGVGIPTRAEFSALDIHWSPDGRSLAIRDRYHFCLLYDEDTGNLDDDEQEGERSALMWNEQGEGLTDVLEEEGHISLSEGLPSREQFIWEKKRYATVKAAVYS

SEQ ID NO: 27834 - protein, 367 aa, Acetobacterium carbinolicum
FTGDFHAIGAANNLLAAMLDNHIKQGNELKIDAKKITWRRCVDMNDRQLRNIVDGLGGSGDGVVREDGFDITVASEVMAAFCLASDISDLKERLGRIIVGYSFAGDPITASQLKANGAMAALLKDALKPNLVQTLEGTPAFIHGGPFANIAHGCNSVIATRMAMHFADYVVTEGGFGADLGAEKFLDIKCRMANLKPDAVIIVATVRALKHNGGVPKADLNNENLEALKAGLPNLLKHVENITQVFKLPAVVAINEFPLDTPAELALVKDECQKLGVNVAISQVWAKGGEGGEELAREVVRLIDESEGTFEYCYELDMPIKEKIEAIATRIYGADGVDFTPIATKEMERLTALGFDKVPICMAKTQY

SEQ ID NO: 27835 - protein, 391 aa, Bdellovibrio bacteriovorus HD100
MEYINNELCLGPLKKPLLPLVANYMRPIYVYDLDSVAQRYQAMSQALKGTRLFFAVKSNPNPGVLQKLKSLGAGADVVSLGEIKRALECGFSPQDIVYSGVGKTKFELAEALKLGIYQINVESLPELERIGVLARELNKKAQVALRLNPDVDINTHPYIATGLKDNKFGMERSMVPALVKCLKSYSDSIDLVGVSLHLGSQMLEFSGYDEALKRLKTVYLELQAQFPTLKKFDFGGGLGIFYDRVDLQLEESLLQKYAQITLENLSDLNCELQAEPGRWLVAHCGALITQVQYIKETSAKTFVIVDAGMNHLIRPSLYEATHRIEPLKRKDAAFVVDVVGPICESSDFFAKEISLTKVQEGDFVAIMDSGAYGYSMASVYNLQELPLEICI

SEQ ID NO: 27836 - protein, 547 aa, marine gamma proteobacterium HTCC2080
MTSATRNILVTSALPYANAPLHLGHILEQVQTDIWVRFQRSRGNHCLYVCADDAHGTAIMLAAEKSETSPEEHIEAVRLNHLADSTGFLINFDNYGSTHSPENQKWSNEIFSRLEAQGHIGSREITQAFDPDKGLFLADRFIKGTCPRCKAPDQYGDNCEACGATYSPTDLIDPVSALSGAVPIEKASEHLFFQLSHFQELLEDWTASGSLQPAIRNKLSEWIDAGLQDWDISRDAPYFGFEIPGHPGKYFYVWLDAPIGYIASCLDYCQRENEDFDKWWQLGHDTELYHFIGKDIINFHGLFWPAMLQAAGLRLPTAIYAHGFLTVDGTKMSKSRGTFIHASAYLKHLDPEYLRYYFAAKLGAGVDDFDLNLDDFVKRVNSDLVGKVVNIASRCAGFLRKKFANTLSDHCEEPALVQGFIAAGDDIAALYEAREFSRAMREIIALADQANQYIDEKKPWVLAKEPGKESEVQAVCSVGINLFRVLITYLKPVLPVMAERSEAFLKISLDWHLLESPLLGHELDDFKQLLQRVDPDNVSAMVEDGKS

SEQ ID NO: 27837 - protein, 172 aa, Zea mays
MDSTFIMIKTDGVQRCLIDEIISRFEKKGFYLKDLKLVNVERSLDDKHYNNLVSKSFFQGLECYIISEPEVCMVWEDKSVVTTVRKIIGATNPLTSETGTIRGDFAGDIGRNVIHGSDSIDSANKEIALCVPEGPGDCQSIQHPCIYYNQTCIASHHILTDRGSMSPLVLSQ

SEQ ID NO: 27838 - protein, 82 aa, Populus x canadensis
TLLKPNMVTPGSDAPKVANEVIAQFTVRALQRTVPAAVPAIVFLSGGQSEEEATRNLNAINKLKTKKPWSLSFSFGRALQQS

SEQ ID NO: 27839 - protein, 536 aa, Gossypium arboreum
MLQIAFSSYSWLLTASNQKDGMLFPVALSFLVAILGISLWHVWTIRKPKKDIAPLPPGPRGLPIVGYLPYLGTDNLHLVFTDLAAAYGPIYKLWLGNKLCVVISSAPLAKEVVRDNDITFSERDPPVCAKIITFGLNDIVFDSYSSPDWRMKRKVLVREMLSHSSIKACYGLRREQVLKGVQNVAQSAGKPIDFGETAFLTSINAMMSMLWGGKQGGERKGADVWGQFRDLITELMVILGKPNVSDIFPVLARFDIQGLEKEMTKIVNSFDKLFNSMIEERENFSNKLSKEDGNTETKDFLQLLLDLKQKNDSGISITMNQVKALLMDIVVGGTDTTSTMMEWTMAELIANPEAMKKVKQEIDDVVGSDGAVDETHLPKLRYLDAAVKETFRLHPPMPLLVPRCPGDSSNVGGYSVPKGTRVFLNIWCIQRDPQLWENPLEFKPERFLTDHEKLDYLGNDSRYMPFGSGRRMCAGVSLGEKMLYSSLAAMIHAYDWNLADGEENDLIGLFGIIMKKKKPLILVPTPRPSNLQHYMK

SEQ ID NO: 27840 - protein, 333 aa, Pseudomonas putida GB-1
MTQTNRRFLLAKRPVGAVRRDDFSFETVPVEQPGEGQVLVRNLYLSLDPAMRGWMNEGKSYIPPVALGQVMRALGVGEVVASNHSAFEPGDHVSGALGVQDYFTGEPQGLHKIDPNLAPLPRYLSALGMTGMTAYFALLDVGQPKAGDTVVISGAAGAVGSIVGQIAKVKGCRVVGIAGGAEKCRYLLDELGFDGVIDYKAEDVLAGLKRECPKGVDVYFDNVGGEILDAVLTRINFKARIVICGAISQYNNKEAVKGPANYLALLVNRARMEGFVVMDYSKDYGKAALEIAGWLASGQVKSKEDVVEGLETFPETLLKLFSGENFGKLVLKV

SEQ ID NO: 27841 - protein, 1483 aa, Penicillium digitatum
MEARRHDPTASVNTEDTANEKSEVGDEKYTDAEVTRLAQQLTRQSTRFSVSPQNAENPFIETHEDSTLNPHSGNFKAKNWMKNLLAIQSRDPERYPKRQAGLAFKNLSVHGFGSPTDYQKDVANSVLEIGAFFRTMAGTGKQKIQILRDFDGLVKNGEMLIVLGRPGSGCSTFLKTIAGEMNGIFKDANSHMNYQGISDKEMRNQFRGEAIYTAETDVHFPQLSVGNTLKFAALARAPRNRLPGVSRDQYAEHMRDVVMAMLGLSHTINTRVGNDFIRGVSGGERKRVSIAEATLCGSPLQCWDNSTRGLDSANALEFCKTLNLMSKYSGTTCAVAIYQASQSAYDVFDKVTVLYEGRQIYFGRTTEAREFFTNMGFHCPDRQTTADFLTSLTSPAERVVKPGFEKMVPRTPDEFAKGWKNSAAYKELQKEIDDYNTQYPIGGESFQQFVESRKAMQSKGQRAKSPYTLSVAEQVQICVTRGFQRLKSDYSLTISALIGNTIMALIVGSVFYQLPDDVTSFYSRGALLFFAVLLNSFSSALEILTLYAQRPIVEKQARYAMYHPFAEAISSMLCDMPYKILNAITFNVTLYFMTGLRQNAGAFFTFMLFSFVTTLTMSMIFRTIASYSRTLSQALVPAAILILGLVIYTGFTIPTRNMLGWSRWMNYIDPIAYGFETLIVNEFHGRNFPCNPESFIPAGDSYADVGRFNKICSAKGAVAGQNFVSGEAYYTASFQYSNSHRWRNMGIMIGFMVFFMVTYLVGTEYISEAKSKGEVLLFRRGYAPKNSGNSDGDVEQTHGVSSAEKKDGAGSGGEQESAAIQRQTSIFQWQDVCYDVHIKNEERRILDHVDGWVKPGTCTALMGVSGAGKTTLLDVLATRVTMGVVSGEMLVDGRPRDQSFQRKTGYVQQQDLHLHTTTVREALRFSAILRQPRHVSHQEKLDYVEEVIKLLGMEHYADAVVGVPGEGLNVEQRKRLTIGVELAAKPQLLLFLDEPTSGLDSQTSWSILDLIDTLTKHGQAILCTIHQPSAMLFQRFDRLLFLAKGGRTVYFGEIGEHSSTLSNYFERNGAPKLSPEANPAEWMLEVIGAAPGTHSDIDWPAVWRESPERKAVQNHLAELRNNLSLKPVATTDNDPAGFNEFAAPFAVQLWQCLIRVFSQYWRTPIYIYSKTALCSLTALYVGFSFFHAQNSMQGLQNQMFSIFMLMTIFGNLVQQIMPHFVTQRSLYEVRERPSKTYSWQAFMSANILVELPWNALMSVLIFLCWYYPVGLQRNASADDLHERGALMWLLILTFMLFTSTFSHMMIAGIELAETGGNLANLLFSLCLIFCGVLATPDKMPHFWIFMYRVSPFTYLVSAMLSTGTSGAKVECESVELLHFEPTAGKTCFEYMNTYMNGLVVNGTQVAAPAGGYLVDNNATSNCAFCTIADTDTYLASVLSYYKDAWRNFGIMWAFIIFNIFGAVCIYWLARVPKGTRSKKTKTA

SEQ ID NO: 27842 - protein, 402 aa, Glycine max
MAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAASTGSNFWIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGQSGKPYSARYIGSLVGDFHRTLLYGGIYGYPRDKKSKNGKLRLLYECAPINFIVEQAGGKGTDGLQVLRLQGTEIHQRVPLYIGEEVEKVEKYLA

SEQ ID NO: 27843 - protein, 101 aa, Populus x canadensis
TVVSIPNGPSALAVKEAAWGLARYAAISQDNGLVPIVEPEILLDGEHGIDRTFEVAQKVWAEVFFYMAENNVMFEGILLKPSMVTPSAECKDRATPEQVAE

SEQ ID NO: 27844 - protein, 204 aa, Glycine max
  misc_feature (48)..(48): Xaa can be any naturally occurring amino acid
  misc_feature (61)..(61): Xaa can be any naturally occurring amino acid
  misc_feature (136)..(136): Xaa can be any naturally occurring amino acid
  unsure (1)..(204): unsure at all Xaa locations
MKKPRSPPQARTWLSEIRKYRYQLLCEIAQNFKINIIDRYLWSTIVLXKELQLLGISSLLXYEEILSPKVKDFITISNDAYSRNHILSMEKAILERLEWNFTVPTPYVFLVRFIRTFGLPPDQQKEKMTFFLAELXLVHYETANLSPPSMTAAAAVYAARCTLNRKHPWNEILKDMAGYTTAQLREFCTLDRGRKALLSPTKDI

SEQ ID NO: 27845 - protein, 228 aa, Ralstonia eutropha JMP134
MTQDELKALVAQAAADYVKQEVPEGAVLGVGTGSTANLFIDAVAAFKDRFAGAVSSSEASTRRLQQHGFKVLDLNEVDDIPVYVDGADEIDASGAMIKGGGGALTREKIVASVAGRFVCIADGSKLVETMGAFPLPVEVIPMARAAVARQVAALGGQPRLRMNKDGGIYKTDNGNVILDVSGLKITDPRGLEQSINQIPGVVTVGLFALRGANVLLLGTGEGVQRTDY

SEQ ID NO: 27846 - protein, 341 aa, Ralstonia eutropha JMP134
MPQRRRESAAFPPPHDDCNDLPIMNQLEQLKQFTTVVADTGDFQLMKQYTPQDATTNPSLILKAVQKPEYRGLLEQAVRDYHNEGGVDAVMDGVLIAFGCEILAIVPGRVSTEVDARLSFDTEATVEKARHLIRLYEQRGVARERVLIKIASTWEGIRAAEILQREGIRCNMTLLFSLVQAVACAEAGAQLISPFVGRILDWYKKQAGDQWDAAANAGDNDPGVRSVRQIYDYYKKFGYNTEVMGASFRSTAQIVALAGSDLLTISPDLLEQLARTEGTVERKLSVDLAQAGNIARIPADEPAFRWQLNEDAMATEKLAEGIRLFAADAIKLEKLVAEIAG

SEQ ID NO: 27847 - protein, 260 aa, Ralstonia eutropha JMP134
MNDDALIPLSSPWPGLEEARELIAQARSVFVLTGAGISAESGVPTFRDALTGLWARFDPEELASEEAYRRQPALVWEWYQHRRDLVAAARPNPAHYALVALAAQKTVTLVTQNVDGLHQRAGSDHVIELHGNLFANKWLNGCGRCDEATAIPGDPPRCSLCGALMRPGVVWFGEDLPRVARFRAEHAAETADLCLVVGTSGLVYPAAGLPGLARDHGARVVVVNPQPSVLDQTADVVLQAAAGASLPLLWPQSGSDTEMD

SEQ ID NO: 27848 - protein, 556 aa, Ricinus communis
GEFTWKLADHPKLPKGKTIAMVVLDGWGEAKPDQYNCIHVAETPTMDSFKKTAPERWRLIKAHGTAVGLPTEDDMGNSEVGHNALGAGRIYAQGAKLVDLALASGKIYEGEGFKYVKECFDKGTLHLIGLLSDGGVHSRLDQLQLLLKGAAEHGAKRIRVHVLTDGRDVIDGTSVGFAETLEKDLENLREKGVDAQVASGGGRMYVTMDRYENDWNVVKRGWDAQVLGEAPYKFKSAVEAIKKLREEPKANDQYLPPFVIVDENGKPVGPIVDGDAVVTINFRADRMVMLAKALEYENFDTFDRVRFPKIHYAGMLQYDGELKLPSHYLVSPPEIERTSGEYLVHNGVHTFACSETVKFGHVTFFWNGNRSGYFNPEMEEYVEIPSDVGITFNVQPKMKAIEIAEKARDAILSGKFQQVRVNIPNGDMVGHTGDVEATVVGCKAADEAVKMIIDAIEQVGGIYVVTADHGNAEDMVKRDKSGKPMADKSGKIQILTSHTLQPVPIAIGGPGLTPGVRFRSDIPTGGLANVAATVMNLHGFEAPSDYEPTLIEAVDN

SEQ ID NO: 27849 - protein, 293 aa, Listeria monocytogenes str. 4b F2365
MNKENPLNKYHTGKFEKQRQDYPGLQSKMTPVPDTGESSYQGANKLTGKKAFVTGGDSGIGRAAVIAYAREGADVAINYHPDEEVDAQEVKAIVEEAGQKCVLLPGDLRKEGLAKDLVKKAYNELGGLDILVLNAGLQQYQLDIQKLPAEQLRDTFEVNVFSVVFAIQEALNYLKAGASIILTSSIQGVKPSAHLVDYAMTKSSLISLTKSLAAQLGGKGIRINAVAPGPIWTALQISGGQPQDSIPAFGQDQPLGRAGQPAELASAYVLLASDEASYTTGQVYGITGGAPIN

SEQ ID NO: 27850 - protein, 270 aa, Nicotiana alata
MAKKDGNQEEEISQMEEGNIHSASNSDSNVGFCSSVSVVVILQKLIAEAIGTYFVIFAGCGSVAVNKIYGSVTFPGICVTWGLIVMVMVYTVGYISGAHFNPAVTITFSIFGRFPWKQVPLYIIAQLMGSILASGTLALLFDVTPQAYFGTVPVGSNGQSLAIEIIISFLLMFVISGVATDDRAIGQVAGIAVGMTITLNVFVAGPISGASMNPARSIGPAIVKHVYTGLWVYVVGPIIGTLAGAFVYNLIRSTDKPLRELAKSASSLRS

SEQ ID NO: 27851 - protein, 432 aa, Legionella pneumophila str. Paris
MEECMYLDALSRLDKAASFCRIDSEALEKLKHPKSCLEVSLPVRMDNGELKIFPAYRVHHNDSRGPMKGGIRYHPKLDLDEIKTLALWMTIKCAVADIPFGGAKGGVIVDPKQLSRMELERLSRSYIELIADFIGPDKDIPAPDMYTNEMIMGWMMDEYATIVRKNSPAVITGKPISLGGCLGREGATGLGAYYCIKILEKKKKWQSSELRVAVQGFGNAGQSIAKLLYDNGYKIVAISDSKGGIYNTKGIDIPRMIEIKNSSKDVQSIYCKESVCKLAKEATITNEELLELDVDLLIPAAAQNQITQENAARIKAPIIIEIANGPITLEADALLQKKGLLIVPDILANTGGVIVSYFEWVQNKSGYYWSLEKVQEELQTIISREFGNIWQLMEQYQTDMRQAAYVHALNRYDKAVTAQGTRGYFSNLSLSL

SEQ ID NO: 27852 - protein, 527 aa, Prochlorococcus marinus str. MIT 9301
MNGDLNSWDKFCNYLWFDKKLNIWLDISKINFTSKEINNLEDKFVDVFSSMKELENGAISNIDENRQVGHYWLRNPSISPSSKIAEEIRADINAISEFGKQILNGDIKNKNNKQYTDVLWIGIGGSGLGPLLITESLQKCSRGLNFSYIDNVDPFLISEKLEELSEKLSTTLFVVVSKSGGTPEPRIAMEIIKSHCEKNSLEWNSNAIAITMKDSKLFKKATSEYWLKIFNLQDWVGGRTSITSSVGLLPLALINENISEFIKGASLMDEATRISDFKNNPAALLSSAWYLTGDGTGKRDMVVLPYRDRLQVFSKYLQQLVMESLGKKFNRNGEVVNQGISVFGNKGSTDQHAYVQQLRDGIDNFFCIFIELLDTPSTNIFDDKENPKEYLSGFLQGTRSALSSENRQSITITLEKLNCFSLGALIALFERAVSFYAELVNINAYDQPGVEAGKKAAANIIEYQQKVSNLLDAGGEYSINDITSLFDNSVSESIFFILREMCFGNDNYLVKGDWSNPNSLVIQKLNS

SEQ ID NO: 27853 - protein, 135 aa, Volvox carteri
MARTKQTARKSTGGKAPRKQLATKAARKTPATGGVKKPHRYRPGTVALREIRKYQKSTELLIRKLPFQRLVREIAQDFKTDLRFQSQAVLALQEAAEAYLVGLFEDTNLCAIHAKRVTIMPKDIQLARRIRGERA

SEQ ID NO: 27854 - protein, 438 aa, Geobacter metallireducens GS-15
MGLKETLKQKIEEFRPRTTRLVKEFGKVKIDEVTIEQCIGGARDIRSLVTDISYLDPQEGIRFRGKTIPETFAALPKAPGSDYPTVESFWYFLLTGEVPTQAQVDEVLTEWKVRQEVPQYVFDTIRTLPRDSHPMAMLSVGITAMQRDSKFAALYNAGKFNKLSAWESVYEDACDIVARIPVIAAFIYNLKYKGDKQIAIDPALDMGANFAHMIDQGDAYKDVARMYFILHSDHESGNVSAHTTHLVHSALSDPYYAYAAGLNGLAGPLHGRANQEVLDWTIKFQEKYCKDQEPTKELITRALWDTLNSGQVIPGYGHAVLRKTDPRYISQREFCQKHLPEDPLFKLVSMIFEVAPGVLTEHGKTKNPWPNVDAQSGVIQWHYGVKEWDFYTVLFGVGRALGCMANITWDRGLGYAIERPKSVTTPMLEEWAAKGGRL

SEQ ID NO: 27855 - protein, 144 aa, Schizosaccharomyces pombe
DPYVEWVISLEQNVMEGAFDKVASMIRSCNFPEFSYFMKIVMSMVRNEIATCAEKVYSEIPLSNATSLLYLENTKETEKLAEERGWDIRDGVIYFPKEANALETEDGMLIDEEDELELPPTASKHTISSIRQLLSYTSELEQIV

SEQ ID NO: 27856 - protein, 103 aa, Emericella nidulans
MSGRGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 27857 - protein, 217 aa, Synechococcus sp. WH 8102
MNQPRRNLTRQQALRLVEGAYLAATTGLIWLALYYLPVGGALFRLALPLPLSLLQLRHGGRSGAEGVLLAVLLMTALMGPVRGPLLLFPYGLMALWLGWSWGKGRSWWLSWSVGVVLGSIGFLVRVLVLSLLVGENLWVVITRAGAGLLERLIALLQLPISPDLTSVQLMALGLVVVQEVIYVLSLHALAYWIFPRLNAPIPEPPKLLQGLVALDPL

SEQ ID NO: 27858 - protein, 309 aa, Oryza sativa
MRDVWGCRQWLRRSSARSSRCHSVDQQPERSRIARRARPRQWRRTALLSAALVPRQPPATPALLPAASKETEWSSTESSAASGLDFEDTALTLRLPCSLAAAVPDPTASAPPPKPTRPTTPPPSPPPATTIGFPTAAAAATADRAMPTPASPRLRQNIRVREILNAKGEAKAGAVYWCCTSHFVHEAIKHMTAHNVGALVVLKSGDEKQLAGIVTERDFARKILLPGRPSEETRVGDIMTEEDKLITVSSNTNILQAMELMTERHIRHVPVFDEKVVGMITIGDVVKTIVDQQHQEVKQLKKYIRGDYY

SEQ ID NO: 27859 - protein, 660 aa, Alkaliphilus metalliredigenes QYMF
MKQIEQKAINTIRLLAVDGVEKANSGHPGLPMGAAPMAYTLWSQFLNHSPNDPQWTNRDRFVLSAGHGSMLIYSLLHLFNYGLTIEDLQNFRQWGSKTPGHPEFGHTVGIETTTGPLGQGLTNAVGMAMAERRLAAEFNRDQYDVVDHYTYVIAGDGDMMEGITSEAASLAGHLGLHKLICLYDDNNISIDGNTSLTFTEDVAKRYEAYGWQVVIVKDGNDVAEITKAIKAAKENKEQPTLIKVKTTIGFGSPNKQGTAGVHGAPLGKDEIQLTRKTLEWAHDEDFFVPEDVKGHFDGLVKDSNEKAKVWEEMFKGYSEAHPELAKAWKQWHSRELPQELLKDASLWEFSEKPMATRSTSGEVMNRLKKHLPNLMGGSADLNPSTKTYLKEMGDFQKGEWKGNNIYFGVREHAMAGITNGMALHGGLRVFCSTFFVFSDYMKPAIRLSALMKQPVVYVFTHDSIGVGEDGPTHQPIEHLLMLRSIPNVQVLRPADGKETTAAWIQALKHQEGPTVLVLSRQNLAQLEGSGQDAAKGAYVVSKGKKETPDMILMASGSEVPLAIEAQKALQDKGIEANVVSMMSWELFKNQSKEYQEEILPKQVTKRISIETGVTLGWSQFIGDAGIAIGIDDFGASAPGEVLMDKYGFTVENIVEKAMTL

SEQ ID NO: 27860 - protein, 486 aa, Nocardioides sp. JS614
MADFTLAQIPDLPLDLCVGGKEVPASDGGRFDVLDPATGAVLTSVANGTVEDALACVDAADAAAAAWAATAPRERSEILRKAFELMRERADELAHLISLENGKALADARGEVAYAAEFFRWYAEEAVRAAGSVMTAPSGANRIVVLQQPVGICVLVTPWNFPAAMATRKIGPALAAGCTVVLKPASDTPLTALLMAKILADAGVPAGVVNVLPARRSGAVVSAMLHDPRVRKLSFTGSTEVGRVLLREAADQVVNCSMELGGNAPFIVLDDADLDAAVDGAMIAKMRNAGEACTAANRFYVHADVADEFSRRLAERMAALRVGPGTADDTEVGPLVNDESAAKVDELVRGAVSAGARVVVGGRRPEREGYYYEPTVLLDVPVDAEILGEEIFGPVAPVVTFTDEDDAIRMANETEYGLVSYVYTRDLARGMRVSERLDSGMVGLNRGLVSDPAAPFGGTKQSGVGREGGHEGMLDYLESKYVAVSW

SEQ ID NO: 27861 - protein, 286 aa, Campylobacter upsaliensis RM3195
MKELANILDLLPEELNEKIQPMFRVKQICQWIYQKYADDFSKMSNLPKNLREELAKNYHFEPLKCIKEERSKDGSIKYLFELEDGLRIESVLLPMKEEKFDEEGKRLSHAKFTICVSSQVGCRSGCSFCLTAKGGLKRNLSAGEIVGQILWIKRQNHIPYERRVNIVYMGMGEPLDNLNNVAKAVREFPIDMRKKVMFEYLLIDGINDKIEHAKELVKLLNGIKAKVNLILFNPHQGSIYKRPNLENAVKFQDLLSQKGVTCTIRESKGLDISAACGQLKEREKNL

SEQ ID NO: 27862 - protein, 317 aa, Arabidopsis thaliana
MNRGVLESSPVQHLTAAGNPNWWNNVSRGLRPPTPLMSHEPPSTTAFIPSLLPNFFSSPTSSSSSSPSFPPPNSNPNFSSWLEMSDLPLDQPWSLSQLLLGGLMMGEEEKMEMMNHHHHQNQHQSYQAKRIQNWEEQVLRHQASMKQESSNNNSYGIMSSPNSPPNKSCATIINTNEDNNNNIHSGLNLSECNSSEMIGSSFANKKPKLQVPSSQSTLKVRKEKLGGRIASLHQLVSPFGKTDTASVLSEAIGYIRFLHSQIEALSLPYFGTPSRNNMMHQHAQRNMNGIFPEDPGQVRTYIFLLSSFIYFTFYWIN

SEQ ID NO: 27863 - protein, 545 aa, Candida albicans SC5314
MSSKIERIFSGPALKINTYLDKLPKIYNVFFIASISTIAGMMFGFDISSMSAFIGAEHYMRYFNSPGSDIQGFITSSMALGSFFGSIASSFVSEPFGRRLSLLTCAFFWMVGAAIQSSVQNRAQLIIGRIISGIGVGFGSAVAPVYGAELAPRKIRGLIGGMFQFFVTLGIMIMFYLSFGLGHINGVASFRIAWGLQIVPGLCLFLGCFFIPESPRWLAKQGQWEAAEEIVAKIQAHGDRENPDVLIEISEIKDQLLLEESSKQIGYATLFTKKYIQRTFTAIFAQIWQQLTGMNVMMYYIVYIFQMAGYSGNSNLVASSIQYVINTCVTVPALYFIDKVGRRPLLIGGATMMMAFQFGLAGILGQYSIPWPDSGNDSVNIRIPEDNKSASKGAIACCYLFVASFAFTWGVGIWVYCAEIWGDNRVAQRGNAISTSANWILNFAIAMYTPSGFKNISWKTYIIYGVFCFAMATHVYFGFPETKGKRLEEIGQMWEERVPAWRSRSWQPTVPIASDAELARKMEVEHEEDKLMNEDSNSESRENQA

SEQ ID NO: 27864 - protein, 392 aa, Synechococcus sp. WH 8102
MPTSRRLEALGNGVFARTDRAKQAHRDKTGVPPLIDLSLGSTDLQPPEEILRCMAAAVTDPASSAYCLEAGTAPFQQAVAAWCQRRFGVEVDPQRQVQLLVGSQEGTAHLPLAILDPGDRALLLDPSYPSHRGGLVLAGASICSLPLFQEQDWLPDFDAIRPAVWDQLKLFVLGYPHNPTATVGNQELLDQAMARGCRHQLVIANDNPYVDLALEGEAPSLLRSPGWSEWGIEFFSLSKGWCLGGFRLAFAIGAEPLITALRQVKGVVDFNQSLALQQGAIQALTQWADWPRSLHGAYRERRDRVLSVLRGGGWSCPTPGMAMYLWLPLPADAGVRKLDDETFASHVLQRSGVALTPGSGFGEGGKGWLRMALVRPTDELEDAARRVVAAVP

SEQ ID NO: 27865 - protein, 308 aa, Mycobacterium tuberculosis H37Rv
MTGPPPSLPERIRTDEADVLMLPDGRALAYLEWGDSTGYPAFYFHGTPSSRLEGAFADGAARRTGFRLIAIDRPGYGRSTFQAGRNFRDWPADVCALADAFELEEFGVVGHSGAGPHLFACGAVIPRTRLAFVGALGPWGPLATPDIMRSLNAADRCYARLARSGPRLFGALFAPLGWCAKYTPGLFSTLLAAAVPAADKHLLSDERFGRHLRAIQLEAFRQGSRGAAYESFLQFRPWGFDLAEVAVPTHIWLGDRDSFVPRAMGEYLQRAIPHVDLHWAHGKGHFNIEDWDAILAACALDIGKRRGG

SEQ ID NO: 27866 - protein, 325 aa, Cattleya bicolor
MESGSFPVINMELLESSQRPEAMALLREACENWGFFELLNHGISTELMNRVETVNKENYRRFREQRFKEFAAKTLDSGEKVDGDNLDWESTFFLRHLPTSNISQIPDLDEDCRSTMKEFARELEKLAERLLDLLCEDLGLEKGYLKRVFCGGSDGLPTFGTKVSNYPPCPKPELIKGLKAHTDAGGIILLFQDDKVSGLQLLKDGQWIDVPPLRHSIVVNIGDQLEVITNGKYKSVMHRVVAQTDGNRMSIASFYNPGSDAVISPAPELVEKEAEEEKKEATYPKFVFEDYMNLYIRKKFEAKEPRFEAMKTMETVSGSQLIPTA

SEQ ID NO: 27867 - protein, 303 aa, Cattleya intermedia
MAVLREACENWGFFELLNHGISTELMNRVETVNKENYRRFREQRFKEFAAKTLDSGEKVDGDNLDWESTFFLRHLPTSNISQIPDLDEDCRSTMKEFARELEKLAERLLDLLCEDLGLEKGYLKRVFCGGSDGLPTFGTKVSNYPPCPKPELIKGLRAHTDAGGIILLFQDDKVSGLQLLKDGQWIDVPPLRYSIVVNIGDQLEVITNGKYKSVMHRVVAQTEGNRMSIASFYNPGSDAVISPAPALVEKEAEEEKKETTYPKFVFQDYMNLYIRKKFEAKEPRFEAMKTMETVSGSQLIPTA

SEQ ID NO: 27868 - protein, 390 aa, Novosphingobium aromaticivorans DSM 12444
MEKAERPYDVVVYGATGFTGRLVAEYLARHYGQEGPRWAMAGRSGAKLAEVRALIEAPKNTPLIVADASDPASLADMVRQAKVVLTTVGPYQLYGEPLLAACVAAGTDYADLCGEPVWMRQMIDKYGDDARHSGARICFSSGFDSIPFDLGVLMLQKEAVARFGRPAPRVKGRVRGMKGGASGGTAASLKATLAALGKDPSLIPLMASPFCLTPGFEGPAQPAGDKVQHDDALGSWETPFIMAAINTKNVHRTNALLGHAWGKDFVYDEMVLTGPGEQGKAVAEHMAKTPMIGRPDDPLPGEGPSKEERETGFYDVLFVGEMPGGETIRYGVKGRYDPGYGSTSRMIAETGIALLSSTAAGGIGTPGAILGETLVARLRAHAEIAFAPED

SEQ ID NO: 27869 - protein, 287 aa, Arabidopsis thaliana
MAAPRNLTGDGGARQLVKDEESPAASSAAKGLLNDDSPTGKRTKSERFPLSRWEFAVFFTVFLVFTTGLFCIYLTMPAAEYGKLKVPRTISDLRLLKENLGSYASEYQARFILGYCSTYIFMQTFMIPGTIFMSLLAGALFGVVRGFVLVVLNATAGACSCFFLSKLVGRPLVNWLWPEKLRFFQAEIAKRRDRLLNYMLFLRITPTLPNLFINLSSPIVDIPFHVFFLATLVGLMPASYITVRAGLALGDLRSVKDLYDFKTLSVLFLIGSISIFPALLKRKRVYE

SEQ ID NO: 27870 - protein, 292 aa, Rhodococcus sp. RHA1
MSEDLAGVYSAVATPFTQDQQLDEAGLRRLVDRTIESGIHGLVPLGSTGEFFALSRGERECALEVVLDQTAGRVPVVPHTGATSTAEAIALSRHAEKAGATALMLVAPYYEPFSIEEVKSYYKDVAGSVSIPVMAYNLPAATGVNLTPHILCELIDEVPNVKYVKDTSGDFTAAAQLIHEFGDKVSVFVGWDTLFYAALLEGAAGSVIGAANVVPRQLIDVYDAIQASDLALARKLWAKLFPVMSTLVSGGYTAAVKAGMELVGHPAGPQRAPGAALTGPRLRELEKALAAL

SEQ ID NO: 27871 - protein, 130 aa, Ostreococcus tauri
MLRASGSGAIVFNSSVSGLTSTATGSLYAMSKGAMNQLTRYLACEWAKDNIRVNAVAPWYIATPLAKQVLKNETYRRAVVDRTPAGRVGEPPEVGAVAAFLVAPASSYVTGVVIPIDGGFTAHGFIPPKL

SEQ ID NO: 27872 - protein, 270 aa, Triticum aestivum
  misc_feature (146)..(146): Xaa can be any naturally occurring amino acid
  misc_feature (149)..(149): Xaa can be any naturally occurring amino acid
  misc_feature (151)..(151): Xaa can be any naturally occurring amino acid
  misc_feature (153)..(154): Xaa can be any naturally occurring amino acid
  misc_feature (163)..(163): Xaa can be any naturally occurring amino acid
  misc_feature (168)..(168): Xaa can be any naturally occurring amino acid
  misc_feature (172)..(172): Xaa can be any naturally occurring amino acid
  misc_feature (175)..(177): Xaa can be any naturally occurring amino acid
  misc_feature (182)..(182): Xaa can be any naturally occurring amino acid
  misc_feature (185)..(185): Xaa can be any naturally occurring amino acid
  misc_feature (192)..(192): Xaa can be any naturally occurring amino acid
  misc_feature (194)..(195): Xaa can be any naturally occurring amino acid
  misc_feature (197)..(197): Xaa can be any naturally occurring amino acid
  misc_feature (214)..(214): Xaa can be any naturally occurring amino acid
  misc_feature (216)..(216): Xaa can be any naturally occurring amino acid
  misc_feature (222)..(222): Xaa can be any naturally occurring amino acid
  misc_feature (226)..(227): Xaa can be any naturally occurring amino acid
  misc_feature (241)..(241): Xaa can be any naturally occurring amino acid
  misc_feature (244)..(244): Xaa can be any naturally occurring amino acid
  misc_feature (249)..(249): Xaa can be any naturally occurring amino acid
  unsure (1)..(270): unsure at all Xaa locations
MPINAADSVPSPPTRSTSASHFPPPPFLKIYTKIRSKILPKSPTSRFCSRSHPNPLQETLATGSTAAHALDRLGDLLRTGALRAVAGVPTSLKTEAHAARVGIPMLALADAAEIHLSIDGADEVDPDLNLVKGRGGSLLREKILRXRAXCXHXXGPSFPRLGXRARAXSCPXGQXXXFGLTXKFXKMPGFPXRXXPXSHKPGTARRSLSHGQRXHXSRCSLXDGIXXNLRDISDSLLRITXVVXHGMFXGMATKVIVARKDGTVAVLSMK

SEQ ID NO: 27873 - protein, 331 aa, Novosphingobium aromaticivorans DSM 12444
MSDPLYDVIAIGNAIVDVMAPCEDADIARLGLAKGGMTLVDTARAKELYDAMGPAREISGGSAANTLAGLAALGANCAFIGQVADDQLGEVFAHDIRAGGIAFDTPTRADEPPTARCLIFVTPDGQRTMNTFLGASQFLPAEALDDATIAAAQVLYLEGYLWDPEEPRKAMRRAIAAARNAGRKVAFTLSDAFVISRHGDDFRALIDAGQIDILFANEHELAALTGIEDFHVGIEQLAAKVPTVVVTRSENGAHAISQGERAHVPAEPIAKVVDTTGAGDLFAAGFLYGYVRGRPLAESLTLGAICAAEIISHYGARPEADLKDLVAQRLG

SEQ ID NO: 27874 - protein, 290 aa, marine gamma proteobacterium HTCC2080
MITGSIVALVTPMLSDGAVDKEGLATLIEYHIQSGTAALGMAGTTGESATLTMSEHIDVIQFAVEQAAGRIPVVAGTGSNSTHEAIELTVAAAAVGAEYSLLVTPYYNKPPQEGLYRHFCKVAAAVNIPIILYNVPSRTGTDLSNETVLRLSEVGNIAGLKDATGDVQRGGALIAKLPDTFSVYSGDDATAFDLMSLGGRGNVSVTANIAATQVAEVCRLAIAGDIEGAGKINAELNALNNALFIEPNPIPIKWAMLELGMIKDGIRLPLVALSSKHQETVLNAIRQAGL

SEQ ID NO: 27875 - protein, 498 aa, Rhodococcus sp. RHA1
MAQHIWDRPAQYIGGRYRDGKSADTFDVLDPSTGRTVVTGPLASTEDVDDAVTAAAGALPEWAGATPAHRCEVMTRWARELEAIADQLATVESAQAGKPIKLTTEFDVPGSIDNVAFFAGAARNLEGKASGEYSGDHTSSIRREPIGVVGSIAPWNYPLQMAAWKILPAVAAGNTIVLKPAEITPLTSLLFAEAATRAGIPDGVINVITGKGTTAGNALVTHRDISMVSFTGSTPVGHGIAAAAAGKRLHLELGGKAPFVVFDDADVDAAIQGAVAASLINTGQDCTAATRAYVQRPLFDRFVDGVAAVMDTVRLGPTTDPSTDQGPLVSRRQQGHVAGFVDRARAGGATIVRGGNIPGGDLADGFYYEPTLVVGATQDSEIVQQEIFGPVLVVLPFDNDDEGIALANDTPFGLAASAWTRDLYRAQRATRDIAAGCVWVNDHIPIISEMPHGGYKQSGYGKDMSTYSLDEYTNVKHVMSDITGVAHKDWHRTIFGDR

SEQ ID NO: 27876 - protein, 466 aa, Glycine max
MTIGSLAPKAEKKKSRKNKTVVVNENAPLLPKSHVQESDAGFDDFNGASFSGAVFNLSTTIIGAGIMALPATLKQLGMIPGLLAIIIMALLTEKSIELLIRFTRAGKSASYAGLMGDSFGNYGKALVQICVIINNIGVLIVYMIIIGDVLSGTSSSGDHHYGILEGWFGVQWWTGRTFVVLFTTLAIFVPLASFKRIDSLRFTSALSVALAVVFLVIAVGIAVVKIFSGGIVMPRLFPVTTDVASFFRLFTVVPVFVTAYICHYNVHSIDNELEDSSQMQGVVQTALVLCSSVYVMISFFGFLLFGEGTLDDVLANFDTDLGIPFGSVLNDAVRISYAAHLMLVFPVVFFPLRLNIDGLLFSKSRPLVLDNVRFASLTVALIGVIFLGANFIPSIWDAFQFTGATAAVCIGFIFPAAITLKDRYNIATKSDKILSVIMIVLAVFSNVVAIYSDAYALIKQNKTSRE

SEQ ID NO: 27877 - protein, 493 aa, Rhodococcus sp. RHA1
MTLSTIGSDQRSVLHRLAGRVTGNFINGRWTPSNSPEIITVLDPSTGREIGTVPASSTADVDAAVAAARAAQPGWAALTPAARSKFLLDIATMTEELLAEISIVEAVDAGKPITAVRDEELPGVIDAMRFFAGAARTLPAPSSGDYLAGVSSIMRREPIGVAAGITPWNYPLLQAVAKVFPALATGNTYVLKPAETTPYSTAWLAEIVARVLPDGVFNVVFGTGAVAGDALARHPKVDVVSFTGSIDTGRKVGIAAADGVKKAIMELGGNSPVIVFGDADLESALDAIATGGLYNTGQECMSASRVIVHACLLDAFVDGLKERCSREKLGDVLDPTTTVGPMNSAQQRDRVLAKITGRSTGARVVSGGESCEGDGFFFPPTIVVGVADDEELVQEEIFGPVFTVQTFETEEQAIALANGTRYGLASSLFTSNVGTATRVQNALNFGTVWVNNHLVFAADLPVSGFGASGIGTENAEAGLLEYTRLKHVMVDIR

SEQ ID NO: 27878 - protein, 142 aa, Novosphingobium aromaticivorans DSM 12444
MTIAQVIAGRGEVWSCHADDSVADAVDMLARYRIGALPVEDGTNGVAGIFSERDMIRCLHKHGEAALHMKVRDMMTAPVVTITPQTSVLEALALMTQRRFRHLPVVEGGHMVAFVSIGDLVKHRIDKIEAEADAMRVYIQQA

SEQ ID NO: 27879 - protein, 304 aa, Prochlorococcus marinus str. MIT 9301
MHEFLPYAWFEGKCIPFKEAKISIATHALHYGTAAFGGMRAIPNPTNKEEFLLFRTDKHIKRLSQSAKLLLTDISEEYIFKALEEVIKRNKPQKPIYIRPFVYTSDLGIAPRLHNIETDFFMYCIELGDYLSPDGVSCRMSSWTRQEDRSLPLRGKISGAYITSSLAKTEASLSGFDEALLLNSSGKVSEASGMNLFIVRNGDLITPGVDQDILEGITRASVIELAKSFGINVIERPVDKTELLIADEVFLTGTAAKITPVKKIESSELNGDRPIMNKLKSKLIEITEGRSQDYDNWVTRISLK

SEQ ID NO: 27880 - protein, 377 aa, Sulfolobus solfataricus P2
MSVVSKGLENVIIKVTNLTFIDGEKGILRYRGYNIEDLVNYGSYEETIYLMLYGKLPTKKELNDLKAKLNEEYEVPQEVLDTIYLMPKEADAIGLLEVGTAALASIDKNFKWKENDKEKAISIIAKMATLVANVYRRKEGNKPRIPEPSDSFAKSFLLASFAREPTTDEINAMDKALILYTDHEVPASTTAALVAASTLSDMYSSLTAALAALKGPLHGGAAEEAFKQFIEIGDPNRVQNWFNDKVVNQKNRLMGFGHRVYKTYDPRAKIFKKLALTLIERNADARRYFEIAQKLEELGIKQFSSKGIYPNTDFYSGIVFYALGFPVYMFTALFALSRTLGWLAHIIEYVEEQHRLIRPRALYVGPEYQEYVSIDKR

SEQ ID NO: 27881 - protein, 443 aa, Glycine max
MIYTAIDTFYLTDEQLAISPSRKDGIDEATETSLRIYGCDLIQESGILLRLPQAVMATGQVLFHRFYCKKSFARFNVKKVAASCVWLASKLEENPRKARQVIIVFHRMECRREDFPMEHLDLYSKKYVDLKMELSRTERHILKEMGFICHVEHPHKFISNYLATLETPPELRQEAWNLANDSLRTTLCVRFKSEVVACGVVYAAARRFQVPLPENPPWWKAFDGEKSGIDEVGRVLAHLYSLPKAQYIPVCKDGDFTFSNKSSETKSQSTPKDVPQNSSPADTDNSVPKGAQGEANTESNGGKGAMVNVAIDKLKDSKRSDDESKGMSTEGEARDEPILKSKADHIGETRRNRDRDRDRERDRGRERDRDRDRDRTKSRDRDRGRDSDKEREREEAERDKLKDRGHRSRERAKDSGHSEKSKRHSSHDRVSYSSREKDRHRHH

SEQ ID NO: 27882 - protein, 330 aa, Shewanella sp. ANA-3
MQTLAQHLTSKAVNESLSQLILTLADTSKAISHAVRHGALAGVLGATEQENVQGETQKKLDIITNDMLKDALKADGTVRGLASEEEDHVVEVCANGQYLVCFDPLDGSSNIDINSLVGTIFSVLPAPQGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGLDYSEEPSLD

SEQ ID NO: 27883 - protein, 233 aa, Zea mays
ARGIDELLSLQETDPVYYTDTVIKGIVSILLSAGTDTTALTMEWAMAQLLTHRDAMQKTRAEIDANVGTSRLVDESDTAHLPYLQCVVKETLRLCPVGPVIPAHEAMEDCAVGGFRVQRGTMVLVNAWLIHRDPRLWEAPGEFRPERFLDATATVAAPLLPFGLGRRRCPGEGMALRLLSLTLAALLQCFDWEVGGAAVDMAEGVGLSMPMAKPLEVVCRPREFVQTVLSAST

SEQ ID NO: 27884 - protein, 185 aa, Glycine max
  misc_feature (50)..(50): Xaa can be any naturally occurring amino acid
  unsure (1)..(185): unsure at all Xaa locations
MVKAYTQEHVYKHPWERVTCASWRKFADQENKRILSHILDVDTLNHSLDXSSGMLYTTRAITIHCPGPWFVRKIVGQDICHCVESTVVDARSRSMQLTSRNISLQKFIEVEEKIRYDPHPDNPTGWTICQQETRIRIKPLSALASMAEKVEQRCAEKFLQNSVKGREVMERICKYLEAESSSLAL

SEQ ID NO: 27885 - protein, 302 aa, Ipomoea batatas
MDYERFIQAHRETDADITVAALPMDEKRATAFGLMKIDEEGRIIEFAEKPKREQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPISTTPRYLPPSKMLDADVTDSVIGEGCVIKNCKIHHSVVGLRSCISEGAIIEDSLLMGADYYETDADRRLLAAKGSVPIGIGRNSHIKRAIIHNIARIGNDVKIINNDNVQEAARETEGYFIKSGIVTIIKDALIPSGTII

SEQ ID NO: 27886 - protein, 497 aa, Arabidopsis thaliana
MEMILMVSLCLTTLITLFLLKQFLKRTANKVNLPPSPWRLPLIGNLHQLSLHPHRSLHSLSLRYGPLMLLHFGRVPILVVSSGEAAQEVLKTHDLKFANRPRSKAVHGLMNGGRDVVFGPYGEYWRQMKSVCILNLLTNKMVASFEKIREEELNEMIKKLEKASSSSSSENLSELFVTLPSDVTSRIALGRKHSEDETARDLKKRVRQIMELLGEFPIGDYVPALAWIDRINGFNARIKEVSQGFSDLMDKVVQEHLEAGNHKEDFVDILLSIESEKSIGFQAQRDDIKFMILDMFIGGTSTSSTLLEWIMTELIRNPNVMKKLQDEIRSTIRPHGSYIKEKDVENMKYLKAVIKEVFRVHPPLPLILPRLLSEDVKVKGYNIAAGTEVIINAWAIQRDPAIWGPDAEEFKPERHLDSTLDYHGKDLNFIPFGSGRRICPGINLALGLVEVTVANLVGRFDWRAEAGPNGDQPDLTEAFGLDVCRKFPLIAFPSSVI

SEQ ID NO: 27887 - protein, 471 aa, Oryza sativa (indica cultivar-group)
MASAAAAAASDEPPRKRARSAGAEDRLSELPDCLLHDILALVGSRQAVRTSVLSRRWRGLWRSAPRVDIDQREFRRACGGEEGEPVVDCDGFEDFADGILSPTLLGGTGTPPLDAFRLHLLYEGRFITFGRWVRRALTRRPASVDIHVEYGGTVDWPPALTLGDGAGTGRLKRLHLFGVHLGFISGDGGRLAELLPVLEDLRMESCTFGHEPSSPTTTIAIPTLRSLALAVVPRRTARPYALTVASPRVASLRLFLPFSRTRAAAVRVAPAEEGEALASLVTASITVLETDQELNRRMNKHKLDFLASTRNMLDRFPNVRNLDLSGFPTIALLDKASQEFPTLPSLTTLLLSVCDVGANCYVLKSVLRNAPNLEHLRLHRCKSTTTSGSLKKVKNVSVGRKMTLCFNSNVLFEFIEDGSKLRAPVEGHCLSPFPVLHTLCVYDGVTTEKVCTKSQSGSFDAKVILAIPMLL

SEQ ID NO: 27888 - protein, 374 aa, Campylobacter upsaliensis RM3195
MLYDIAIIGSGTVGAFAGYYAAKAGKKVCLIDKFQTPHTLGSYHGDTRIFRIAYGEGSKYIPLLQEAYTLWGEFEKAHKIKLFERGGLLNVGSYDNDFMQNILTSIKEFKLNTKQLNAKEIYENYGIKIAKDCFGILEPDTGFVYSDLSVSRAILEAQNLGADILIDTLKNVDKKEDIFTLHFENKEKIKAKQILICAGSFVNEVLDCFDFELAPVCVKAKRKVVHWYESLGNYPVSKLSSFIIEFEDDHFYGFYDFKDGLKIGRDQSGQFINNREECKDFGAYKEDFREIDVYIKNFFPKIGSFKKGSVCSYPLSADNDFIIDFLSENVFFIGGLSHGFKFAPVLGKFGFEALNFNKLNEDIQKHFSLSRFKR

SEQ ID NO: 27889 - protein, 497 aa, Arabidopsis thaliana
MEMILSISLCLTTLITLLLLRRFLKRTATKVNLPPSPWRLPVIGNLHQLSLHPHRSLRSLSLRYGPLMLLHFGRVPILVVSSGEAAQEVLKTHDHKFANRPRSKAVHGLMNGGRDVVFAPYGEYWRQMKSVCILNLLTNKMVESFEKVREDEVNAMIEKLEKASSSSSSENLSELFITLPSDVTSRVALGRKHSEDETARDLKKRVRQIMELLGEFPIGEYVPILAWIDGIRGFNNKIKEVSRGFSDLMDKVVQEHLEASNDKADFVDILLSIEKDKNSGFQVQRNDIKFMILDMFIGGTSTTSTLLEWTMTELIRSPKSMKKLQDEIRSTIRPHGSYIKEKEVENMKYLKAVIKEVLRLHPSLPMILPRLLSEDVKVKGYNIAAGTEVIINAWAIQRDTAIWGPDAEEFKPERHLDSGLDYHGKNLNYIPFGSGRRICPGINLALGLAEVTVANLVGRFDWRVEAGPNGDQPDLTEAIGIDVCRKFPLIAFPSSVV

SEQ ID NO: 27890 - protein, 416 aa, Oryza sativa (indica cultivar-group)
MRRERDATQIPENPMEGIPQTAAAAAAAAAAEASEPPRKRARVDGGGGGAGEEEDRLSDLPDCLLEDILAHLGSRQAVQTSVLSRRWRNLWRGVRVVVIDVGSFRLPGADGDPPRFRLDRIEDFADGVLSPSLHPGAARELDALRMRLDEDAVTTNFQRWIRRALWRRPATVDLYYLPRRSFSWPPAVPLTPVTAVSRLKTLRIFGLRPTVVFGADEFPALEDLHIERCSYAHGTIASPTLKRLALVSPINGCFVREQRLTAPGLTSLRLVLPYSREEGVRVITDAPLTSLVDASITIVDTDPGDPRNRRVNQFKVDFLVAISNLLGRLTSVRNLDLTGLNATALLDNKSQEFPMFPYLTTLLLNECDIGYKYHVLRSILQNAPNLEQLRLHNCKVSFGEVKHMVHLALIPSWFGI

SEQ ID NO: 27891 - protein, 141 aa, Ralstonia eutropha JMP134
MAIERTLSIIKPDAVAKNVIGQIYARFEAAGLKIVAAKMVHLSRGEAEQFYAVHKERPFFKDLVDFMVSGPVMIQALEGEGAIAKNRDLMGATDPKKADKGTIRADFADSIDANAVHGSDAAETAAVEIAFFFPGMNVYTR

SEQ ID NO: 27892 - protein, 128 aa, Arabidopsis thaliana
MEKVSIVCFFFFLLFGSGYGGLPPFWRATVVTMTNLIGGPPLTIHCKSKQDDLGIHVVPFKQEYHFKFQPNLWKSTLFFCSFQWDSQFKSFDIYDAQRDQGICDDCQWEIKPDGPCRLGKKAKCFPWK

SEQ ID NO: 27893 - protein, 508 aa, Aspergillus nidulans FGSC A4
MNWLRGASDPPRPASPADSEEPLLNDDDRSHRSSQDEEATQNDVKRSPRSRTRVVTLFILLTSSITTVAVVIYLLVAHRLPAPTGPLHHHDSNTPIKNVVVLVQENLSFDTLAGGLNYSRDIDNIVNLPPNKRFCNPSNVADPSSPLICAKPLAKNVAPDDPDHSIAGGNFQVYGTDHPDLSIHKPTMQGFVSEQIRSHGINGDLKRAAEVINYYAPEHIPVFNALAENYLLLDRWFASVPGPTNPNRAYLTSGTSHGHGWNDPSFDHSSLPQVSIFQQLTEANISWINYSNATGFAPDALFYTWTAKSEAGRNSIKSIDQFYSDAAAGNLPQFTWINPECCSYTSFHPPSPTNLGEGFVKSVYEALRAGPQWNETLFILTFDEHGGFADHVPPPEKVPPGDGIPYTEVAKDGKPTTFHFDRLGIRVPTLLISPYVQKGAVVHGPKGKGKKGQAKGEYTHTSILKYVDELWGLDILTPRVEWSASFGDLIEKKFREDTPELLPEPVIF

SEQ ID NO: 27894 - protein, 291 aa, Enterococcus faecalis V583
MRYLSKDILEEVITQRPSDSYKSNFGRVVLIGGNRQYGGAIIMSTEACINSGAGLTTVITDVKNHGPLHARCPEAMVVGFEETVLLTNVVEQADVILIGPGLGLDATAQQILKMVLAQHQKQQWLIIDGSAITLFSQGNFSLTYPEKVVFTPHQMEWQRLSHLPIEQQTLANNQRQQAKLGSTIVLKSHRTTIFHAGEPFQNTGGNPGMATGGTGDTLAGIIAGFLAQFKPTIETIAGAVYLHSLIGDDLAKTDYVVLPTKISQALPTYMKKYAQPHTAPDSELLEQKRSR

SEQ ID NO: 27895 - protein, 339 aa, Enterococcus faecalis V583
MEKANLDWNNLGFSYIKTPFRYISYWRDGKWEEGTLTDNNQLTISEGSPALHYGQQCFEGLKAYQCADGSVNLFRPDENAKRLQKSCARLLMPQVPVETFVSACQEVVKANLAYLPPYGTGGTLYLRPYMIGVGDNIGVAPAKEYIFSIFCVPVGSYFKNGLAPTNFIVSEYDRAAGRGTGAAKVGGNYAASLLPGAEAHEKEFSDCIYLDPYTHTKIEEVGAANFFGITKDGTFITPKSASILPSITKYSLLTLAKERLGMTALEGDVYIDRLADFSEAGACGTAAIISPIGGIQNGTDFHVFYSETEVGPVTKQLYDELVGIQFGDKEAPEGWIVKV

SEQ ID NO: 27896 - protein, 253 aa, Triticum aestivum
MGRKFFVGGNWKCNGTVEQVESIVNTLNAGQIASTDVVEVVVSPPYVFLPTVKAKLRPEIQVAAQNCWVKKGGAFTGEVSAEMLVNLGVPWVILGHSERRSLMGESSEFVGEKVAYALAQGLKVIACVGETLEQREAGSTMEVVAEQTKAITGKIKDWTNVVVAYEPVWAIGTGKVATPAQAQEVHANLRDWLKTNVSPEVAASTRIIYGGSVTGASCKELAGQPDVDGFLVGGASLKPEFIDIINAATVKSA

SEQ ID NO: 27897 - protein, 554 aa, Bdellovibrio bacteriovorus HD100
MERIWLKNYPKGVPHEVDLSKYGSLVDVYEEAIGKFKTKKAFTSMGVSLTFSELDRKVDQFASFLQNELKLKKGDRIAIQMPNLLQFPIVAFAALRSGLTIVNTNPLYTAKEMRHQFKDSGAKAIVILANYAHLLQEILKETDIESVVITEVADLFPTPKRILVNSVVKYIKKMVPAYHLPQAYTFRQALELGAMKPSSKVPTSLEDVAFLQYTGGTTGVAKGAMLTHRNVAANMLQICDWMKPKLREGEEVAIAALPMYHIFALTLNCLGLLRYGSENVLILNPRDIPGFIKELKNTPFTVMAGVNTLFNALMNNPAFTTIDFTRVKVSVAGAMTLQKPVAEKWMELTKSVIVEGYGLTEASPVVCCNPIDGTDRVGTIGLPFPSTDIMLIDDDGKEVALGEPGELVCRGPQVMAGYWNRPDETAQVLNDGWLKTGDVAVADADGFFKIVDRKKDMILVSGFNVYPNEVEEAIASHPGVLEVAAIGVVDQHSGEIVKAVVVKKDPNLTAEDVIAHARKSLTNYKVPRLVEFRTELPKTNVGKILRRALRDNVK

SEQ ID NO: 27898 - protein, 870 aa, Neurospora crassa
METTLPLPFLVGVSVPPGLNDIKEGLSREEVSCLGCVFFEVKPQTLEKILRFLKRHNVEFEPYFDVTALESIDDIITLLDAGARKVFVKTEQLADLSAYGSRVAPIVTGSSAALLSSATESGLLLSGFDQTASEAAQFLEEARDKKITPFFIKPVPGADLEQFIQVAAKANAIPILPSTGLTTKKDEAGKLAISTILSSVWKSDRPDGLLPTVVVDEHDTALGLVYSSAESVNEALRTQTGVYQSRKRGLWYKGATSGDTQELVRISLDCDNDALKFVVKQKGRFCHLDQSGCFGQLKGLPKLEQTLISRKQSAPEGSYTARLFSDEKLVRAKIMEEAEELCTAQTPQEIAFEAADLFYFALTRAVAAGVTLADIERSLDAKSWKVKRRTGDAKGKWAEKEGIKPAASALAATSAPVTKEAAQETTPEKITMRRFDASKVSTEELDAALKRPAQKSSDAIYKIIVPIIEDVRKNGDKAVLSYTHKFEKATSLTSPVLKAPFPKELMQLPEETIAAIDVSFENIRKFHAAQKEEKPLQVETMPGVVCSRFSRPIEAVGCYIPGGTAVLPSTALMLGVPAMVAGCNKIVFASPPRADGTITPEIVHVAHKVGAESIVLAGGAQAVAAMAYGTESITKVDKILGPGNQFVTAAKMFVSNDTNAAVGIDMPAGPSEVLVIADKDANPAFVASDLLSQAEHGVDSQVILIAIDLDEEHLQAIEDEVHRQATELPRVQIVRGSIAHSITVQVKTVEEAMELSNKYAPEHLILQIKEAEKAVDLVMNAGSVFIGAWTPESVGDYSAGVNHSLPTYGFGKQYSGVNFASFVKHITSSNLTAEGLKNVGQAVMQLAKVEELEAHRRAVSIRLEHMSKSN

SEQ ID NO: 27899 - protein, 438 aa, Schizosaccharomyces pombe 972h-
MSTLEELDALDQSQQGGSSNNEGLDGIEQEILAAGIDELNSRTRLLENDIKVMKSEFQRLTHEKSTMLEKIKENQEKISNNKMLPYLVGNVVEILDMQPDEVDVQESANQNSEATRVGKSAVIKTSTRQTIFLPLIGLVEPEELHPGDLIGVNKDSYLIIDKLPSEYDSRVKAMEVDEKPTERYSDIGGLSKQIEELFEAIVLPMQQADKFRKLGVKPPKGCLMFGPPGTGKTLLARACAAQSNATFLKLAAPQLVQMFIGDGAKLVRDAFALAKEKSPAIIFIDELDAIGTKRFDSEKAGDREVQRTMLELLNQLDGFSSDDRVKVIAATNRVDTLDPALLRSGRLDRKLEFPLPNEEARVGILRIHSRKMAIDDDINWEELARSTDEYNGAMLKSVCVEAGMIALRQGDTKINHEHFMDGILEVQMRKSKTLQYFA

SEQ ID NO: 27900 - protein, 870 aa, Neurospora crassa
METTLPLPFLVGVSVPPGLNDIKEGLSREEVSCLGCVFFEVKPKTLEKIVRFLKRHNVEFEPYFDVTALESIDDIITLLDAGARKVFVKTEQLADLSAYGSRVAPIVTGSSAALLSSATESGLLLSGFDQTASEAAQFLEEARDKKITPFFIKPVPGADLEQFIQVAAKANAIPILPSTGLTTKKDEAGKLAISTILSSVWKSDRPDGLLPTVVVDEHDTALGLVYSSAESVNEALRTQTGVYQSRKRGLWYKGATSGDTQELVRISLDCDNDALKFVVKQKGRFCHLDQSGCFGQLKGLPKLEQTLISRKQSAPEGSYTARLFSDEKLVRAKIMEEAEELCTAQTPQEIAFEAADLFYFALTRAVAAGVTLADIERSLDAKSWKVKRRTGDAKGKWAEKEGIKPAASAPAATSAPVTKEAAQETTPEKITMRRFDASKVSTEELDAALKRPAQKSSDAIYKIIVPIIEDVRKNGDKAVLSYTHKFEKATSLTSPVLKAPFPKELMQLPEETIAAIDVSFENIRKFHAAQKEEKPLQVETMPGVVCSRFSRPIEAVGCYIPGGTAVLPSTALMLGVPAMVAGCNKIVFASPPRADGTITPEIVHVAHKVGAESIVLAGGAQAVAAMAYGTESITKVDKILGPGNQFVTAAKMFVSNDTNAAVGIDMPAGPSEVLVIADKDANPAFVASDLLSQAEHGVDSQVILIAINLDEEHLQAIEDEVHRQAMELPRVQIVRGSIAHSITVQVKTVEEAMELSNKYAPEHLILQIKEAEKAVDLVMNAGSVFIGAWTPESVGDYSAGVNHSLPTYGFGKQYSGVNLASFVKHITSSNLTAEGLKNVGQAVMQLAKVEELEAHRRAVSIRLEHMSKSN

SEQ ID NO: 27901 - protein, 1132 aa, Zea mays
MSSSRPAHSSSSSSRTRQSSRARILAQTTLDAELNAEYEESGDSFDYSKLVEAQRSTPPEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLLGGSMEALCNTVVKEVFDLTGYDRVMAYKFHEDEHGEVFAEITKPGIEPYIGLHYPATDIPQAARFLFMKNKVRMICDCRARSVKIIEDEALSIDISLCGSTLRAPHSCHLKYMENMNSIASLVMAVVVNENEEDDEPEPEQPPQQQKKKRLWGLIVCHHESPRYVPFPLRYACEFLAQVFAVHVNKEFELEKQIREKNILRMQTMLSDMLFKESSPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKTKSLPWSDYEMDAIHSLQLILRGTLNDASKPAQASGLDNQIGDLKLDGLAELQAVTSEMVRLMETATVPILAVDGNGLVNGWNQKVAELSGLRVDEAIGRHILTLVEDSSVSLVQRMLYLALQAGREEKEVRFELKTHGSKRDDGPVILVVNACASRDLHDHVVGVCFVAQDMTVHKLVMDKFTRVEGDYKAIIHNPNPLIPPIFGADQFGWCSEWNAAMTKLTGWHRDEVVDKMLLGEVFNSSNASCLLKSKDAFVRLCIVINSALAGEEAEKASFGFFDRNEKYVECLLSVNRKVNADGVVTGVFCFIHVPSDDLQHALHVQQASEQTAQRKLKAFSYMRHAINKPLSGMLYSRETLKSTGLNEEQMRQVRVGDNCHRQLSKILADLDQDNITDKSSCLDLDMAEFVLQDVVVSAVSQVLIGCQAKGIRVACNLPERSMKQRVYGDGIRLQQIVSDFLFVSVKFSPAGGSVDISSKLTKNSIGENLHLIDFELRIKHRGAGVPAEILSQMYEEDNKEQSEEGFSLAVSRNLLRLMNGDIRHLREAGMSTFILTAELAAAPSAVGR

SEQ ID NO: 27902 - protein, 281 aa, Ostreococcus tauri
MKGPSMSSLRRRRVIESALLGDRSERDRRRRRRLRRGQRRRRNAWTTARATTKPSVDRRFAINSTPRLHIFDLPGNGLLSLDELSRGGHATGNLSPDDLAYGRAGDAAATPTGVSIRGVLISDPHVNHRLLEIAAMKLTPDNNDAAWRLSSERVKRRTERRSNAFPRSYPTRAPPGLDSPLLFKRLDADALFFTFYFCPTPKKKLLAAAELRASNWRFHKALGTWFARLELPKVINEAERYEQGSVIYFDHNMQVNEADSSTNGWCQRSRSDFTSRYDDFI

SEQ ID NO: 27903 - protein, 320 aa, Streptococcus gordonii
KVGINGFGRIGRLAFRRIQNVEGVEVTRINDLTDPVMLAHLLKYDTTQGRFDGTVEVKEGGFEVNGKFVKVSAERDPENIDWANDGVEIVLEATGFFATKAAAEKHLHAGGAKKVVITAPGGSDVKTVVFNTNHDVLDGTETVISGASCTTNCLAPMAKALQDNFGVVEGLMTTIHAYTGDQMVLDGPHRKGDLRRARAAAANIVPNSTGAAKAIGLVIPELNGKLDGAAQRVPVPTGSVTELVAVLDKNVTVDEVNAAMKAASNESYGYTEDPIVSSDIVGMAYGSLFDATQTKVLDVDGKQLVKVVSWYDNEMSYTAQ

SEQ ID NO: 27904 - protein, 209 aa, Yarrowia lipolytica CLIB122
MVSTRRTRVLILTAILFTVGLLIFAVHGPRYDLAVDPRSSSQKTVKTTDNNIDKEVLEVNEDEGVAHKSEKEKTEKIVKGEEKADLTTSQGEEFNPEKEYQSILKLAPVIVFSKSYCPHSQFVKDLLQKEYAITPDLQIVELDKHPSGPELQAYVKQKTGRGTVPNVIVAGKSLGGGDEMRALHKDGELAETFHEAGPKALTVVRRSPL

SEQ ID NO: 27905 - protein, 451 aa, Geobacter metallireducens GS-15
  misc_feature (45)..(45): Xaa can be any naturally occurring amino acid
  unsure (1)..(451): unsure at all Xaa locations
MAKEKLVVIGGDAAGMSAASQAKRRRPELEIVVFERSPHTSFSAXGIPYYVGRVVDKEEKLVIRSPEKFREKYGIDARALHEVVEIDAAQGKVRVRDLQRGGSAWESYDQLLIATGAVPLCPDLPGSDAVDICGVNTLESGLEIRRRLDKGGMKKGVVVGGGYIGLEMAEALVRHGLEVSLVNRAPQVMGTLDYDMGAMVSQALRDVGVSLYLEETLTAFETKGGKVTGVVTDRRTLPADIVILGLGVRPNTALASAAGIPLGEKGSIRVNERMQTGVAGIWAAGDCAESFHLVSRKPVHIALGTVANRHGRVAGINLGGGYATFPGVVGTAVTKICQVEVARTGLQEEELRELGIEWISAVIKSRTRAGYFPGAGGITVKVLAERGSGRLLGGQIVGMEGSAKRIDTLATALHAGFTVEEMINLDLGYAPPFSPVWDPVVIAAREVAKEL

SEQ ID NO: 27906 - protein, 565 aa, Ehrlichia canis str. Jake
MILYNIFLVKMKVDFINTVFPSSTKEYIPGTIYNNIKVGMRKIHFNDNTESILVYDTGGLHTDQNVEVDINHGITKLRLNWIIDRQDVEYYERQPVLNSEHIFTSQSNKVLRANSTKPVTQIFYARNNIITPEMEYIAIRENSLRQKILSYKPTVMSPEITPEFVRQEVASGRAIIPANINHPESEPMIIGKNFLVKINANIGNSVVSSNIEEEVQKMIHAITYGADTVMDLSTGNNIHDIREWIIRNSPVPIGTVPIYQALNKVNGVVGDLNFNVFKETLIEQAEQGVDYFTIHAGVLKNYISHTDNRLTGIVSRGGAIMAHWCTIHNKENFLYTNFEEICDIMKRYDIAFSLGDGLRPGSIADANDTAQFLELKTLGELTDIAWQHDCQAMIEGPGHVPMHLIKENMEKQIHFCKEAPFYTLGPLTTDIAPGYDHITSAIGAAITGWYGTSMLCYVTPKEHLGLPNIQDVKDGVIAYKIAAHAADLAKGNPSAYIRDYALSYARFNFKWHDQFNLSLDPETARSLHDESLPSEHAKSAHFCSMCGPKFCSMKLTHHLKEHSTG

SEQ ID NO: 27907 - protein, 502 aa, Petunia x hybrida
MEIQLSSLVPFLLFLSSIFLLLRKWKTQELNLPPGPWKLPFIGSLHHLVFAGPLPHHGLTNLAKRYGPLMLLQLGEQPTVFISSPQMAKEVLKTHDLAFATRPKLTFAEIIKYGSTDIAFSPYGEYWRQIRKICVMELLSAKMVNSFSSIREDELSNMISWIRLRPNIPVNLTEKVKWFTSSVVCRSALGKICKDQNKLIILMREILSLAISVNFADFFPRWKFLHDLGGSKTRLLKEHHKIDEILQDIVNEHKQNRVNGKMGNGEFGGEDLIDVLLRVRESGQHQLPITDDNIKAVIVDMFSAGTETSSTTIIWALAEMMKKPSVLAKAQAEVRQAMKGKKGFQLIDLDELKYLKLVIKETLRMHPPIPLLIPRECMEETKINGFNIPLKTRVIVNIWAIGRNPESWEDPESFMPERFENNPIDFTGNHHQFIPFGAGRRMCPGMLFGLTNVAQLLAQLLHHFDWKLPNGQSPQDLDMTESPGVSATRKDDLVFVATPYDS

SEQ ID NO: 27908 - protein, 333 aa, Phaeodactylum tricornutum
MDLSSEMLREIPGTLSQHYKAGNLNYPMIVYTTIVHTVALVGLCTIPQASAETLLWAFVLWPISGFGITVGVHRLWSHRSYEAALPVRFVLMLCNSIANQGSIYHWSRDHRVHHKFSETDADPHNARRGFFFAHMGWLFVKKDPAVIEAGREMDFSDLLEDPVVALQKMVDPWFALYMCYVMPAQVASYFWGENFWTAFLVAGGLRYCFVLHCTWLVNSAAHLYGDHPYDLTSYPAENPFVSWCAVGEGWHNWHHKYPFDYAASEFGVSSQYNPSKLVIDVLASVGLVWGRKRGTAAWAMGRARRDRDIAQGKEMPKQPPRPWEVRTVARKIA

SEQ ID NO: 27909 - protein, 293 aa, Dryopteris caudipinna
  misc_feature (171)..(171): Xaa can be any naturally occurring amino acid
  unsure (1)..(293): unsure at all Xaa locations
VGILPLSLQYGFSVANKFLQGAQSIDNHFKTAPFEKNIPVLLGLLSVWNVSFLNHPARAILPYCQALEKFAPHIQQLSMESNGKGVSIEGVPLSFEAGEIDFGEPGTNGQHSFYQLIHQGRVIPCDFIGIIESQQPVYLKGEVVSNHDELMCNFFAQADALAYGKTPEELXAEGVPEHLVPHKTFSGNRPSLSILLPKLTPYTLGQLLSIYEHRIAVQGFIWGINSFDQWGVELGKSLASHVRKQINASRSQGKSVAGFNYSTSTLLNHYLKVKSNVYTSTHDSFPPAILPPK

SEQ ID NO: 27910 - protein, 249 aa, Arabidopsis lyrata subsp. petraea
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGWEGGEQNVTYAHHQAQSQGLYQPLECNPTLQMGYDNPVCSEQITATTQAQAQQGNGYIPGWML

SEQ ID NO: 27911 - protein, 390 aa, Bifidobacterium longum DJO10A
MSRRAREANPFRAMVFGEQADKMIAQGTSVIKLSLGEPDFGAPPAVRDAMREQYDGRALPYTAAMGLPELRQAIADFYRERHDLDIDPKRICVTAGGSAALLLATALTVDPGDDVIVADPSYPCNRELVRSFEGRVIDVPTSAATRFHLTADLCSQYWTSKTKAVMITSPSNPTGTTIDFNVLDEVCKLAASRGAWRIVDETYLDLADREPDGTEVKSVLACDPDAIVCNSFSKFFGMTGWRLGWAILPDEPTVLEAVDDLATNYYLCAHTPTQHAALACFTPESLAECEARRQELLARRRIVIDGLKRIGLPVEVEPNGAFYAYFNISRTGLDAWTFCERALDEAHVALTPGRDFGAATADTHVRLSYAASREALTEGLERLGTFVESL

SEQ ID NO: 27912 - protein, 456 aa, Ostreococcus tauri
MCVETENNDGIPTVEIAFDGERERAEANVKLSAEKMEPAALAKTFARRYVVIEGVEYDVTDFKHPGGTVIFYALSNTGADATEAFKEFHHRSRKARKALAALPSRPAKTAKVDDAEMLQDFAKWRKELERDGFFKPSPAHVAYRFAELAAMYALGTYLMYARYVVSSVLVYACFFGARCGWVQHEGGHSSLTGNIWWDKRIQAFTAGFGLAGSGDMWNSMHNKHHATPQKVRHDMDLDTTPAVAFFNTAVEDNRPRGFSKYWLRLQAWTFIPVTSGLVLLFWMFFLHPSKALKGGKYEELVWMLAAHVIRTWTIKAVTGFTAMQSYGLFLATSWVSGCYLFAHFSTSHTHLDVVPADEHLSWVRYAVDHTIDIDPSQGWVNWLMGYLNCQVIHHLFPSMPQFRQPEVSRRFVAFAKKWNLNYKVMTYAGAWKATLGNLDNVGKHYYVHGQHSGKTA

SEQ ID NO: 27913 - protein, 223 aa, Pseudomonas putida GB-1
MRLRAVLFDMDGTLLDTAPDFIAICQAMLAERGLPAVDDNLIRGVISGGARAMVAATFAMDPETEGFEALRLEFLERYQRDCAVHSKLFDGMAELLADIEKGNLLWGVVTNKPVRFAEPIMQQLGLAERSALLICPDHVKNSKPDPEPLILACKTLNLDPASVLFVGDDLRDIESGRDAGTRTAAVRYGYIHPEDNPNNWGADVVVDHPLELRKVIDSALCGC

SEQ ID NO: 27914 - protein, 573 aa, Cucurbita pepo
MGNTCVGPSISKNGFFESVSAAMWRSKTPENSVSNHTNGENVREVVASEPESPLPVQNQPPEKVTMPESVAKPEPPMEPKVRPVMKRVGSAGLRGGSVLQTKTGNFKEYYSLGKKLGQGQFGTTYMCVEKATGKEYACKSIAKRKLVNEDDVEDVRREIQIMHHLSGHPNVISIKGAYEDAVAVQVVMELCAGGELFDRIIQRGHYTERKAAELTRTIVGVLEACHALGVMHRDLKPENFLFVSKEEESLLKTIDFGLSMFFKPGEKFNDVVGSPYYVAPEVLRKRYGPEADVWSAGVIVYILLSGVPPFWAESEEGIFEEVLHGDLDFSSDPWPSISDSAKDLVRRMLVRDPRKRLTAYEVLCHPWVQVDGVAPDKPLDSAVLTRLKQFSAMNKLKKMAIKVIAESLSEEEIAGLKEMFKMIDTDNSGQITFEELKAGLKKFGANLKESEIYDLMQAADIDNNGTIDYGEFVAATLHLNKIEKEDHLLAAFSYFDKDGSGFITHDELQQACKEFGIEDLQMEEMMREVDQNNDGSIDYNEFVAMMQKGNVVNTGKKGLQSSFSIGFREALKL

SEQ ID NO: 27915 - protein, 438 aa, Mycobacterium tuberculosis H37Rv
MHFARHGAGIQHPVIVRGDGVTIFDDRGKSYLDALSGLFVVQVGYGRAELAEAAARQAGTLGYFPLWGYATPPAIELAERLARYAPGDLNRVFFTSGGTEAVETAWKVAKQYFKLTGKPGKQKVISRSIAYHGTTQGALAITGLPLFKAPFEPLTPGGFRVPNTNFYRAPLHTDLKEFGRWAADRIAEAIEFEGPDTVAAVFLEPVQNAGGCIPAPPGYFERVREICDRYDVLLVSDEVICAFGRIGSMFACEDLGYVPDMITCAKGLTSGYSPLGAMIASDRLFEPFNDGETMFAHGYTFGGHPVSAAVGLANLDIFEREGLSDHVKRNSPALRATLEKLYDLPIVGDIRGEGYFFGIELVKDQATKQTFTDDERARLLGQVSAALFEAGLYCRTDDRGDPVVQVAPPLISGQPEFDTIETILRSVLTDTGRKYLHL

SEQ ID NO: 27916 - protein, 696 aa, Aspergillus nidulans FGSC A4
MAGSLVNGSSSKHDIVLKTFRLLIADLCQQFGGGHPGGAIGMAAIGVALWRYVMRYAPHTPNFFNRDRFVLSNGHTCLFQYTFLHLTGYKAMTFEQLKSYHSEREDALCPGHPEIEHEGIEVTTGPLGQGVANAVGLAMATKNLAATYNRPGYEVVNNHTWCMIGDACLQEGVALEAISLAGHWKLNNLTIMYDNNQITCDGSVDLTNTEDINAKMRACGWDVINVEDGCYDVEGIVEALSKARASTEKPTFINIRTVIGLDSKVAGQAAAHGAAFGVEDVAAMKRKLGFNPEEHFVIGETVREFFADLPARGEGYVKEWKDLIQRYSEAHPELADEFQRRVRGELPTDWQKLIPSELPDKPTATRVSSGLVFNPIAQYIKSFMVGTADLSPSVNMIWKGKVDFQHPDLRTTCGINGNYSGRYIHYGVREHAMAAISNGLAAFNPNTFIPVTSSFFMFYLYAAPAVRMGALQHLQVIHAATHDSIGMGEDGPTHQPIELASLYRAMPNLLFIRPGDSEETAGAWIAAINAKKSSTIISTSRHALPQLKQTRREGVIKGAYVLEEASNADVTIIGVGAELSFALDVAARLKEEKGATARVVSFPCQRLFEQQSLEYRRSVLQRHKGIPAVVIEPYAPNGWERYADAGISVRRFGHSLPGKAAYKFFGFDIGVMTEKVGHYLQQLKEDEALRGEFVDL

SEQ ID NO: 27917 - protein, 502 aa, Mycobacterium tuberculosis H37Rv
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPDTARWYLLKGRIADARSALRRIQPEADIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSPMLTSTLTANAIVAAFSLTMLRVLGGAGVFAVFGTFAVVAFVVVYRFAPETKGRKLEEIRHFWENGGRWPAERSPAADEP

SEQ ID NO: 27918 - protein, 514 aa, Prochlorococcus marinus str. MIT 9301
MTFVITTPLYYVNDKPHLGSVYTTIICDSIARYKRLAGEDVIFITGVDEHGLKIQRTANEKGIEPKSHCDEISEVFNNNWKDWNISFDKFIRTSSKNHEFVVNEFYERVKASDDIYMGVQKGWYCVGCEEFKDNPENSSTYKCPIHQKNLEWKNEENLFFRLSKYQKEIERIINEPSFIEPIERKNEIINFVSRGLKDFSISRTNVKWGIPVPGYDNHTFYVWFDALLGYVSAISSDATEHSLEKSINGGWPADVHLIGKDILRFHAVYWPAMLISAKMKVPKKVFGHGFLTREGQKMGKSLGNVLDPDLLLTKYGNDPVRWYLIKDISLGNDGDFQDKRFVDIINNDLANTIGNLLNRTSSMSRKWFNNKVPNKEKIFNEKKLENFAKIAVENYIYNFDNYKLDLAANEVLSLAINTNLYLNDNQPWLLIKEKDNLPLVKEIIYNVLESTRIIGLLLIPLLPELSTKINDQLGSIYREEIPWKKQLIWGLLVSNSSLPKPTPIINKLEYEEHL

SEQ ID NO: 27919 - protein, 266 aa, Burkholderia vietnamiensis G4
MTQAHQGTALITGASSGIGAIYAQRLARRGFDLVLVARNRDRLNDFAKRITDDTQRNVEVIAADLGDPRALAEIEAKLRTDASITMLVNNAGVGTHKPLLESDVDAMTRMIDLNVTALTRLTYAAAPGFVARGHGAIINISSIVAIGPELLNGVYGGSKAFTLAFTQSLHHELADKGVQVQAVLPGATATEFWDNGGLPLDNLPKEIVMSASDLVDAALTGFDRHELVTIPSLHAAEEWDAYDAARRVMTPHLSNSTVAARYAVTH

SEQ ID NO: 27920 - protein, 496 aa, Sulfolobus solfataricus P2
MIRRLLEVFFKLAPRVLAYREFRNKILKEIPIDEKEMAEEAKKFVDTLIELGPTFIKFGQILSVRPDIMPETYIKELARLQDEVPPAPFSQVSKIIDEELGNSVKILKELSSASLGQVYLGEYNGKIVAIKVNRPGIKETVNEDIQVVKKLLPLLRFVFDESFIEIIKVFLEEFSRRIFEEMDYTKEAFYLNKIKEELSDYPSLRIPSIIKATKRVLVMEYIKGYKVTSEEAKKIVDNRILAYRVFRLFMYMLLNKDYFHADPHPGNIAVDEQGNLVLYDFGMSGKIDEKTRNLLIRAYVAMIRMDADSLVRVLDELGAIQPFADRRVLAKGLRLFMQAMQGIEVSELELEDFMKLADQVFFKFPLRMPSKLVLPFRMVNVLDGTCREIDKDFDFVKSSITFLEEEGYTTKVVIEQVRELVNGIWNRFRSFLLSYSQQQELINIQSSRKGSAITNYIPQMILVITIIFYAITKDIIITLLMVILAFSISLSGRKNT

SEQ ID NO: 27921 - protein, 542 aa, Triticum aestivum
MSAAQLLRHSRKLRSLRNSVDCERTSLARYFSTGSGSSAVKENGVEKRIGGARFSQYKQPGKELETFKVSLGGANGSSTCRRMLINRVPSAVTGLNGSLSCGRVASARSFSSSADLPPHQEIGMPSLSPTMTEGNIAKWIKKEGDKVSPGEVLCEVETDKATVEMECMEEGYLAKIVQGDGAKEIKVGEVICVTVEEEGDIEKFKDYKPSAADAPAAPSESKATPEPAAPKVEEKVPAKAPEPKAPKAEKASRSGDRIFASPLARKLAEDNNVQLSSVKGTGPDGRILKADIEDYLAKGGKSEAFAASGLDYTDIPNAQIRKVTANRLLASKQTIPHYYLTVDTRVDKLIKLRGELNPLQEASGGKKISINDLVIKAAALALRKVPECNSSWMNDFIRQYHNVNINVAVQTEHGLFVPVVRDADKKGLGTIGEEVKQLAQRARDNSLKPQDYEGGTFTVSNLGGPFGIKQFCAIINPPQSAILAIGSAEKRVIPGSVDGQYEFGSYMSVTMSCDHRVIDGAIGAEFLKAFKGYIENPTTMLL

SEQ ID NO: 27922 - protein, 369 aa, Acholeplasma laidlawii
MAKRDYYDVLGISKSASQDEIKKAYRSLAKKYHPDVSKEKDAETKFKEVQEAYDVLNDSNKKAQYDRFGHAGTGQDPFGGAGGGFGGFGGFDDIISQFFGGGQTRRTRQTSNVGEDLNMRMTIDFMEAVLGTTKNVSVDITQDCGHCHGSGAESSKDVHTCSKCHGQGFINVDQRTMFGTMRSQQVCPQCQGEGQTIDNKCHVCSGAGRVKAKKTVDVKVPAGVDNEMTLRVPGYGNGGRKGAESGDLYITFRVKPHKIFKRRGSDIILDVPITFTQAALGDKIDIPTIYGEVELTIPAGIQSGTELKLKNKGTKDPRTGKTGDQHVIVNIETPKNLSSEEKKLFEQLSKLDSPRKKSGWDKFKSFFTN

SEQ ID NO: 27923 - protein, 483 aa, Nostoc sp. PCC 7120
MQKLNGLLTNDIIEESAWEALEKSILYYKGRPVGTVAAFDASVEALNYDQCFVRDFVSSALIFLIKGKTDIVRNFLEETLKLQPKDRQLDAYKPGRGLIPASFKVVSDNGEEYLEADFGEHAIARVTPVDSCLWWILLLRAYVVASKDFSLAYQPEFQTGIRLIMEICLANRFDMYPTLLVPDGACMIDRRLGIYGHPLELQVLFYAALRAAREMLICQGNQDVVEAIDNRLPLLCAHIRQHYWIDINRLNAIYRFKSEEYGKAAVNLFNIYVDSIPYYELDKWLPKKGGYLAGNVGPSQLDTRFFALGNLMAIISDLATEEQSQAIMTLIEDRWEDLVGDMPMKICYPALENEEYRIVTGCDPKNIPWSYHNAGSWPVLMWMLAAASVKAGKPYIAGKAIEIAQARLLEDEWPEYYDGKKGRLIGKQARKYQTWTIAGFLLAAELMKNPSLLSLISFDKLPSELVSRACEFEIGSVDASISR

SEQ ID NO: 27924 - protein, 379 aa, Colwellia maris
MSKRDYYETLEVSQDASEKEIKKAYKKLAMKYHPDRTQGDKSKEETFKEVKEAYEILNDDQKRAAYDQYGHAAFEQGGHGGGGGGHGGGFGQDFGDIFGDIFGGGGGGGRGRQRQQRGSDLRYNVELSLEDAVKGKSLEIKVPTYVSCEPCDGSGAKKGTSAKTCSTCHGHGQVQMRQGLFAVQQTCPTCSGKGKVIADKCTSCRGQGRVEKTKTLSVKIPAGVDTGDRIRLSGEGEAGEHGAPAGDLYVQVNVRDHDIFVRDENHLYCEVPISFVTASLGGEIEVPTLGGKVKLKVPKETQTGKMFRLRGKGVKSVRSTSTGDLMCKVVIETPVNLSGDQADLLRQLEEKMASSSKKHSPKETGFFDGVKKFFDDLKS

SEQ ID NO: 27925 - protein, 308 aa, Glycine max
QRWLTTTGVGEVWQSDSSDMNRRRGSRNFENVFSNSSPDYLPFEFRALEVALEAACTFLDSQAAELEIEAYPLLDELTSKISTLNLERVRRLKSRLVALTRRVQKVRDEIEQLMDDDGDMAEMYLTEKKRRMELSFYGDQSMVGYKSVDGASISAPVSPVSSPLDSRKLEKCFSIARSRHESMRSSESTTESIEELEMLLEAYFVVIDSTLNKLTSLKEYIDDTEDFINIQLDNVRNQLIQFELLLTTATFVVAIFGVVAGIFGMNFEIQLFDVPSAFQWVLIITGICGVFIFSAFVWFFKYRRLMPL

SEQ ID NO: 27926 - protein, 322 aa, Rhodococcus sp. RHA1
MNDDVPTWWNLLDGAAQAAAGMLAHALPKPIRELGPEQARALLNTTPTAEPITPLDRVEQLTIPTRAGSIRARLYGATRAAPDGDAPALVYLHGGGFVLGTLDGADELCRAIAAGSGWTVVSLDYRLAPENPYPAALEDCVDAYAWLSRTASEFGIDPGYIAVGGDSAGGNLAAALCLYRRDEHSTLPVTQVLAYPAVDETFTASSWSEFADAPMLSAADARWFWEQYVGEHHSGGDHLAAPMRAESLRGLPPALILTAEVDPIRDDAEAYAARLRRDGVPVSLTRYAGVFHGFVTEIGAFAQAKQAIDEVCLHLREVRDGG

SEQ ID NO: 27927 - protein, 604 aa, Ostreococcus tauri
MTDAKRAKTTDGRPSATEGVDAVVVLDYGSQYTQLIARRVRELGAYSVLLPGDADMARIEALKPKAIVLSGGPNSVHVEGAPTVPDGFFERVAETSTPVLGVCYGMQLLVQRLGGVVEAAVGKGEYGRMPVVYQSDDSLLYGKGSKAGDSEQVWMSHGDEATKLPSGFVCVGKSEAGAVVAIEDADRKLFGLQYHPEVTHSEKGTEMLRRFLFDIAGVKAEWSMQNVLDEQIAIVNEKVGKDAHVICALSGGVDSAVAATLVHKAIGDRLHCVFVDNGLLRYKEQERVMEMFKDHLHLPVDCVDHSEQMLKALAGVSDPEKKRKIIGAEFIECFKNFKSEIEKRTGVRPTFLVQGTLYPDVIESCPPPGSDQKHSHTIKSHHNVGGLPKELGFELVEPLRMLFKDEVRKLGALMDVPRTFLARHPFPGPGLGVRIVGDVTANNALDILRRADEIYINTIREFGLYDEIWQAFAYFLPVRTVGVQGDQRSHSFMIGLRAVCSSDGMTADWYPFPTEFLKTVSSRITNQVKEVNRVLYDINSKPPATIENFAQTAPSRHSASRARPGGAEGHYLSVSREIRPFKFEFETRAHEHAIHVNAGKVFVV

SEQ ID NO: 27928 - protein, 442 aa, Zea mays
  misc_feature (229)..(229): Xaa can be any naturally occurring amino acid
  unsure (1)..(442): unsure at all Xaa locations
MGGSGKWVKSLIGLKKQPEKEDCKDKLQLPSVHGGGLRGKGRRWKLWRTSSGDQGSMWRGSRGGSQRSAASEASDDASSVAAVPADPFTAAVATVARAPARDFMAVRQEWAAIRVQTAFRGFLARRALRALKGLVRLQAIVRGRQVRKQAAVTLRCMQALVRVQARIRARRVRMSTEGQAVQKLLEARRTQMDILREAEEGWCDSQGTLEQVRVKLQKRQEGAIKRERXAIAYAYSQQADGAAKCNPPKLTSNGLVNHSGMLLKHQNLDKGNGNWSWLERWMAARPWENRLMEEHNSSSPDFRSSKNCEDSFGVLGDFSEPNSVKVRKNNVSKRVCAKPPGPTHAHGHHQRLKAQSISSLSTELHNDESSASSSSCFASTPISFTLVASEKTEDSVRTRPNYMSMTESIKAKQKACSAQRTVALKQCDDRKAMSAELKVAQV

SEQ ID NO: 27929 - protein, 486 aa, Gibberella zeae PH-1
MNGAKRRKVAQDTPRNTKPVAQEKPARAEPKPSSDEESEEESATLEEPSAEETAVDAPKKTFKDLGVNDALCEACEKLNYKYPTPIQEKSIPVALQGRDIIGLAETGSGKTAAFALPVLQALLDKPQPLFGLVLAPTRELATQIGQAFEALGSLISLRCAVIVGGLDMVPQAIALGKKPHIVVATPGRLVDHLEKTKGFSLRTLKYLIMDEADRLLDMDFGPSIDKILKFVPRERRTYLFSATISSKIESLQRASLRDPVKVSISSNKYQTVSTLLQNYLFIPHPQKDVHLIYLINEHAGQSTIVFTRTVWETQRVSILLRTLGFGAIPLHGQLSQSSRLGALNKFRSGTRDILVATDVAARGLDIPSVDVVLNYDLPQDSKTYIHRVGRTARAGKSGVAISLVTQYDLEIYLRIEAALGKKLAEYPTEKEEVMAFQSRVEEAQRIARIEMKSFTEERGKKGSTLKGGRGKKGGKRGRDDMDREEG

SEQ ID NO: 27930 - protein, 371 aa, Campylobacter upsaliensis RM3195
MEISYYEILEITQSADKESIKKAYRKLALKYHPDRNQGDKEAEDKFKLINEAYEVLSDDEKRAIYDRYGKEALKGRAGGSAGFGDFEDIRDIFTSFFGEGFGGRKSRQKNNEDKFNADFVVGLNLSFKEAVFGCTKEIDFTYKNSCKTCNGSGAKDGKMQICPKCQGRGQIVMKQSFLSFAQTCPDCSGSGSCASDKCPQCKGLGYEELKDKVELKVPEGVDSGMNLRVSEKGNITKNGIRGDLFVKIHAEEDETFIRDDEDIYIEFPVFFTQAILGQSVKVPTIRGEATLNLPKGAKDGQRFVLENEGVKNVRSSHIGRQIVQIAIKFPNSLNEEQTKLLEQLSESFGIKDGMHHEQKGLFDKIATWFKG

SEQ ID NO: 27931 - protein, 116 aa, Arabidopsis thaliana
MLLYPLYASVIAMESTTKVDDEQWLAYWIIYSFLSLTELILQSLIEWIPIWYTVKLVFVAWLVLPQFQGAAFIYNRVVREQFKKHGVLRSTHSKPTKPNILHSIFPHRVNFLSFWF

SEQ ID NO: 27932 - protein, 363 aa, Aspergillus nidulans FGSC A4
MPYLANPSLQVTADHQIKLVEAPVHEPGKGEVLVHIKATGVCGSDIHFWKTGRIGELIFHGDCIIGHEAAGVVLKCGEGVTDLQPGDRVAIEPGVPCENCFLCDEGRYNLCEDVAFAGVYPYAGTIQRYKVHPAKWLHKLPPSLSYLDGALLEPLSVVMRGIQVAQLELGRGVVICGAGPIGLIAAAAARASGAHPVVITDIDPSRLSFARRFLPTIQTYQNNPTLDAQGNAKAIRALFGDNEYNAPDRVLECTGVESSICTAAYTARRGGLVVVVGVGKEIINNVPFMHLSLAEIDLKFINRYRDTWPRAISCMAAGIITDLKPLISHTFPLERADEALELCADMGRPSIKVTIVDEGDATV

SEQ ID NO: 27933 - protein, 112 aa, Zea mays
  misc_feature (44)..(44): Xaa can be any naturally occurring amino acid
  misc_feature (59)..(59): Xaa can be any naturally occurring amino acid
  misc_feature (107)..(107): Xaa can be any naturally occurring amino acid
  unsure (1)..(112): unsure at all Xaa locations
YDEREQLGSDIPKNRNGVTVRNISTLILIGMAPGLKLNLEDCFXKMTGLTMQVGTSVLXNSFRGDMRLRPHVSEEESCIACSISPYICPVYATTIEAEERRYVDLRXTRYDI

SEQ ID NO: 27934 - protein, 358 aa, Nicotiana tabacum
MATFTLLSLFILLSLLSVAHSGSIGINYGRIANNLPPPAQVVQLLKTQGVNRVKLYDTDSNVLTALSGSNISVTVALPNEQLADAAGKQSFTDSWVQSNILTYYPKTQIESIAVGNEVFVDPKNTTKFLVPAMKNMYASLVKYGVAQSIKVSSPVALSALGNSYPSSAGSFKPDLVEPVIKPMLSFLKQTGSYLMVNIYPFFAYAANTDTISLDYALFKDNKGVTDPNNGLVYKSLFEAQIDAVYAAMKAVGFGDVAMAVSETGWPSKGDENEAGAGADNAAAYNGNLVRRVLTGSGTPLKPNEPLDVFLFALFNENQKPGPTSERNYGLFYPNEQKVYDITLTKEGLENGPTMNNGR

SEQ ID NO: 27935 - protein, 325 aa, Shewanella sp. ANA-3
MVDQSQLRQWGCKVIDIEKSALDNLYQYVDSVEFAQACELILNCTGKVIVMGMGKSGHIGNKISATLASTGTPAFFVHPGEASHGDLGVLSDNDVILAISNSGESSEILALMPVIQRKAIPVIAMTGKPESTMARLSKIHLCIEVPEEACPLGLAPTSSTTATLVMGDAIAIALLQAKGFTREDFAMSHPGGALGRKLLLKVSNVMHSGDDLPLVKHDICITDALYEISKKGLGMTAVIDEQNKLVGIFTDGDLRRVIDAQVNLRTTPIADVMTRNCVTITENVLAAQALQVMDSKNINGLIVIDKEHHPVGALNMLDMVKAGVI

SEQ ID NO: 27936 - protein, 595 aa, Pseudomonas putida GB-1
MCGLAGELRFTPIDQAPRPADLAAVERITHHLAPRGPDAWGFHSQGPIALGHRRLKIMDLSDGSAQPMVDNTLGLSLAFNGAIYNFPELRQELQDLGYSFWSDGDTEVLLKGYHAWGAALLPKLNGMFALAIWERDNQRLFLARDRLGVKPLYLSRNGERLRFASTLPALLKGGDIDPMLDPVALNHYLNFHAVVPAPRTLLANVQKLEPGTWMRIDRHGEVERQTWWQLQYGANPDERDLDLEGWTTRVLDATRDAVAIRQRAAVDVGVLLSGGVDSSLLVGLLREVGVDDLSTFSIGFEDAGGERGDEFQYSDLIAKHYGTRHHQLRIAEHEIIDQLPAAFRAMSEPMVSHDCIAFYLLSREVAKHCKGVQSGQGADELFAGYHWYPQVAGAEDAFAAYRDAFFDRSHAEYRDTVQAPWLLETDAAGDFVREHFARPGARDAVDKALRLDSTVMLVDDPVKRVDNMTMAWGLEARTPFLDYRLVELSARIPARFKLPDGGKQVLKQAARRVIPHEVIDRKKGYFPVPGLKHLEGATLGWVRELLTDPSQDRGLFNPAMLDRLLSNPHGQLTPLRGSKLWQLAALNLWLSEQGI

SEQ ID NO: 27937 - protein, 655 aa, Magnaporthe grisea 70-15
MDARPQRPSRAGALQPSGNENIAPVKQVLHQRHKSAGNLKTIYNPATAFPAGGLNVAPKRAVFGEMNTNAKSAAQDLPSKKASMAPVVSHVGKENSGKPAALQKPAQRSSKSYAMLHQQPSAADTHGAALRKATADVLTKPQVTKKTTFVYQDTTAAQLLPEPNQHMIADHPVILPKPDIIKNPRHYKSQPQLKPNQPVLRRTLSRQFAEVASLISSALAEEAQDPPYEDALEEIADINGSRGVPINILGDYMEEPNIEIISHDAIDDYPLEEHVPAPPTAFESEDGWEEEDGDMDDEQGYTTAHSYRSHGENTTGGLTELLAPKATARVQQELEQAKAIVEESRTIEEIEEEQWDVSMVAEYGEEIFEYMRELETRMTPDPHYMDIQTEIQWSMRSVLIDWVVQVHHRFTLLPETLFLCVNYIDRFLSQKVVSVAKLQLVGATAIFIAAKYEEINCPSVNEIIFMVDNGFSADEILKAERFMLSMLQFELGWPGPMSFLRRISKADDYDLETRTLAKYFLEVTIMDERFVGCPPSFLAAGAHCLSRMILEKGDWAHTYWSGYTWSQLRPLVALLFDCCQYPEKHHQAVFEKYCDRRYKGASTFVQRAIARGWTPPFPIQQPFVLDANCFAETIASCRNFSSMEVGRMMATATQA

SEQ ID NO: 27938 - protein, 138 aa, Arabidopsis thaliana
MINQISIFLPSCNNKIQGADYSLPAHFSPIHFPMGNAATGFFIMFALIAGVAGAASVISGISHLQSWTTTSLPAAVSAATIAWSLTLLAMGFGCKEIELGMRNARLVSKPLMRTMEAFLIILSATQLLYIAAIYGVRK

SEQ ID NO: 27939 - protein, 158 aa, Triticum aestivum
  misc_feature (35)..(35): Xaa can be any naturally occurring amino acid
  unsure (1)..(158): unsure at all Xaa locations
RSRKPLSRPTHAPHRARTRTAHRRPRRSGEERRRXVMEEAAAAPGVQLGTSKPQIATQAEMAEARLPIPYRDQCAHLLIPLNKCRVAEFYLPWKCEPERHSYEKCQYELVMERMLQMQKIREAQAGSVRFRRGWWLELEGRCARKDHECCSCMNETSV

SEQ ID NO: 27940 - protein, 185 aa, Brassica napus
MATKEDVQDPRIPKIASSIRVIPDFPKPGIMFQDITTLLLDTEAFKDTVDIFVERYKGKGISVVAGVEARGFIFGPPIALAIGAKFVPMRKPKKLPGKVISEEYSLEYGTDKIEMHVGAVEPGERAIIIDDLIATGGTLAAAIRLLERVGVTIAECACVIELPVLKGREKLGETPLFILVTSDAA

SEQ ID NO: 27941 - protein, 379 aa, Lactococcus lactis subsp. cremoris
MNNTEYYERLGVDKNASQDEIKKAYRKMSKKYHPDLNKEEGAEDKYKEVQEAYETLSDEQKRAAYDQYGEAGRNGGFGGGGFGGASGFSGFGGRSGGFGGFEDIFSSFFGGGGAQVNPNAPRQGDDLQYRINLKFEEAIFGVEKQVKYNREELCHTCGGSGAKAGTHPETCHKCGGRGQINVVRDTPLGRMQTQTTCDVCHGTGKEIKEKSTTCHGSGHEKVAHTVKVTVPAGVETGQKMRLQGQGDAGVNGGPYGDLYVVFQVEASDKFERDGAEIYYKMPMDFVQAALGDEVEVPTVHGNVKLKIPAGTQTGANFRLKGKGAPKLRGSGNGDQYVIINIVTPKNMNQAQKEALQAFAKASGIEVSGSGQKGFFDKFK

SEQ ID NO: 27942 - protein, 703 aa, Oryza sativa
  misc_feature (614)..(614): Xaa can be any naturally occurring amino acid
  unsure (1)..(703): unsure at all Xaa locations
MATTVATAMRRRRNLTPCDSRLATAVPLLVAFLLLLHAPPLAEAQPLPWQMCDTAGGNYTEGSTYQANVRALASALPVNASSSRALFAKGAAGAAPDVVYAIALCRGDTNASSCAACVATAFQDAQQLCAFNRRATMFDDPCILRYSDQDILANATDGQGNFIAWNYNNVSAARAAAFDAASGRLVNATAGYAAADPVRRFGTGEVGFDDATYPRIFSLAQCTPDLSEADCRSCLGRIIRWVPQYFAGKPGGRVFGVRCNFRFESYSFFSGRPLLQLPGPPPAPAPSPANMAPPSPPGTMGGRTRHRTGRVLAITLPIAGAILALIVLTCFCFWRRRTPARKASPVPYSTNPDDIQSIDSLLLDLSTLRAATDNFAERNKLGEGGFGIVYKGVLPEGREIAVKRLSQSSRQGIEELKTELVLVAKLRHKNLVSLVGVCLEEGEKLLVYEYLPNKSLDTILFDYEKSKDLDWGKRLNIVSGVARGLQYLHEDSQLRVVHRDLKASNVLLDFDHNPKISDFGLAKLFEWDQTQDVTSHIAGTYGYMAPEYAMRGQYSVKSDAFSFGVLIIEIVTGRRNSSFSNSEQSIDLLSLVWEHWTTGTIEELLDPAIGSRAXNVLLKLINIGLLCVQDNPADRPAMSAVNVMLSSDTVSLQAPSRPTFSIQEMDGAADTDLYSSALRSTGDSKTRAVASPNEVSLTELEPR

SEQ ID NO: 27943 - protein, 163 aa, Glycine max
LDLTQPKIKGYNLFTLIDHFHSRGLYRSIFLSIMGCCRSLQRFSPEVMIQDPNIGNANSLLPPVVLFHGTGDYSIPSDASKTFAEALKRVGVTAESILYEGKTHTDVFLQDPMRGGKDDMFEDLVAYIHSGDADARARDATAPPRRRLVPEFMLKLAHSVSPF

SEQ ID NO: 27944 - protein, 267 aa, Synechococcus sp. WH 8102
MVLMQTPRPINDPSTGLVGLVAILLSVLLLLGQSLFIVPAGQVAVVTTLGKVSGGSRLPGLNFKIPLVQAVSPFDVRTQVRPEEFATLTKDLQVIEATATVKYAVRPNEAGRIYRTIASADREIYPRIIQPSLLKALKSVFSQYELVTIATEWNDISSLVERTVAEELDKFDYVEVRGLDLTGLQIAEEYRAAIEQKQIAEQQLLRAQTEVKIAEQEAIRYDTLNRSLDDQVLFKLFLDKWDGRTEVVPALPGTPGGTPPVIVGRKN

SEQ ID NO: 27945 - protein, 502 aa, Arabidopsis thaliana
MTVLWFVSLILLISILLVAVKHSKRRWVRQPPSPPGLPIIGNLHQLGELPHQSLCKLSKKYGPVMLLKLGRVPTVIVSTPETAKQVLKDYDLHCCSRPSLEGTRKLSYNYLDIAFSRFDDYWKELRKLCVEELFCNKRINSIQPIKEAEMEKLIDSIAESASQKTLVNLSDTFLSLNVNVICKAVFGVNFQGTVLNNDKFQDLVHEALEMLGSFSASDFFPYVGWIVDWFTGLHARRERSVRDLDAFYEQMIDLHLQKNREESEDDFVDLLLRLEKEEAVLGYGKLTRNHIKAILMNILLGGINTSAITMTWAMAELIRNPRVMKKVQSEIRAQIGKNNKTRIISLDEINHLSYLNMVIKETCRLHPVAPLLVPREVISEFKINGYTIQPKTRLHVNVWAIGRDPEIWKDPEEFLPERFMDCDIDVKGQDYELLPFGSGRRICPAVYMGITTVEFGLANLLYHFDWKLPEGVAVEDIYMDEASGLTSHKKHDLLLVPVKSLV

SEQ ID NO: 27946 - protein, 599 aa, Burkholderia thailandensis E264
MLRRASSATRRGRRRNRDRHGSPDCQAAACRGGAIARLRIRCSASCAAFVIPLFFSPSAAMHDKILILDFGSQVTQLIARRVREAHVYCEIHPNDVSDDFVREFAPKGVILSGSHASTYEDHQLRAPQAVWDLGVPVLGICYGMQTMAVQLGGKVEWSDHREFGYAEVRAHGHTRLLDGIQDFATPEGHGMLKVWMSHGDKVAAMPPGFALMASTPSCPIAGMADEARGYYAVQFHPEVTHTVQGRKLLERFVLDIAGAKPDWIMRDHIEEAVARIREQVGDEEVILGLSGGVDSSVAAALIHRAIGDQLTCVFVDHGLLRLNEGKMVLDMFEGRLHAKVVHVDASEQFLGHLAGVADPEHKRKIIGREFVEVFQAEAKKLTNAKWLAQGTIYPDVIESGGAKTKKATTIKSHHNVGGLPETLGLKLLEPLRDLFKDEVRELGVALGLPEEMVYRHPFPGPGLGVRILGEVKRDYADLLRRADAIFIEELRGTLATEQDAAAGLCEPSQVGKSWYDLTSQAFAVFLPVKSVGVMGDGRTYDYVTALRAVQTTDFMTAHWAHLPYALLGRASNRIINEVRGINRVVYDVSGKPPATIEWE

SEQ ID NO: 27947 - protein, 199 aa, Candidatus Kuenenia stuttgartiensis
MTEAKQAGSILKKEGYVFDIAFTSVLKRAIKTLWYILDEMDLTWIPVQKTWRLNERHYGALQGLNKAEVAKKYGEEQVFLWRRSYDTPPPPLTLTDNRYPGNDVRYRSLSKEEIPFTESLRDTIFRFLPYWDDAIAPAIREKKRVIVVAHGNSLRALVKYLDDIPDDKIAELSIPTGIPLVYELDEGLKPTSKYYLRGD

SEQ ID NO: 27948 - protein, 248 aa, Brassica napus
  misc_feature (175)..(175): Xaa can be any naturally occurring amino acid
  misc_feature (225)..(225): Xaa can be any naturally occurring amino acid
  unsure (1)..(248): unsure at all Xaa locations
KKTIFDGWFKKTKKKKKTILDLPEDLVEDEIISRLPISSLRSVRSTCKKWNTLCKNRILFGKAAKKQFLMMDSRRICLMNLDLSKDNGDPSIKQVSVLDQKFQIPMVFQSDGLLLCVLKDYSRLVVWNPYLGQMRWIEPRNSFHSSDRFAPGHDSNFNYKILRISSEIHPVTERXFLGFELYDFTSSSWKVLDDVTPKRRQIRSGQQGESLKGNAYFLTSVRGSXAGLDFTTERFGPPRPRPPFILTM

SEQ ID NO: 27949 - protein, 381 aa, Alkaliphilus metalliredigenes QYMF
MFNLGSESAFEVLEKAKKLEAEGKNIIHFEIGEPDFDTPRNIIEAGKTALDEGYTHYTAAQGYLPLREAVTQYALEYKNIKTNPEEVVIVPGGKPIMFYTMTALINPGDEVIYPSPGFPIYESLIRFYGGIPVPLAIREENDFRLDVEELKSKLTTKTKLLLINSPANPTGGVLSEEDIDEIANVLIGKNIFVLSDEIYDRMIYDGSTKSIASIPEMKEWTIVLDGFSKTYAMTGWRLGYGIMNKTLAQKVTDLMINTNSCTAAFAQVAGIEALTGPQHAVDEMKSEFFNRREIIVDGLNGIKGFKCIKSPGAFYAFPNIKDTGMRSSELSDYLMNHAGVAVLSGSSFGAFGEGYLRFSYATSTENIKIALKRIDEAMKKL

SEQ ID NO: 27950 - protein, 376 aa, Aspergillus nidulans FGSC A4
MNFSAWGIKAVQTRLFAALPAFLCLGKQKGPRHLPFPQHHPPFSYPRHGTHSTSLSSCRPLWPSKLLDGPEPVNPPEPPNRLQIDASPSPHPILPRELPEPPTLHNQRRTPHRPFQIGQEQGIIGFAIGAAAEGMKPVAEIQFADYVFPAFDQIVNEAAKFRYREGATGGNAGHGALYHSQSPEALFAHIPGLQVVIPRSPSQAKGLLLASIFESKNPVVFMEPKVLYRAAVEHVPSEYYTIPLNKAEVIKPGNDVTIISYGQPLYLCSAAIAAAEKNLGASVELIDLRTIYPWDRQTVLDSVNKTGRAIVVHESMVNFGVGAEVAATIQTGAFLRLEAPVQRVAGWSTHTGLTYEKLILPDVTRIYDAIKRTLEY

SEQ ID NO: 27951 - protein, 202 aa, Petunia x hybrida
MSNEYDYLFKLLLIGDSSVGKSCLLLRFADDSYVDSYISTIGVDFKIRTVELDGKTIKLQIWDTAGQERFRTITSSYYRGAHGIIIVYDVTEMESFNNVKQWLSEIDRYANESVCKLLVGNKCDLVENKVVDTQTGKALADELGIPFLETSAKDSINVEQAFLTMAGEIKKKMGNQPAGAKKTGSTVQIKGQPIEQKSNCCG

SEQ ID NO: 27952 - protein, 256 aa, Nicotiana tabacum
MLREKVEQKTHKHVELVSPVPKKDGKGKDGGNGGGSGAEEKKKQNKENKDPKENKGGGEDNKKSKVKEPPITTAVLKVHLHCQGCIQKIYKIVTKFKGYKEMKIDKQKDLVTVTGSMDVKELAETLKKHLKKEVEIVPAKKEAGEKKEKGEKGGDNGGGGGGEKGKGGGKGKGGSGEGKGKGEEGGGIGGGEMIIGNVGNGMQMMQQMQQPVQFGYPYPYMYGPVYPADQFQNPYPVSVHAPQLFSDENPNACSVM

SEQ ID NO: 27953 - protein, 208 aa, Oryza sativa
MMVMAMMRRVVMVVAVLCAVATMAMAQEASNFFSTYHYYRPAENNWDLGAPAVSAYCATWDADKPLEWRQKYGWTAFCGPVGPTGQDACGKCLSFYDIIYLVSPSYITYTDFNYTSFLKRYLLWSNKKYFKIPVSHGTKIQRSETIWYHEVTNTATGDQITARIVDQCANGGLDLDWDTVFSKIDSDGQGYQNGHLIVDYQFVDCGDN

SEQ ID NO: 27954 - protein, 331 aa, Rhizobium tropici
SAFRKLAMQFHPDKNPDDSNAERKFKEINEAYETLKDPQKRAAYDRYGHAAFEHGGMGGGGGFGAGFGGGGFSDIFEDIFGEMMGGGRARGRSSGGRERGADLRYNMEISLEEAFSGKTAQIRVPTSITCDVCSGSGAKPGTQPKTCGTCQGSGRVRAAQGFFSVERTCPTCHGRGQIIPDPCTKCHGQGRVTEERSLSVNIPAGIEDGTRIRLQGEGEAGLRGGPSGDLYIFLSVKPHEFFQRDGADLYCAVPISMTTAALGGTFDVATLDGTKSRVSVPEGTQVGKQFRLKGKGMPVLRSSQVGDLYIQIQIETPQKLTKRQRELLQEF

SEQ ID NO: 27955 - protein, 92 aa, Zea mays
TERDYLRKIIVQGRSSKSTKVGDIMTEENKLITVNPDTKVLQAMQLMTENRVRHIPVIDGTGMLGMVSIGDVVRAVVAEHREELNRLNDYIQ

SEQ ID NO: 27956 - protein, 377 aa, Mycoplasma pulmonis
MNKKEDYYKILGIDKSANEKEIKKAYRKLAMEHHPDRSSSKESEAKMREINEAYEVLSNPEKKAIYDKYGHEAANNPGFNGFNAGSAGFGNFGGFSNFGGFDSIFEEFFGGSRSHSKQNSNYPYPGESYSTQVKISFLDSVHGRVISQKLDKYKDCESCNGTGARSKSDIKTCSTCNGRGSVEKLVNSLFGKIKQSVTCSTCNGLGQEITHKCPSCKGAKKIKESISQKISIPAGVISGQEVLLRGFGGPGFNGGPNGDLYIRVYVTEHPYYQRINDDIYVDFPISIVNLILEKPVVVPTPYGDEKIKIKSTFKNDQIITFKGKGFKRKNRVGDLKIRLKFEIPNFSSKVKKNLESLLSETNDSINEDFVKKVNSIK

SEQ ID NO: 27957 - protein, 272 aa, Ralstonia metallidurans CH34
MLRSCVMSSLPLIEPDTALFLDFDGTLADLAPRPELVQVEPELVGTLRALHTCLDGALAIISGRPVAELDGFLQPLRLPAAGVHGAELRHDGEALFMPPAPGITALMPRLEAFVARHPGLRIERKSVAVAIHYRQAPELEAQVRAMVADTLHDVDGLEGLPGKMVVEIKPAGVDKGGAIAAFMRMAPFEGRKPLFAGDDVTDEAGFVVARELGGVGVLVGERATAATVSVTGPAALRCWLHRSAHALLALRAQRGGKPQSVSSTSSETEDSL

SEQ ID NO: 27958 - protein, 368 aa, Peanut witches'-broom phytoplasma
MKQKKDYYEVLELSRDAKLDDIKKAYRRLSKKYHPDVCKEANADAKFKEVQEAFDVLSNTNKRAQYDQMGHNFNNQGFNSDFQGFQSANFEEFEDLFSSFFGRRKSNRHQEDIKGEDHHIKLTISFMESVLGTQKTVTFNVKENCEKCDGTGAKTKNDIRICNVCKGNGYISYTQQGWFVSVFGKQICPECGGNKKIYFRPECKFCKGVGMVKSEHKVTLNIPAGVESGMRLKSPNQGHQGPSGAPNGDLYVDINVQPHKTFQRKGNDIFSSILINFYQAALGTIINVDTIHGNVQLKIPAGTQTDTKFRLKNKGVPYVNSPFSIGDHYVIVKIYTPQNLSNTQKKLFEQLEELEELNRKSKTNSSWF

SEQ ID NO: 27959 - protein, 552 aa, Rhodococcus sp. RHA1
MRPAFGHETNSPLLQHFEGEAPVSFKSPFPDVEIPNLSVYDFLFGRVDPADGDRPALIDGASGAVTTYRSLVAQINGVAGALAARGLAVGEVVGLHSPNVPAFASVFHGILRAGGVATTINALYTAEDIAKQLTDSKAKFLFTVSPLLPQAKDAAAKVGIPVANVIVLDGADGHPSLTDLLAERAPAPEVSFDPATQLAVLPYSSGTTGRPKGVMLTHRNLVANVCQINPRMGIGADDTLLAVLPFFHIYGMTVLLNAALYNRASLVTMPKFDLVEFLSIVSGQKCTYVFIAPPVAVALAKHPLVDDYDLSSVHSIFSGAAPLDQELGKAVANRLGCRVRQGYGMSEMSPVSHAIPFDRDDIALDSVGPSIANMECKLVDPATGEEVAYPADGVSAPGELWCKGPNIMAGYLGNDEATAETLDADGYLHTGDIATVDSEGVVTIVDRMKELIKYKGYQVPPAELEALLLTHPQIADAAVIGVLDDEGEEVPKAFVVRQPGAELDEAAVIGFVAERVSPHKKVRKVEFIDLVPKSAAGKILRKDLRAAETAGR

SEQ ID NO: 27960 - protein, 380 aa, Geobacillus thermoglucosidasius
MAKRDYYEILGVSKNATKEEIKKAYRKLSKKYHPDINKEPDAAEKFKEIKEAYEVLSDDQKRAHYDQFGHADPNQGFGGFRSDDFDFGGFSGFSGFDDIFSTFFGGGRRRDPNAPRAGADLQYTMTLTFEEAVFGKETDIEIPREETCNTCHGTGAKPGTKKETCSYCHGTGQISTEQSTPFGRIVNRRTCPYCGGTGQYIKERCTTCGGTGRVKRRKKIHVKIPAGIDDGQQLRVAGQGEPGINGGPPGDLYIVFHVEPHEFFERDGDDIYCEIPLTFAQAALGDEIEVPTLHGKVRLKIPAGTQTGTKFRLKGKGVPNVRGYGYGDQHVIVRVVTPTKLTEKQKQLLREFDQLGGSSMHQGPHGRFFEKVKKAFKGES

SEQ ID NO: 27961 - protein, 335 aa, Xylella fastidiosa 9a5c
MTQTITVIRGDGIGPEIMDATLLVLNTLQANLNYEFADAGLNALEKHGDLLPEATLNSISKNKVALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNACMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMEFAKAIASRL

SEQ ID NO: 27962 - protein, 219 aa, Photobacterium profundum SS9
MTQDEMKKAAGWAALEYVTKGSIVGVGTGSTVNHFIDALETRKEEIKGAVSSSVASTERLEKLGIPVFEANEVAGLDIYVDGADEINAEYDMIKGGGAALTREKIVAAISDKFICIVDDTKQVDVLGQFPLPVEVIPMARSFIGRELVKLGGDPEYREGVVTDNGNIIIDVHNMAITDAKDMEKKINALPGVVTVGLFAARGADVLLVGAPEGVRKFEK

SEQ ID NO: 27963 - protein, 303 aa, Synechococcus sp. WH 8102
MTRCDVLVVGGTHGNEINGAWLVDQWRDQHDLLDAAGLSLALEIGNPEARTANRRYVDRDLNRCFTADLLNQGGQEQELQRARQLLAWHGPDGATPCRVALDLHSTTAAMGSCLVVYGRRPADLALAARVQGALGLPIYLHEADAAQTGFLVEQWPCGLVIEVGPVPQGVLDALVVRQTRIALETCCQELAAARAGTGRDPHNLVVHRHLGSVDLPRDQRDCAAAMVHPQLQGQDWRPLMDGAAMFELPRGGTVPLQADEGETWPLFINEAAYAEKRIAFSLTRREVWPIDPSWGQALEQLMG

SEQ ID NO: 27964 - protein, 463 aa, Glycine max
MVGGGGNRPEAERWLYTANKLLSARDLHGARSFAIRARESDPTYEASEHLLTVIDTLLAGESRINDHHRDWYGILQILRYTTNMDHIAAQYRRLALLLDPHRNMFAFASHAFSLVNDAWSVLSIPAKKAMYDSELRLLTAPAPQHYSLPPQPQPTPRRNPRSRDNSAKLNPNPTPNRAESTRTVETDTGTSFWTSCPYCYVLYEYPKVYEECTLRCQSCRRGFHAVVIRSPPPLSGKDGSYCSWGFFPLGFSGNSKDVNGHASNWNPFSPLFPCPLKGSSYRRPQRNWAYYDDEAAAAFIELSDPSDDDSGDGDWRGGKNRGRKRTRGKKNSGDGRRETVKRPRRGAPVGNENLGSGDAATGASADANVASAVPAGARGESSKKAALGGSRRRGAGNLGKLDLNVEFSNEVEEPSRGVRDREGNAAGHAEDNIEGIGFFEGLDEFLSSLPILNVVADDKVKGH

SEQ ID NO: 27965 - protein, 587 aa, Zea mays
MGSVAMDADYGAPRELSPLQKARALYRPETPPCLQGPTVSVEYGDAAIAADVAGAHVISHAFPHTYGQPLVHFLTKTANVHDATIVTEHPVVRIGVVFSGRQSPGGHNVIWGLYDVVKAHNSNSKIIGFLGGTDGLFAQKTIEITDEALPSYKNQGGYDMLGRTRDQIRTTEQVKATIGTCQALKLDALVIIGGVTSNTDAAQLAETFAQLKCPTKVVGVPVTLNGDLKNQFVETTVGFDTICKVNSQLISNACIDALSAEKYYYFIRMMGRKASHVALECALQSHPNMVILGEEVSVSKLTIFDITKQICDAVQARAEKDKYHGVVLIPEGLVESIPELYALLQEIHGLHNKGVSVENISSHLSPWASALFEFLPPFIRKQLLLHPGSDDSAQLSQIEIEKLLAQLVETEMDKRLVLGHVCYHIVAAGLNGYMATVTNLKSPVNKWKCGAAPITSMMTVKRWSRGAATSQIGKPAVHMASVDLKGKAYELLRQNSSSFMMEDIYRNPGPLQFEGSGADTKPISLCVEDQDYMGRIKKLQEYLEKVKSIVKPGCSQDVLKAAVSAMASVTEMLTIMSSLSFSGQATI

SEQ ID NO: 27966 - protein, 306 aa, Triticum aestivum
MAPFATPMRSASLQLSALLCILLCSEVWVLQCGAAIGINYGQVGNNLPTPAQVVSLLSSLRVGKVRIYDVNPQVLAAFAGTGIELIVTVPNDLVQPMAASAGQAMQWATANIKPYFPATRVTGIAVGNEVFTDDDEALKASLVPAMRNLHAALAQLGMDGYVHVSTASSLGVLANSYPPSQGAFTPECAPLMLPFLRFLAETNAPFWINAYPYFAYKADPANVSLSYALSDPYHVGAVDPYTHLQYTSMLYAQVDAVTFAAARLGYGGIPVFVSETGWPSKGDADEVGATVENARAYNRKPPLALG

SEQ ID NO: 27967 - protein, 281 aa, Nostoc sp. PCC 7120
MVYHNEGVFKSVDGLELYYQNWYPEVKAKAILVIVHGLGGHSDKYSNIVNHLTAKDYAVYGLDLRGHGRSPGQRGHINAWADFRGDLSAFLELIQTQQPQSPIFLLGHSLGAVVVCDYILRCPKEAAKLQGAIALAPAIGKVGVSKFRLLVGKLLSQIWPRFSLTTGLDLSAGSRDEKVVAAYAQDTLRHNLGSARLATEYFTTVAWIHAHAPDWQIPLLILHGSSDRIASPEGGEIFYKNVGCSDKFRIEYPEAYHDLQADLNYQQVLADIENWLENHLP

SEQ ID NO: 27968 - protein, 117 aa, Vibrio cholerae O1 biovar eltor str. N16961
MSNIIKALEQEQMKQDLPQFAPGDTVVVQVKVKEGDRERLQAFEGIVIAIRNRGLHSAFTVRKISNGEGVERTFQTHSPVVDSIEVKRRGAVRRAKLYYLRDLSGKAARIKEKLAKK

SEQ ID NO: 27969 - protein, 392 aa, Photobacterium profundum SS9
MRGRTMSVIKMTDLELAGKRVFIRADLNVPVKDGKVTSDARILASLPTIKRCLEAGAKVMVTSHLGRPTEGEYNEEFSLAPVVNYLNDALDCDVKLAKDYLDGIELNAGELVVLENVRFNKGEKKNDEALSKKYAALCDIFVMDAFGTAHRAQASTHGVGMNAAIACAGPLLANELEALGKAMDNPARPLVAIVGGSKVSTKLTVLESLSKIADQLVVGGGIANTFIAAEGHNVGKSLYEADLVETAKKLMKDCAIPVATDVACAKAFDENAEAVIKHVSEVQDDDMIFDLGPDSTAVLAEIISNAKTILWNGPVGVFEFKNFEAGTAGIAKAIADSEGFSVAGGGDTLAAIDKFGIKADVSYISTGGGAFLEFVEGKVLPAVAMLEERAKA

SEQ ID NO: 27970 - protein, 525 aa, Ralstonia metallidurans CH34
MTRLLRLCKILFVILYYGLDELVLSGFKNRRIKFLVRVITIGRKLDQPRGERLRMALTALGPIFVKFGQVLSTRRDLMPPDIADELAKLQDQVPPFESAVAVKIIEKSLGRRLTELFETFEHEPVASASIAQVHFATLRGGPSHGREVAVKVLRPGMLPVIDSDLALMRDMATWLERVWVDGRRLKPREVVAEFDKYLHDELDLMIEAANASQLRRNFAESDLLCVPEVFWDWCTSSVFTMERMHGIPISRTESLKAAGVDMHKLAEEGVEIFFTQVFRDGFFHADMHPGNILVSVRPETFGRYIALDFGIVGALSEFDKNYLAQNFIAFFRRDYHRVALLHVESGWVPPETRVEELESAVRACCEPYFDKPLREISLGMVLMRLFQTSRRFNVEIQPQLVLLQKTLLNIEGLGRQLDPDLDLWKTAKPFLERWMYEQVGWQGAWERIKIEAPQWAKMLPDFPRLAHQFLERRALQNNEGQERLLTQLVAEQRRTNRRLSTALLLMGGFLAGIVIVQALAWAGYW

SEQ ID NO: 27971 - protein, 466 aa, Ehrlichia canis str. Jake
MVVLNSQQVISYEKSCGIVVDELICRAGKAITDSISKLFPKQFVTVIAGPGNNGKDGVTAARMLKAQGWPVILMLYNCNVDIDEDWVIPLTYNSIVNCQSCLIIDAIFGIGLSRNIPEDLSCIFKYINNDSNNVIVAVDIPSGINCDTGQIMGCAIHADVTITFSVLKIGHILFPGCDYSGKVHVVDIGINIDYSRVAIRNNTPVLWKHEIPKLDYTVNKYKRGYTLVCSVGNKSIGASKLVAMAALRTGSGIVSIACDSNAVAFYASCLTSIMYKLYDDVINDDRVTSVVIGPGCGISDITKQRTVDVLSKKNCVLDADSISVFADSCETLFSEIKHNVIMTPHEGEFKRIFPFLTGSKIEVVQKAANLSKAVIVLKGPDTVIADPIGNVVVNNAPFNLATAGSGDVLSGIIGGLLSCGMTPLSAACCGVWIHAECARNYGIGLIADDIILQIPQILGKLFYSNY

SEQ ID NO: 27972 - protein, 475 aa, Arabidopsis thaliana
  misc_feature (36)..(36): Xaa can be any naturally occurring amino acid
  misc_feature (81)..(81): Xaa can be any naturally occurring amino acid
  unsure (1)..(475): unsure at all Xaa locations
MVFFRSVSAFTRLRSRVQGQQSSLSNSVRWIQMQSXSTDLDLKSQLQELIPEQQDRLKKLKSEHGKVQLGNITVDMVIGGXRGMTGLLWETSLLDPEEGIRFRGLSIPECQKVLPTAQSGAEPLPEGLLWLLLTGKVPSKEQVEALSKDLANRAAVPDYVYNAIDALPSTAHPMTQFASGVMALQVQSEFQKAYENGIHKSKFWEPTYEDCLNLIARVPVVAAYVYRRMYKNGDSIPSDKSLDYGANFSHMLGFDDEKVKELMRLYITIHSDHEGGNVSAHTGHLVGSALSDPYLSFAAALNGLAGPLHGLANQEVLLWIKSVVEECGEDISKEQLKEYVWKTLNSGKVIPGYGHGVLRNTDPRYVCQREFALKHLPDDPLFQLVSKLYEVVPPVLTELGKVKNPWPNVDAHSGVLLNHYGLTEARYYTVLFGVSRSLGICSQLIWDRALGLALERPKSVTMDWLEAHCKKASSA

SEQ ID NO: 27973 - protein, 490 aa, Thermobifida fusca YX
MRRGEEQVSLTERPQLFIGGRWVDSKGGRKVDVHNPATGAYVGSTVLASTADIDAAVASARASFNSGVWANTPPEERAAVLHRAADLLEERAPELAKLITSELGCPIWFSERAHVPNPIRHLRYYGTLAKDFAYDERRSDGTNTSLVTQVPVGVVAAITPWNGPLSTPSLKVAPALAAGCSVILKPPPETPLTAYNLADALSQAGLPDGVLNIVPADREEGAYLVSHPDVDKVAFTGSSAAGKKIMAACAERIARVTLELGGKSAAIILDDADVDTVVPALLPMAFMVNGQACIAQTRLLVPRSRKDEFIDAFAQAVAAQRVGDPIDPATQIGPMVSRRQQERVEGYIATGRQEGARVVVGGERPSLPSELAGGWFVAPTLLAEVHNSMRVAQEEIFGPVLAVIEYDGDDEAVAIANDSVYGLSGSVWSSDEERALAIARRMRTGMVSINGRPQAANSPFGGFKQSGIGREMGPEGFHAYLETMSIAVGS

SEQ ID NO: 27974 - protein, 799 aa, Symbiobacterium thermophilum IAM 14863
MTNHWTDYQNTDVFMVLGTNPAENHPISMRWIDRARETRGAKLIVVDPKFNRTAAKADLYVQIRPGTDIAFLGGLMNYAMTHGRYFHEYVAKYTNASYLIHPDFKFEEGLFSGAQVGEDGQVKYDTATWQYQVDEDGNIKKDPTLQHPQCVFQLMKKHYARYTPEMVAETCGMTVEEFLEVAELFTSTGRPDKAGNIMYAMGITQSSHGSQNVRAVAMLQLLLGNIGIPGGGVNAHRGESNVQGSTDMAMLWNNLPGYMPMPSAAQHPTLAAYQASTPKSGYWTNRPKFMVSLLKAWWGENATAENDFAYDYLPKLDHRDHSHMSIFEAMGRGELKGLFAWGQNFAVGGPNVTKERSALANLDWLVVVDLFETETAAFWKGPGMNPAEIQTEVFLLPAAASYEKCGTVTNSGRWIQWRDKAVEPMGDSRDDLWIADRLFKKLRELYATEGGAFPDPILQLHWDYDDGDHPSAEKVAFEINGYTWADRKGLTTFGNLQDDGSTACGCWIYAGYFDNFETPKCRSRVKDEPGTTLGTHLGWAWAWPVNRRILYNRCSMDEHGQPWDPERPLFRWDGEKFIAQDVPDFVATNPPEVSAQNPFIMMQEGVGALWSPSGMKDGPIPEHYEPVESPVSNRFNRRQFNPVAVISGKGEFGALTEAENPEFPYICTTYRVTEHWQSGAMTRSLPWLGEMMPDMFVEISPTLAAKLGVQSGDRVEVTTVRGSLVAPAMVTPRMRPVRVHGREIEIVGMPWHWGFMGKFTGASANVLTPHVGDANTQIPEYKAFLCNVKKAGGSGPVRG

SEQ ID NO: 27975 - protein, 469 aa, Oryza sativa (japonica cultivar-group)
MVQIEPLEVSLEAGNQADSALLDDDGRPRRTGTFWTASAHIITAVIGSGVLSLPWATAQLGWVGGPAVMVVFGGVTYFTATLQAECYRTGDEETGARNYTYIGAVRAILGGANAKLCGIIQYANLVGTAVGYTIAASISMPGHQEGRAASTPNGHNVPCHISSTPYMLIFGAFEIVFSQIPDFHEIWWLSIVAAVMSFTYSGVGLGLGIAQTVADGGFRGTIAGVTNVTATQKAWRSLQALGNIAFAFAFSNVYTEIQDTIKAPPPSEAKVMKQASLLSIVATSVFYALCGWMGYAAFGNAAPDNLLTGFGFFEPFWLVDAANVAIAVHLIGAYQVYCQPVFAFVERKASRRWPDSGFVNSELRVWPFAISAFRLAWRSVFVCFTTVVAMALPFFGVIVGLLGAISFWPLTVYLPTEMYIAQRGVRRGSALWIGLRALAVAGFVVSAAATTGAVANFVGDFMKFRPFSG

SEQ ID NO: 27976 - protein, 355 aa, Zea mays
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVLFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 27977 - protein, 476 aa, Coprinopsis cinerea okayama7#130
MLTALARSRTVYRTSVARGARWASQASPPKPPGESANESKEPDTNASANANADVKPEQDSVASEGFAAGKVPSLDFSPAAEAAEEEPKRTGARSAKDDTTLSTEKRRKAVGRAMLALMGAGFAGYAVYMGREWDEEELKAKKLNLATAPSTWWGRTSERFGDIFDYFNKPAWPELLPPPMPPPQGKPYTLVISLDDLLITSTWDRQHGWRTAKRPGVDYFLAYISQFYEVVVFTSQPSYTAAPILEKLDRYNFFITHRLFREGTRYLNGKIVKDLSYLNRDPSKVLVLDTNPDHVCLQPENAVILPKWKGDPKDKGLIAMIPFLESIGIYKPPDIRPILKAYEGKNIPIEYAKTEAEAKARHIEAWKAKQPGVSSGFMASLFGLSQNPHASTSGPPPTYLEQKRKEAQIQYREEQKYLAENKEMLDKLIEQEQQAMAQQVPSNLFEAFGQMGKPPPAPPVPGQQPPSAPGSEQAKA

SEQ ID NO: 27978 - protein, 357 aa, Spinacia oleracea
MTAYRGKYADELIANASYIATPGKVILAADESTGTIGKRFPSINVENVESNRRALRELLFTTPGALPYLSGVILFEETLYQKTADGKPFVDAMKDGGVLPGIKVDKGTVELAGTNGETTTQGLDGLAQRCAQYYTAGARFAKWRAVLKIGPTEPSPLAILENANGLARYGIICQENGLVPIVEPEILVDGTHDIDRCAEVSERVLAACYKALNDHHVLLEGTSLKPNIVTPGSESKKVTPEVIAEYTVRTLQRTVPQAVPGVMFLSGGQSEEEATLNLNAMNKLETKKPWTLSFSYGRALQQSTLKAWQGKEENVAKAQEVFLARAKGNSEATLGKYQGGAGGADASESLHVKDYKY

SEQ ID NO: 27979 - protein, 248 aa, Brassica napus
MTEYKEEQEMEIEALESILADDFKEIHSSESGLNTSNRCFQITVTPQDDDLEESSSIPPVQLGLVFSHTENYPDEAPLLDVKSIRGIHVGDLTILKEKLEQEATENLGMAMMYTLVSSAKDWLSEHYGQDDGDDYAEEETAKEDEVIIPHGEPVTLETFVAWRERYEAELALERAKLMPESALTAPKEKKLTGRQWFESGKARGTVVAADQESEEEDDEDIDFEDDDFEDDEEDMLEHYLAEKSDARA

SEQ ID NO: 27980 - protein, 670 aa, Photobacterium profundum SS9
MSSRNANSRKELANAIRALSMDGVQQANSGHPGAPMGMADIAEVLWRSHMNHNPQNPQWADRDRFILSNGHGSMLIYSLLHLTGYDLSISDLKNFRQLHSKTPGHPEYGYAPGIETTTGPLGQGLTNAVGMAIAEKAMADQFNRDGHKVVDHHTYTFLGDGCMMEGISHEASSLAGTLGLGKLVAFWDDNGISIDGKVEGWFTDDTPKRFEAYGWHVIPAVDGHDADAINAAIEAAKAETGKPTLICAKTIIGFGSPNKAGTHDCHGAPLGAEEIAAAREFLGWNHGPFEIPTDIAAEWDAKEAGSAKESAWDEKFAAYAAAHPALAAEFKRRTVGDLPANWEAETSKIIADLQANPANIASRKASQNALEAFGKLVPEFMGGSADLAPSNLTMWSGSKALEAGDFSGNYIHYGVREFAMTAIINGMALHGGFVPYGATFLMFMEYARNAMRMAALMKIQNIQVYTHDSIGLGEDGPTHQPVEQIASLRLTPNMSTWRPCDQVESAVAWKLAIERKDGPTALIFSRQNLAQQPRTDAQVANIAKGGYILKDCEGKPELILIATGSEVELVTEAYAQLTAEGRKVRVVSMPATDTYDKQDAAYRESVLPSDVTARIAVEAGIADFWYKYVGFDGRIIGMTTFGESAPAGELFKMFGFTVENVVDTAKELLA

SEQ ID NO: 27981 - protein, 247 aa, Zea mays
MRVAATRTAAAAAAHPPSAFLLLLVLLCCASLAIGGAAMAGHVLGGVKENPAAANSADSDGLGRFAVDEHNRRENALLEFVRVVEAKEQVVAGTLHHLTLEAVEAGRKKLYEAKVWVKPWLDFKELQEFSHKGDATAFTNADLGAKEGGHEPGWREVPVEDPVVKDAAHHAVKSIQERSNSLFPYELLEILRAHAQVVEDFAKFDILMKLKRGSKEEKIKAEVHKSLEGAFVLNQHQPAEHAESSSQ

SEQ ID NO: 27982 - protein, 288 aa, Triticum aestivum
  misc_feature (130)..(130): Xaa can be any naturally occurring amino acid
  unsure (1)..(288): unsure at all Xaa locations
MEWDRKLVDGLSQDALCDVIIAAKFLHIKGLLDAACQKVAVVDMVNCKTPEQMHQMEEEDMCTWFSGLTPFSEKGTAAAEGARRGRTVGQRPEEKGAMAEETEQVAGENDTFFFRASGKIITLKSSEWDXFPKVSEAAARLSVLLADMIDQGCAKGIIQLPNVDARALATVIEYCNEHAAAAATANPDANHGVAEGSSSSNSEASEEALMEWDRKLVDGLSQDALYDLMMAANFLHIKGLLDAACQKVADNVKGYSVEQMREMFGIANDFTEEEEEELRKESPWAFEE

SEQ ID NO: 27983 - protein, 241 aa, Prochlorococcus marinus str. MIT 9301
MRKSVIAGNWKMHMTCAEAKSYLEEFIPLIKNIKDDRKVVIAPPFTAISTFSDHSDFEYLDISSQNIHWEDQGAFTAEISPKMLLEHGVSYAIVGHSEPRKYFSESDEQINKRAVFAQSSGLTPIVCVGETLEQRERGEADRVITRQVEQGLENTDPSNLIVAYEPIWAIGTGKTCEAEDANKICSLIRKLIGFDDVIIQYGGSVKPNNIDEIMSMSDIDGVLVGGASLDPNSFARIANYQ

SEQ ID NO: 27984 - protein, 429 aa, Bacillus subtilis subsp. subtilis str. 168
MHTKSIELHNEALQHIVGGVNSPSRSYKAVGGGSPVAMEKASGAYFWDVDGNKYIDYLAAYGPIITGHAHPHITEAIKKAAENGVLYGTPTKHEVTFAKMLKEAIPAMDKVRFVNSGTEAVMTTIRVARAYTGRTKIIKFAGCYHGHSDLVLVAAGSGPSTLGTPDSAGVPKSIANEVITVPFNDIDSYKAALEKWGSEIAAVLVEPIVGNFGIVEPKEGFLEQVNELTHNAGALVIYDEVITAFRFMYGGAQDLLQVKPDLTALGKIIGGGLPIGAYGGKQEIMEQVAPLGPAYQAGTMAGNPASILSGIACLEVLKEKGVYEKLDHLGAMLEEGIMKHAETHGITITVNRLKGALTVYFSDEKVENYEQAERSDGETFSTFFKLMLERGINLAPSKYEAWFITTAHTEQDIKDTLTAVEDAFKHLKN

SEQ ID NO: 27985 - protein, 2160 aa, Magnaporthe grisea
MTRNDALSRFSSITSSSTDSAHSTATVKPLPSTPIASDTRRHSSGSRPAIPSRLRIDDDLNRITASPLRDDTQVSPTNTFGTRVALSPSSPTSNVFPREQRLSDFGNYRRDLAVLDPGGSRVPQIQQPPPNTGPSLSSQVAPWMTSNGTGGAPAAINTSFYNDSSDNLSVASQLSPGFRIPGGRPSISQPSGVGADNNEASYFGDERRPSIASITTTASSQGSKASGNRGGFRKLQGFFGEEFPGRDSSDTSLPPAVPGKEHRSHSYSHGRPYRDRNYSNATDHTRDGSPSSSRPRTPVPAPEVVPFLYQEADDIAKYGEAPVRDILSGPDRERYVTGDSLQNPPKTSSSSRSGHSLAHLSGQHRHQKSNDDPRTLRPTMSRDDSAVPTYKDRSGSATTMMTTSRDRAHSPAPSGHSIGGYFSSKNGTYDGQTSPPGHQKKSLLGRFKRNKDKEDTGSLKKTSPSSTSLNLKPSRSEFGGDGASTMGQDWPSRLAEPSQYNSNSNSASARPPQARHGTFKSPFAKRGRTHHRHDDRDEAIGPTDKHDGMQAGGTMFHLDTDLNDMSGILSRPLPLTPMDADFVGTIKGEKSTVTSNGRNGAWDAPDSWAVKRTGDDLAYHGPENDEAGPSPRPEEKMTSYCIRVFKSDGTFATLQMSIDSSVQDLIGQLSKKSYVSGGLEYHIALRKHGLIRVLGSAEKPLFIQKRLLRQVGFEERDRIEDIGREDNSYLCRFLFMSSRELEQQARTQDLGLGRTQKFNHVDLSARNIIRIPIYLYSKVQDIISLNLSKNLSLDLPRDFISSCQNLRDIKFNNNEARKLPASLGRASRLTYLDVSNNRIDHLENAELNGLVGLLKLNLANNRLKHLPPYFGAYRSLRTLNVSSNFLDKFPSFLCELESLVDLDLSFNLIGAFPPAIENLRNLEKLVITNNRLAGTLPDSFSRLQSLRELDIKYNAISGIDVISLLPKLEILAADHNAISQFVGSFERVRSLKLKDNPITRFELTSTVPTLKLLNLSNAKLASIAESFNHMLNLERLVLDRNHFVSLPSQIGRLRRLEHFSIAHNALAELPPEVGCLQELKFLDVRGNNLKKLPLEIWWANKLETLNASSNVMTDFPKPASRPPQPPESSPGSMQGSNGKVAMVGSLSTPPSIEDLDPDDSRRPSQASSSTLLSVGPSPVPAGPDRKSSVVSVYGKGGRKTSIISRSANSSGNAPAPPNTRKDSGLSARITNTFSGSLRNLFLADNLLDDDVFDQIMLLCELRVLNLSFNQISDMPQRCIKSWPQLSELYLSGNELTTIPVDDLEEYSLLQVLHINCNKFTNLPADISRAKKLAVLDCGSNFLKYNISNVPYDWNWNLNPNLRYLNLSGNRRLEIKQPAYGSGAGNREQYTDFSRLQNLRVLGLMDVTLTQPSIPEQSEDCRVRTSGSSAGYLPYAMADTLGKNEHLSTVDLVVPRFNASETETLLGLFDGQALSSGGSKIAKYLHENFGQILATELRALKTGLKETPEDALRRAFLALNKELVTIAIQHSEDRPSVPHRSGSQAHVILNKEDLNSGGVATVVYLQGQDLYVANVGDAQAMIIQSDQTHKMLTRKHDPAEPTERSRIREAGGWVSRNGKLNDQLGVSRAFGYVDLMPAVQAAPHVSHVAIREQDEMILLATSELWEHLAPELIVDIARQERGDLMRATQKLRDLAIAYGSTNKIMIMMISVADLKRRTERTRINRGQSMSIHNLSLHGEQYKFPTRGRRKKDQVMDSTLQRLEAEVPAPTGMIAIVFTDIKNSTNLWETYPAAMRSAIRLHNEMMRRQLRRIGGFEVKTEGDAFMVSFPTATSALLWCFAVQLQLLEVNWPSEMLNSLSCKPTVDKNNQVIFKGLSVRMGIHWGEPLCEPDPITRRMDYYGPMVNKASRISAVADGGQITVSSDFISEIQRCLETYQGANAAALVNESFDEDPFSMAIRKELRSLSSQGFEVKELGERKLKGLENPEVVYSLYPHQLAGRIETHQAHDKGVTAAAPELIENTPAVLKEGSELDFDPEIIWGLWKLSLRLEMLCSSLEYVGGRGLQAPETELLERMKQRGGEVTESFLVNFMEHQISRIETCVSTLSIRHLNMGGGTIKELDDLRGPISSVLANFSKQMAELQRYKALYGPLDAIEDGQQAS

SEQ ID NO: 27986 - protein, 458 aa, Oryza sativa
MGISSESPNGSQQIVQKETRDETTPLLPVKVEEEGFHEFNGASFSGAVFNLSTTIVGAGIMALPASIKMLGIIPGILMIIVVALLTEASIDMLVRCSHQGKITSYGWLMGEAYGQWGRIALQASVVINNIGVMIVYMIIIGDVLSGTSSTGVHHRGILEGWFGAHLWNSRAIVLLATTLFVFAPLVSFKRLDSLRYTSALSVALAVVFVVITAGIAIIKLFNGTVAMPKLFPELDGLSSIWKLFTAVPVLVTAYICHYNVHSIDNELEDRTQIKPIVRTSLFLCSSVYIATSFFAYLLFGEGTLDDVLANFDANLGIPFSSVFDDIVRVSYAAHVMLVFPIVFFALRLNLDGLLFPTSRDISRDNKRFAIITISLLTVIYLAAIFIPSIWDAFQFTGATAAVLIGFIFPAMVILRDPYGIASKRDKILAVTMIVLAVLSNSVALYSDAMNIFRKEEEA

SEQ ID NO: 27987 - protein, 524 aa, Synechocystis sp. PCC 6803
MAVTSPWFRAVVSAAQMQEIENWLFTQGMPVAALMEKAALQTAQRLLTLYPLSTYPRIGVVVGPGHNGGDGLVVARELKLQGYQVQVLQPLDKLKPLTQNHVDYGKSLGIPWVDGVQALAHCDLIIDALFGVGLTRLITGAIADLITTINNLPIPVVSIDLPSGIETDTGEILGVAVEADRSFCLGLWKRAYFQDRALAHLGQTELLGIGLPPQAIANVLGEVWPVQVLGADQAQQTLPLSRPLVTHKYQQGHLLLICGSQQYAGGALLTTLGARASGVGMVTVAVPMGIKALLHSQCPEVLVKGLLETPSGAIAGLGNLDLSRYSAVALGPGLGSDVGPLVEEVLSVNCPLILDADGLNQLAQQQLLPLLAVRTAPTVLTPHGGEFKRLFPDIDQGDRLTAVQTAAAMCQATVLLKGAKTVIASPTGPTWAIKDSTPALARGGSGDVLTGLMGGILAQPEKFDLAQRVATAAWWHAQAGILASQQRTILGVDAQHLAEYLIPACRQWLGPNVANWPANLSHSS

SEQ ID NO: 27988 - protein, 389 aa, Haloarcula marismortui ATCC 43049
MTENVVVLGSGYAGAGAIKSFEDELDGQTDVDVTWISETDYHLVLHESHRCIRDPSVQENIAIPVHEIKQPSTSFIQDEVVGIDTDAQEVDLADSDTVEYDYLLVGLGSQTAFFGIEGLKEHALTLKSLDDALEIHDKVQQAAREASTNDPAQVVIGGAGLSGIQTAGEVAEFRDEHNAPIDIHLVEGLDQVLPNSDPELQGALRKRLEAADVNIKCGEFIGEVDEETVYIGDEDELDYDVLVWTGGITGRDCMQDVDLDKDERNHRVHAEGNFQTEDEHVFAIGDSALIDQPGDQPAPPTAQAAWQAAEVAGENLARAVRGQPLKTWTHKDKGTVVSVGEKAVAHDVVNMPIETFGGMPAKLLKKAIAARWINDMTGVGRAAKAWPDM

SEQ ID NO: 27989 - protein, 291 aa, Brassica napus
  misc_feature (264)..(264): Xaa can be any naturally occurring amino acid
  unsure (1)..(291): unsure at all Xaa locations
MSSFNQNGDAKNADTSDDIDDIDFSKLLEKPRPLNMERLRSLEERSLTELSTSPPHLRNGDNASASRLQDRAECVVSPSVGFNTPRSLPGFESHPMVGEAWDALRRSLVYFRGQPVGTIAAVDNSEEKLNYDQVFVRDFVPSALAFLMNGEPDIVRNFLLKTLRLQSWEKKIDRFQLGEGVMPASFKVFHDPVRNHETLIADFGESAIGRVAPVDSGFWWIILLRAYTKSTGDSSLADMPECQKGIRLILSLCLSEGLDTFPTXLCADGCCMIDRRMGVYGYPIEIQALFF

SEQ ID NO: 27990 - protein, 398 aa, Ehrlichia canis str. Jake
MSLIAGRMDCIKPSPTLEIASQAQKLKMSGVDVISLSAGEPDFDTPQHVKQAAIDAINAGKTKYTAVDGIIELKKAIVDRFKQDHDLTYDVNQVSVGNGAKQCIYNLLMATINDGDEVIIPAPYWVSYPDVVKISGGNPVIVDCSETFKLTPDLLESVITEKTKWLIINSPNNPTGLMYTYEELQCIAEVLLKYPNIYIMTDDIYSKIVYDGFKFFTIAQVEPRLYDRVFTVNGVSKAYAMTGWRIGYVAGDSKVISAISVIQSQSTTNPNSIAQFASVHALTGDQEFLKERNKIFAERRDMMMNMVNNTSVLSVKKPQGAFYVFISCKELIGKSAKNGLVINSGIDFTRYLLEDYNVAAVPGEAFGVQGFFRISYATSTEQLSKACDRILDACNKLL

SEQ ID NO: 27991 - protein, 104 aa, Leuconostoc mesenteroides subsp. mesenteroides ATCC 8293
MAVKTVEDATFNQETNTGVSITDFWATWCGPCRMQSPVLDVLSDEVDDVKFVKMDVDANPETPAAFGIRAIPTLLIKKDGEVVERLTGFHNKEQLAKILAKYTN

SEQ ID NO: 27992 - protein, 117 aa, Zea mays
GDLSTSLLFARAQHHPPTSSKRRRPATCGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 27993 - protein, 305 aa, Thermobifida fusca YX
MTTPVDPAIAAVAAAAAAAPPLTSLTPEQARARVAAGNSSCANGPDLRSVRDIRLPVADGQIGARVYTPHAAPRATFVYLHGGGWVTGDLDYSDELCRFLADRLAWTVVSVDYRLAPEHPFPTPVNDAYAAVQHVAATIAANGPLGVGGDSAGGNLAAACTLRARDEHGPRLDFQVLLYPVTDHDFTRASYQTHATAFPIGVAEMRWFWDHYLPDPERRDLPLASPLRAELAGLPPAHIVVAGHDPLRDEGVAYAERLRAAGVKASLAEYPSLTHGFFRLTGVVPAARAAVDDLIDALQLLTEDH

SEQ ID NO: 27994 - protein, 549 aa, Oryza sativa (japonica cultivar-group)
MASINSFCNHMIFKLILGAIEKLKKKKNSSFATILSSSCCFATGDCSAHRLHLPVVACKRNRKATYSLQTIGSGGAHRGGVRRWRRWCRRAGAAGVVAHSGAAGARGWGRWGVESAAAAAALGGWGGARGRRACAPWRRRRSAAALGAELVWILCYEVKRPLLGPKDLPLCINKLPPMIDREPAGSSRHGSNMDPSINIPVNRDAITEEVAAAFAESEVIPERYCRPDEVHDGIVVGHDDDEAYELPVVDMEKLLDPELAEAEIAKLGSACQDWGFFQLVNHGVDEQVVNEMKDSTVKFFSLPLESKRTVEIQDNGFEGFGHHYRRASGKLDWAESVILLTQPIQERNPEMWPTNPSSFRDALDKYSAEMTKLAMRIASIMATDLGVDQEALVGAFRDKQQSMAIHHYPPCRHPDKVIGITPHSDGLGLTLLLQLDDTPGLQIRKDGRWLPVRPRPGTFIINVADILEVLTNGAYKSVEHRVLADAEKGRTTIVTFHEAYVDGMVKPIPEVLKLNGAEARYKSIERIEYIKGNFVALSEGTRFLESLKI

SEQ ID NO: 27995 - protein, 670 aa, Oryza sativa
MAHRAGCLSMLLTAAVVLLALAPRGAAYPWQVCGTTGNFTANSTYQANLDAVAAALPRNISSSPDLFATAMVGAVPEQVSALALCRGDANATECSGCLATAFQDVQNMCAYDKDAAIYYDPCILYYSNVPFLSSVDNAASTSRVNLQNVTSDPGRFNGMVAALVNATADYAAHNSTRRYASGEAVLDRESEFPKVYSWAQCTPDLTPAQCGDCLAAIIAKLPRLFTNRIGGRVLGVRCSYRYEVNPFLNGLVMVHLTAPPIPTASPPAAAAAAAGEGKDYNVPRLVLAILLPTIAALVLINILVWLCFWRRMERLRSGATQPYSSNSAESENISSVESMLIDISTLRAATGCFAERNKLGEGGFGAVYKGTLPDGDEIAVKRLSKSSAQGVGELKNELALVAKLQHKNLVRLVGVCLEQEERLLVYEFVPNRSLDQILFDADKRQQLDWGKRYKIINGIARGLQYLHEDSQLKVVHRDLKASNILLDMNMNPKISDFGLARLFGRDQTQGVTNLVIGTYGYMSPEYAMRGNYSLKSDVFSFGVMVLEIVTGKKNNDCYNSLQSEDLLTLVWEQWTARAVSEAVDPVMGGGFSWSDVMRCIHIGLLCVQENPADRPVMSSVVMMLGSDTVSLRAPSKPAFCARRNGGTGGAGASSGGTSSGTSTAASVQGK

SEQ ID NO: 27996 - protein, 1098 aa, Prochlorococcus marinus str. MIT 9301
MPQRGDLKKILILGSGPIVIGQACEFDYSGTQACKALRNAGYEIVLINSNPASIMTDPEVASKTYIEPLTPEIVSQIILREKPDAILPTMGGQTALNLAVKLSESNFLKQNNIELIGADLRAINKAEDRQLFKESMEKINVNVCPSGIASNLDEAIEVSRKICSYPLIIRPAFTLGGVGGGIAFNLEEFVELCKSGLEESPSNQILIEKSLIGWKEFELEVMRDTADNVVIVCSIENLDPMGVHTGDSITVAPAQTLTDKEYQRLRDLSLKIIREVGVETGGSNIQFAINPSNGEVIVIEMNPRVSRSSALASKATGFPIAKIAALLSVGYTLDEIINDITKKTPACFEPSIDYVVTKIPRFAFEKFKGSSNTLSTSMKSVGESMAIGRSFEESFQKALRSLEVGVFGWECDSKDEFINESQIKNSLRNPTSERILLIKKAMQLGKNNNYIKEVTNIDLWFIEKLRNIFNFENDFLKDKELYTLDRDLMLHAKQLGFSDQQIAKLTNSEFFEVRTYRKKLNVIPIYKTVDTCSAEFSSSTPYHYSTYEESFININSQIFDSEISEKSKSKKIMILGGGPNRIGQGIEFDYCCCHASYQASTNGYKTIMVNSNPETVSTDYDTSDILYFEPVTLEDVLNIIEAENPYGLIVQFGGQTPLKLSLPLFEWLKSNDGIRTGSKILGTSPISIDLAEDREEFTKILEELSIRQPLNGIARNQDEAEIVAKNIGFPLVVRPSYVLGGRAMEIVKDENELSRYISEAVKVSPDHPILLDQYLNNAIEIDVDALCDSEGSVVIAGLMEHVEPAGIHSGDSACCLPSISLSTSTIENVRNWTKLIAQRLNVVGLINLQFAVINTNNKEKKLFILEANPRASRTVPFVSKAIGKPVAKLATQLMQGFTLEDLNFTEEFSPKYQAVKEAVLPFKRFPGSDTLLGPEMRSTGEVMGLAKDFGIAYAKSELAAGNGVPSDGVAFLSTNDLDKKNLEEVARELLNLGFKLIATKGTASYLVNLGIQVEEVLKVHEGRPNIEDLIRSGLVQLIINTPIGSQALHDDAYLRRAALEYNIPTFTTIPGAKAAIKAIKALQCNKINTYSLQEIHNY

SEQ ID NO: 27997 - protein, 476 aa, Bartonella quintana str. Toulouse
MLFDEKHNKLKRSLQNRHVQMIALGGVIGTGLFYGSTESIRLAGPSTILAYLFGGLIMYFIMRMLGEMSVEEPTSGAFSFFAYKYWGSLAGFITGWNYWFLYILVSMTELTVIGFYLDHWLLIDHWKSSFIVLLLVTLINLLNVRFYGEFEFGLALIKVAAVVGMIVFGIFLIVTEIGENQASISHLWDHGGFFPYGAMGVVLATCVVMFSFGGTELIGIAAGEVSNPQKTIPIAIRKVMWRIVIFYIGSISVIMMISPWNMIGKDVSPFVKIFEIIGIPAAGHILNFVVIMAAISVYNSGIYSNGRMLYSLAIQKNAPHIFSKLSAARVPYVAILFSSICTAIIIVMNAFVPNNSFMRIMALATAAAIITWSIIVIVHLKFRKVHKDRKGAFIYAFALYPYANYLCLCFLAALFCIMFVSGFGKNGLMAQLFNVVGISASSVESYIPAQMPDMSLAVIIIPLWCLLLLLGYKLKR

SEQ ID NO: 27998 - protein, 753 aa, Rhodopirellula baltica SH 1
MSISIKDNRNDAGKTFQLPTLLQRRTGPMTRELVLRPGDHGLGMTHDSMAADTTTTATCGFCATGCGLRLHLKDGEAIGLTPETAYPVNLGMACPKGWEALRVLDSPERATLPLLRDETGKLSPIEWDDAFSKFCDGMKQVQSEHGPESIAFLSTGQIACEEMAFLGALARFGMDIRHCDGNTRQCMATAVTAYKESFGFDSPPYTYDDFEQSDCLVFIGANPCVGHPIMWERVLRNPHNPEIIVIDPRRTETAAAATQHLQLRPKNDLALLYAITNELILRDFVEHDFVQNHTQGFEELRQHVSQYDLATVCEEAGLAVEDVSAAVEAIGRGRAVSLWWTMGVNQSYQGTRTAQAIINIALITGNIGRPGTGANSITGQCNAMGSRLWSNTTNLFGHHSFTEESDRRKVAEALNIPVEKIPSTTSWKYDRIIEGIRNGEIKGLWVVATNPAHSWIDQGDVRELFDQLDFLVVQDMYKTTETCSHADLILPSAGWGEKEGTFINSERRYGLLKKVRHAPGQALADFQIFRGIAHRWGVGEMFAEWTSPEAVFQIMQRASRGQPSDISGIEGYEQIDRCGGIQWPWSADHASGGFEPEQQRRLFADGRFFHEDRRARLIVDDVSPMPEPAGEDYPIVLLTGRGTVSQWHTQTRTRQSPLLRSLYPNQPYVEMHPRDAAELDVEHGDLVRVRSRRGHADATACLTHSVQPGQVFMPMHYECTNQLTLSHFDPHSGQPSYKDCAVRIEPVLTSDHD

SEQ ID NO: 27999 - protein, 613 aa, Rhodopirellula baltica SH 1
MTDQQDSKPFSDEQQQYLAGFTFGADVARAVQGLPVISGSGGQGTTLAIGGGSTTVDGESVPTGPDRFAFEAQSAVLAAGKKLSKEEQAKRDKNPLDMWDEMQARSDAGEFPKGTDVFLQKFHGLFYVTPAQDSFMCRLRLPGGQIQAWQLRGLADLADQSAGPYLDLTTRGNVQLREIPADQAMNILFGTRELNIVPLGSGGDNIRNCTSSAMSGLDADELIETLPLAIRMHHYILNHREMYGLPRKFNIAFEGGGRIASLEDTNDIGFKAVRVLDENASDDLPAGVYFQLCLGGITGHKDFARYTGVLLRESECVAVAAAIVRVFIRTGDRTDRKKARLKYVLDDMGFEKFIAEVEAEMGRTLTKVDVSRLTVQDIEDRSAHVGVFPQKQPGLNSLGIVFPVGRMTTDQARALADLALRYSNGDIRLTVWQNLILTNITDADLPAVQAGIRECGLDYEANSVRAGLVACTGSAGCKFAGAPTKANAIEIAERVESVLTLDQPINIHLTGCHHSCAQHYIGDIGLIACQVEVGDDMVDGYHICLGGGWGSRQGIAREIFKSVPFAEVPDLVTGILSSYQQNRVDSNESFNDFAGRLSDEELKSLVATPSVVC

SEQ ID NO: 28000 - protein, 500 aa, Thermoplasma volcanium GSS1
MDIFHIFSDKRLNTVYLSKNMEYHEVIEKLDFSKVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQISDLFENNGLSSLRKASMSYNKSSSGSSGKK

SEQ ID NO: 28001 - protein, 614 aa, Bacillus subtilis subsp. subtilis str. 168
MCGITGWVDFKKQLVQEKQTMDRMTDTLSKRGPDDSNVWGEHHVLFGHKRLAVVDIEGGRQPMACTYKGDTYTIIYNGELYNTEDLRKELRARGHQFERTSDTEVLLHSYIEWQEDCVDHLNGIFAFAVWDEKRNLLFAARDRLGVKPFFYTKEGSSFLFGSEIKAILAHPDIKARVDRTGLSEIFGLGPSRTPGTGIFKGIKEIRPAHALTFSKDGLNIWRYWNVESEKHTDSFDDTVANVRSLFQDAVTRQLVSDVPVCTFLSGGLDSSAITAIAAGHFEKEGKAPLHTYSIDYEENDKYFQASAFQPNDDGPWIEKMTEAFGTTHHKCVISQKDLVDHLEEAVLVKDLPGMADVDSSLLWFCREIKKDFVVSLSGECADEIFGGYPWFHTADVESGFPWMRSTEERIKLLSDSWQKKLNLKEYVNAKYEETLAETPLLDGETGVDKARRQLFYLNMLWFMTNLLDRKDRMSMGASLEVRVPFADHRLVEYVWNIPWEMKMHDNREKGILRKALEGILPDDILYRKKSPYPKTHHPEYTKGVSEWLKTIRSQKDSVLHTLLDRKQLDQLLETEGSSFKVPWFGQLMKGPQLIAHLAQIHTWFEAYRIDIDER

SEQ ID NO: 28002 - protein, 273 aa, Magnetospirillum magnetotacticum MS-1
MKDATHADLSVIEPLVRSSDLAEYRQGLQRHQSGEWDAERFTAFRLRHGVYGQKQAGVQMVRIKIPGGIVPTPWLKTLARVNRDFAKGPAHITTRQDFQLYYVPLERSADMLEVLNAGGITTREACGNTLRNMTSCALAGACGRELVDAGKVAEQLARTWLRHPLVQHMPRKMKFTVSGCATDCGASPIHDLGFVAVEKDGKPGFKVLAGGGLGGQPIMAAEVLSFVPEEDLPTVIEATALHSPALFQPPRTASLARLKFVLQAALGLEKSPP

SEQ ID NO: 28003 - protein, 306 aa, Photobacterium profundum SS9
MKPTKELLAGILDEVRPLIGQGKVADYIPALAGISATKLGIAVCYNDGEIIQAGDTQERFSIQSISKVMSLTLAMSLYEPEEIWRRVGKEPSGHAFNSMIQLELENGIPRNPFINAGALVVSDLLHSRLAAPQYRMLELVRKLSCNPHLTYDKAVAASEMQHSDRNASIAYLMRSFGNFENEVMPVLTNYFSYCSLNMSCIDLARTFSYLANKGLPLGAKKTIISQTQSKQMNALLATCGLYDGAGEFAYRVGMPGKSGVGGGIVAIVPGEMSITVWSPELDPSGNSLAGTAALELLAERIGRSIF

SEQ ID NO: 28004 - protein, 172 aa, Staphylococcus aureus subsp. aureus
MDLKQYVSEVQDWPKPGVSFKDITTIMDNGEAYGYATDKIVEYAKDRDVDIVVGPEARGFIIGCPVAYSMGIGFAPFRKEGKLPREVIRYEYDLEYGTNVLTMHKDAIKPGQRVLITDDLLATGGTIEAAIKLVEKLGGIVVGIAFIIELKYLNGIEKIKDYDVMSLISYDE

SEQ ID NO: 28005 - protein, 1221 aa, Lotus japonicus
MLTKFETKSNRVKGLSFHTKRPWILASLHSGVIQLWDYRMGTLIDRFDEHDGPVRGVHFHNSQPLFVSGGDDYKIKVWNYKMHRCLFTLLGHLDYIRTVQFHHENPWIVSASDDQTIRIWNWQSRTCISVLTGHNHYVMCASFHPKEDIVVSASLDQTVRVWDIGSLKRKAGPPADDILRLSQMNTDLFGGVDAVVKYVLEGHDRGVNWAAFHPTLPLIVSGADDRQVKLWRMNDTKAWEVDTLRGHMNNVSCVMFHAKQDIIVSNSEDKSIRVWDATKRTGIQTFRREHDRFWILATHPEMNLLAAGHDSGMIVFKLERERPAFAVSGDSLFYAKDRFLRFYEFSTQRETQVLTIRRPGSLSLNQSPKTLSYSPSENAVLLCSDVDGGSYEFYCISKDGIKDSFGRGDTQDPKKGLGGSAVFVARNRFAVLDKGSNQVFVKNLKNELVKKSVLPIATDAIFYAGTGNLLCRSEDRVFIFDLQQRLVLGDLQTPFIKYVIWSNDMESVALLSKHAIVIASKKLVHQCTLHETIRVKSGAWDENGVFIYTTLNHIKYCLPNGDSGIIKTLDVPIYITKVVGNTIFCLGRDGKNRAITIDATEYVFKLSLLKKRYDHVMNMIRNSQLCGQAMIAYLQQKGFPEVALHFVKDERIRFNLAIESGNIQIAVASATAIDEKDHWYRLGIEALRQGNAGIVEYAYQRTKNFERLSFLYLITGNVEKLSKMLKIAEVKNDVMGQFHNALYMGDIRERVKILENVGHLPLAYITASVHGLHDVAERLATELGDNVPSLPEGKVPSLLIPPSPVLSGGDWPLLRVMRGIFDGGFNQTDRDADEEEYEAADGDWGEELDMVDVDGLQNGDVAAILDDGEVGEEGDEEGGWEMEDLELPPEAETPKASVSSRSSVFVTPTPGMAVSQIWIQRSSLAADHAAAGNFDTAMRLLNRQLGIKNFAPLKSLFLDLHSGSHSYLRAFSSAPVVSLAVERGWNESSSPNVRGPPALPFKLPQLDEKLKAGYKATTAGKFTEALRTFVNILNTIPLIVVESRREVDDVKELIIIVKEYVLGLKMELKRREIKDDPARQQELAAYFTHCNLQTPHLRLALLNAMTVCYKAKNLATAANFARRLLETNPNIENQAKTARQVLAAAEKNMTDATELNYDFRNPFVICGSTYVPIYRGQKDVSCPYCTSRFVPSQEGQLCAVCDLSVVGADASGLLCSPSQVR

SEQ ID NO: 28006 - protein, 1030 aa, Bacillus subtilis subsp. subtilis str. 168
MPKDTSISSILVIGSGPIIIGQAAEFDYSGTQGCIALKEEGYRVILVNSNPATIMTDEAFADEIYFEPLTAESLTAIIKKERPDGLLANLGGQTALNLAVELEETGVLKEHGVKLLGTSVETIQKGEDREKFRSLMNELKQPVPESEIVDNEADALHFAESIGFPVIIRPAYTLGGKGGGIAPDKEAFTAMIKQALLASPINQCLVEKSIAGFKEIEYEVMRDSNNTCITVCNMENIDPVGVHTGDSIVVAPSQTLTDEDYQMLRTASLTIISALDVVGGCNIQFALDPFSKQYYVIEVNPRVSRSSALASKATGYPIAKMAAKLAVGYTLDELKNPLTGSTYASFEPALDYVIVKFPRWPFDKFKNADRKLGTKMKATGEVMAIERNLEAAIQKAGASLELKNIGTHLPELSGLSIDTLWDLAITPDDRRFFVVMELLSRSVSIDDIHEKTKIDPFFLHTFDNIIKLENRLMEAGSDLSFELLKKAKEKGFSDATIASLISKTEEEVRRLRKEMGITPSFKIVDTCAAEFDAKTNYFYSTYFGETDGDISRKEKKRALIIGSGPIRIGQGVEFDYSAVHGVLTLQELGFETIMINNNPETVSTDYEIADRLYFEPMTTEHIVNVREQENIDFAIVQFGGQTAINAAEALEKAGITLLGTSFQTLDVLEDRDQFYQLLDELGLKHAKGEIAYTKEEAASKASEIGYPVLIRPSYVIGGMGMIIVDSQAQLSQLLNDEDSMPYPILIDQYVSGKEVEIDLISDGEEVFIPTYTEHIERAGVHSGDSFAILPGPSITSGLQQGMKDAAQKIARKLSFKGIMNIQFVIDNGNILVLEVNPRASRTVPVVSKVMGVPMIPLATRLLAGASLKDLNPAVQNHHGVAVKFPVFSSHAIQDVDVKLGPEMKSTGEGMCVAYDSNSALKKIYTRVWSQKGSIYLQNVPEDVKELAENAGFTIHEGTFASWMEQEGNSLHINLSGSEEARKERLEAMTHGIPVFTEEETVRAFLQSGSGHPQPVSLKDLYKKEVASCTQ

SEQ ID NO: 28007 - protein, 204 aa, Synechocystis sp. PCC 6803
MLQRLVHILALTVCGLAVVSSLTPSVRGQGVTEVEEVIIEGSGPENSREFRPLNQEGSILSVGAGRRLMNEANEAINLNQYTVALEKLQEARKIFNQLSNFHLQLANSFSGINTVIFEEQRIAALETGQLRDEATYRLALVHRANNEPALAVPLLLQIIRSQNPTTDLGRKSYQQLYELGFVASPFEGPTPTGTNAAPTAPVVN

SEQ ID NO: 28008 - protein, 194 aa, Leuconostoc mesenteroides subsp. mesenteroides ATCC 8293
MDVHNVEMVMSAVSASQYPTDGKPEIALVGRSNVGKSSLTNTLIQRKNFARTSSQPGKTQTLNFYDVEDKLYFVDVPGYGYAKVSKAQREAFGVMIEEYITSRKQLRGVISLVDARHEPSEDDISMYEWLHYYNIPILVVATKSDKISRGKFNKAESVIKKALGFDNEDSDFQFFSSETKYGKDEVWHWIEQHI

SEQ ID NO: 28009 - protein, 335 aa, Propionibacterium acnes KPA171202
MTVKVGINGFGRIGRNFFRALAEQGADLEVVAVNDLTDTKTLAHLLKYDSIMGRFSGEVSYDDDSITVDGKTIKVLAERNPADLPWKELGAEIVVESTGLFTDGEKAKAHFEAGAKKVIISAPGKNVDGTFVMGVNDGDYDNAKHNIISNASCTTNCLAPLAKVLNDAFGIERGIMTTVHAYTGDQRLQDAPHKDLRRARAAALNMIPTKTGAAQAVALVLPELKGKFDGLAVRVPTPTGSLTDLTFQTSKETTVEEVQAAVKKAAEGPLKGILAYTEDPIVSKDIEGDPHSSIFDATETKVIGNLVKVLSWYDNEWGYSNRLVDLTKLVASKLA

SEQ ID NO: 28010 - protein, 402 aa, Propionibacterium acnes KPA171202
MKSVEDLGDLRGKRVVIRCDFNVPLDGDKITDDGRIKAALPTLTQLHEAGARTTVLAHLGRPKGAVDPKYSLAPVAKRLGELMNLDVKLAGDVVGPSATKTSESLADGEIALVENVRFEKGETSKDEAERAELAQKYASFGEFYVSNGFGVVHRKQASVYDVAKLLPSAAGSLVAKEVEVLEGLTADPKRPFVVVLGGAKVADKLAVIDNLLKAADTLVIGGGMAYTFLKAKGLEVGDSLLDEDSIDACTKYLEQAKAAGKQILLPVDVRVVSDIDFEARTVGQIDVVPADEIPSDKMAVDIGPETEKAYANAIKGAKSVFWNGPMGVFEIKGLELGTKAVAQALTEVDGLSVVGGGDSASAVRTLGFADDQFGHISTGGGASLELMEGKELPGIAVLKENN

SEQ ID NO: 28011 - protein, 259 aa, Propionibacterium acnes KPA171202
MSRTPIMAGNWKMNLDHVAATSLVQDLGEALKAAGYDSSKSEAVVIPPFTDIRPVAIIIDGDKLPIAYGAQDISAHDDGAYTGEVSGAMLSKLGCRYVVVGHSERREYHNESDELVNAKAKKVIENGMTPIICCGEALEVRKAGKHVEHTVGQIKADLDGIPAEQVAKLVIAYEPIWAIGTGETATADDAQEVCQAIREAVKELYDAPTAEAVRIQYGGSVKPANVAEIMAKPDVDGALVGGASLKAGDFSKIVTFYEA

SEQ ID NO: 28012 - protein, 293 aa, Zea mays
YLLQLNNKYADSEFWLAFSGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGAMCEPLSVGVHACRRAGLGPETGVLVVGAGPIGLVSLLAARAFCAPRVAVVDVDYHRLAVAIFFGRRTLSCCFSLLAAALAVYVERFRAGVGSWLFLSPYCPGVIFIMFSGAGGYPAPLGMCARGLALFFPLPLFGAAGSGGGLRGRVSVFA

SEQ ID NO: 28013 - protein, 255 aa, Brassica napus
  misc_feature (243)..(243): Xaa can be any naturally occurring amino acid
  unsure (1)..(255): unsure at all Xaa locations
VASTNRGCKAMYVSGGATSTVLKDGMTRAPVVRFASARRASELSTHASGPENFETLAVVFNRSSRFARLQSVMCTLAGKNAYVRFSCSTGDAMGMNMVSKGVQNVLEFLTEDFPDMDVIGISGNFCSDKKPAAVNWIEGRGKSVVCEAVIRGETVNKVLKTSVASLVELNMLKNLTGSAIAGSLGGFNAHASNIVSAVFLATGQDPAQNVESSQCITMMEAINDGKDIHISVTMPSIEVGTVXGGGTQLASQSAC

SEQ ID NO: 28014 - protein, 523 aa, Arabidopsis thaliana
MSGIVHHDCPNSGNPYHECHDQCFKRISSGDVPKKEKKRFGFGKPACSKETPLTSPVRVIAGNRSPLPSYYGKRMDESDESPSFSSSDDSFNANLPTPRSTLHGNETAPGINWLPMSPSFAVYCKKDCFSSRIDHREGEAPILDEMPSKTRLKTPLSPDTRPRKSEHRTRNQGPRSKTPEPRGSYLEPPRSRIPQTQPVPHRSLESAGLKSPQKGETRPHIPQTQPTSFNIGGNYHYAAQASKYHANKADSVYTKDRDKCVILYPDILLSPQENLTSRSITVLMLPQKSRTPLDKQSKEPLQLPVECHSFTPSEIECMKALKIYETGEEMKSMISESYVSVGSYKVRASVSSTLQKILDKHGDIASGSKLQSLRTKSYSLETLAAVVLELQSTPLKKLKQARVLEMLSVVIDAESVKIRAGWLREILNEILEAAHHYDGHETTVVEKEGRERDMLLEREEMKKIQEEVRLKEKEAKDFRKGVMEMAGRLGELKMKRARLEKRLAFLSSKVEKFEGESLLENVF

SEQ ID NO: 28015 - protein, 552 aa, Nostoc sp. PCC 7120
MAKPIEFTLFAPYNKGAALIASFSDWQEIPMKKGDDGYFRTTVELEDGTYQYKFRVQTRSWFFEEDQWVDVTDPYATDIDESSGKDNSIARIKDGEKIVDTYVWQHDDKPLPADHELVIYELHVGDFSGGEDDPYARGKYKHVIEKLDYLCELGINAIELLPVKEYPGDYSWGYNPRYFFATESSYGSTADLKKLVDECHQRGIRIIMDGIYNHSEASSPLTQIDHDYWYHHEPRDPDNNWGPEFNYEHYDENLETYPARKFIGDTVRYWVGEYHLDGIRYDAARQIANYDFMHWIAQEAKKTAGAKPFYNVAEHIPETTSITNLDGPMDGCWHDSFYHTIKAHICGDTFDLENLKDVIDPKRQGFLGATNVVNYLTNHDHDHIMVELGNREIFHDEAFRRAKLGTAILMTAVGVPLIWMGEEFGEYKPKQQDQSKIDWTLLGNDLNRSLFDYHKGLIGLRKNNHALYTENIDFIHENPEAKVLAYSRWNDEGSRVVVVTNFSEDFLAGYHVPNFPSGGTWHEWTGDYDVEAGDDGIITDIGPYEAKVFVWQ

SEQ ID NO: 28016 - protein, 385 aa, Pseudomonas oleovorans
MAIVVVGAGTAGVNAAFWLRQYGYKGEIRIFSRESVAPYQRPPLSKAFLTSEIAESAVPLKPEGFYTNNNITISLNTPIVSIDVGRKIVSSKDGKEYAYEKLILATPASARRLTCEGSELSGVCYLRSMEDAKNLRRKLVESASVVVLGGGVIGLEVASAAVGLGKRVTVIEATPRVMARVVTPAAANLVRARLEAEGIEFKLNAKLTSIKGRNGHVEQCVLESGEEIQADLIVVGIGAIPELELATEAALEVSNGVVVDDQMCTSDTSIYAIGDCAMARNPFWGTMVRLETIHNAVTHAQIVASSICGTSTPAPTPPRFWSDLKGMALQGLGALKDYDKLVVAINNETLELEVLAYKQERLIATETINLPKRQGALAGSIKLPD

SEQ ID NO: 28017 - protein, 476 aa, Bartonella quintana str. Toulouse
MFNKRKFYINGLWDDPSTPHDLHVIDPSTEEVCAVISVASTKDADKAINAAKAAFQNWRTTLPNERLSFVEKILEIYEKRSEDMAKTISMEMGAPIDMALNAQTATGSSHIRNFIKVYKEFTFQDVLVEGNEQSILHYDPIGVVGLITPWNWPMNQVTLKVIPALLAGCTMVLKPSEIAPLSAMLFAEILDEAALPAGVFNLINGDGDNIGSYLTAHPDLEMISFTGSTRAGKDISKNASSTLKRVCLELGGKGANIIFADADTNALQRGVHHCFYNSGQSCNAPTRMLVEQAIYDKAIRIAKDIAEKTKVGPGHQTGNHIGPVVSKQQYDKIQDLIQSGIDEGATLVAGGTGLPIGMERGYYVRPTVFADVKPNMRIFREEIFGPVLSILPFNTENEAVALANDTEYGLTNYIQSQDRNKCRRIAAQVRSGMVEVNGHELPRESYFGGVKFSGRAREGGQWGIKEFLDTKAISYW

SEQ ID NO: 28018 - protein, 180 aa, Spinacia oleracea
MASSVLSSARVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 28019 - protein, 435 aa, Ralstonia metallidurans CH34
MSSAAPTQNVSNGHTLPSYLNADNLGPWGIYLQQVDRVTPYLGSLARWVETLKRPKRAMIVDVPIELDNGTIAHFEGYRVQHNLSRGPGKGGVRFHQDVTLSEVMALSAWMSVKNAAVNVPYGGAKGGIRVDPRTLSHGELERLTRRYTSEINIIIGPSKDIPAPDVNTNAQVMAWMMDTYSMNSGSTATGVVTGKPISLGGSLGRHEATGRGVFVVGSEAARNLGMDVKGARVAVQGFGNVGAVAAKLFHEAGATVVAVQDHRTTLFDPAGLDVPKMMEYASHSGTIEGYRAEVISTEQFWEVDCDILIPAALEGQLTASNAPKIKAKLVIEGANGPTTPEADDILRERNILVCPDVIANAGGVTVSYFEWVQDFSSFFWTEEEINERLVRIMQEAFRAIWQVAQDNKVTLRTAAFIVACTRILQAREMRGLYP

SEQ ID NO: 28020 - protein, 473 aa, Bartonella quintana str. Toulouse
MKNGKQMKSKGSKPVSQFLKNLRGVDNWEQVSQWLALRNVEDIECITPDQAGVARGKMMLSKKFISETSLALPSAVFMATISGDYPEDGHGFEYPKTDGDLRLEPDLSTLSIVPWEEAPTAQVICDLVYQNGQGVDYTPRNVLRKVINFYTKMGLKPVVSPEIEFYLVEKNPDPDYPLVPPIGRSGRSIGGGQGYSIAGVNEFDDLIDDIYHFSEAQGLEIDTLIHEEGAGQFEINLRHGDPIELADQVFIFKRTIREVALKHNMYATFMAKPIQGQPGSAMHIHQSVVDKKTGMNIFTQEDGKENIRFRHFIGGLQRHIPGVLVMLAPYVNSYRRLVPDLSAPVNLRWGYDNRTTAFRVPRSSPQGRRVENRLPSSDANPYLALAASLACGLIGLQQELEPDEPTTKNVNTDNIELPRGLIEAVNLFEQDTAIRAILGDVFVSTYAAIKRQEFETFMEVISPWEREYLLLNV

SEQ ID NO: 28021 - protein, 353 aa, Debaryomyces hansenii CBS767
MATKQNIGVFTNPKHDLYVSEIETPDVGDLSEEEVLVHVRSTGICGSDVHFQKHGCIGPTMVVEDEHILGHESAGEVLAVGNKVKILKVGDKVALEPGVPCHTCKPCLTGKYNGCENVEFYSTPPVHGFLRRYIKHPAAFCHKINLLTYAQGALLEPLSVVFCGIRHINLILGQSVLVFGAGPIGFATAKAAEAAGAYPIMVTDIEQSKLDFIKKEIPSAITALVNGSLKENVAKVTDDGINNFDVAIECTGVEQSLELATHALDFGAKLHIIGVGKDHQKFPFMLLSVKEINITFQYRYANTWPTIIKLVEAGIIKLDNLVTHRFKLEDAVDAFKLAGNPKSGAMKILIEDS

SEQ ID NO: 28022 - protein, 260 aa, Haloarcula marismortui ATCC 43049
MADDRHGIDDIDGETLDAVAEALRTAETAVALTGAGVSTASGIPSFRGDDGIWERHDPADFHRRRLDADPAGFWADRLSLREAIYGDIDPEPNAAHEALAALEADGHLDAVLTQNIDGLHDAAGTDRVVELHGTHRRVVCDDCGHRRDAEVVFEQAAESSDLPPRCDCGGVYRPDVVLFGEPMPDVAMNEAQRLARDSDVFLAVGSSLSVQPASLLPKIAAEGDSTLVVVNYEETPRDASAAHVLRADVTQVLPAIVERL

SEQ ID NO: 28023 - protein, 570 aa, Bacillus subtilis subsp. subtilis str. 168
MQELKGIGASAGIAIAKAYRLEEPDLTVEKKNISDSEAEVSRFDEAIARSKEELEKIKEHALKELGQDKADIFSAHLLVLSDPELLNPVKEKISTDSVNAEFALKETSSMFVTMFESMDNEYMKERAADIRDVTKRVTGHLLGVEIPNPSMISEEVIIVAEDLTPSDTAQLNREFVKGFTTDIGGRTSHSAIMARSLEIPAVVGTKAATGTIQNGVTVIVDGINGDVIIDPSAETVKEYEEKHNAYLAQKAEWAKLVNEPTVSKDGHHVELAANIGTPDDVKGVLENGGEAVGLYRTEFLYMGRDQLPTEDEQFDAYKTVLERMEGKSVVVRTLDIGGDKELPYLQLPKEMNPFLGYRAIRLCLEEQEIFRTQLRALLRASTYGNLKIMFPMIATVNEFKEAKAILLEEKEKLVKAGQAVSDDIEVGMMVEIPSTAVIADQFAKEVDFFSIGTNDLIQYTMAADRMNERVSYLYQPYNPAILRLITLVIEAAHKEGKWVGMCGEMAGDEIAIPILLGLGLDEFSMSATSILPARTQISKLSKQEAESFKEKILSMSTTEEVVAFVKETFK

SEQ ID NO: 28024 - protein, 433 aa, Borrelia burgdorferi
MGFHIYEIKARQIIDSRGNPTVEADVILEDGTYGRAAVPSGASTGINEAVELRDGDKSVYMGKGVLKAIENIKNIIAPELEGMSALNQVAIDRKMLELDGTPTKEKLGANAILAVSMATAKAAAKYLGLRPYQYLGAYKANILPTPMCNIINGGAHSDNSVDFQEFMIMPIGAKTFSEAIRMAAEVFHTLKGILSGKGYATSVGDEGGFAPNLKSNEEACEVIIEAIKKAGYEPGKDIAIALDPATSELYDPKTKKYVLKWSTKEKLTSEQMVEYWAKWVEKYPIISIEDGMAEEDWDGWKKLTDKIGNKIQLVGDDLFVTNTSFLKKGIEMGVANSILIKVNQIGTLTETFEAVEMAKKAGYTAIVSHRSGETEDTTIADLVVALGTGQTKTGSLSRTDRIAKYNQLIRIEEELETTAEYHGKSVFYSIKQK

SEQ ID NO: 28025 - protein, 332 aa, Ralstonia metallidurans CH34
MDATARRFGIDFQWDHFDFSSYAYYERHGKMLPDDWFDTLVKYDAIYFGAVGWPAKIADHVSLWGSLLQFRRSFDQYVNLRPVRLMPGIKSPLADRKPGDIDFYVVRENTEGEYSSIGGRMFPGTEREIVMQETVMSRHGVDRILKFAFELAQKRPKKHLTSATKSNGISITMPYWDERVEAMAANYPGMKVDKYHIDILTAHFVQHPDWFDVVVASNLFGDILSDLGPACTGTIGVAPSGNINPDKVYPSLFEPVHGSAPDIAGQGIANPIGQIWCGAMMLEHLGHAEAGAAVLAAIEQVLAAGPGHAPLTRDIGGTASTADLGQAIAEAL

SEQ ID NO: 28026 - protein, 450 aa, Frankia sp. EAN1pec
MRVSAVPWSRIHVRPGPSGPERPPNSLVPAWPCRSAGHRSPGLRPGLPAPGRRRRCAGAVPPELRRRPNRRRTPPSGRHHRTGRHHRTAQHHWTTGYRRRVRTTADPVRRSRPKIPSEEPVRTTRKRRHMMSDGLTAPAPAPGASPSGPVAPADGAERHAGTARVKRGMAEMLKGGVIMDVVTPEQARIAEEAGAVAVMALERVPADIRAQGGVARMSDPDMISGIIEAVSIPVMAKARIGHFVEAQIIQALGVDYVDESEVLTPADPNHHIDKWGFTVPFVCGATNLGEALRRISEGAAMIRSKGEAGTGEVSNAVVHMRTIRSEIARLSGLPSEELYAAAKELRAPVELVTEVARLGRLPVVLFTAGGIATPADAALMMQLGADGVFVGSGIFKSGDPARRARAIVEATTMYNDPGVLAKVSRGLGEAMVGINVGELPPEARFAARGW

SEQ ID NO: 28027 - protein, 151 aa, Ashbya gossypii ATCC 10895
MSDERTFIAIKPDGVQRGLISKILSRFESRGYKLVGIKLVTPTENLLKQHYAEHVEKPFFPKMLAYMTSGPILATVWEGKDVVKQGRVILGATNPLNSAPGTIRGDFALDMGRNVCHGSDSVESAQREIDLWFKKEELVDWKLNQLSWIYE

SEQ ID NO: 28028 - protein, 273 aa, Leuconostoc mesenteroides subsp. mesenteroides ATCC 8293
MKTLTEDILYRVIKKRAKDSHKGTYGRVLIIGGTAQFGGAVIMNALAAVNSGAGLVTVATDPSNFTALHSHLPEAMVVDFNEDLTEYIKKSDVVLIGSGLGDRIDLVQHTFYAILPRQILIVDGSALTLVAEHKLKWPKSRLVLTPHQMEWQRLSGVTINEQAFEAFNMLAQQRMNVEPILVLKQHHTQIYTNDCAFEIPVGGPYQATGGMGDTLAGMIAGFTAQFMLSFSEAILAAVYAHSAIADELAETRYITLPTEISASIPEFMHRYSR

SEQ ID NO: 28029 - protein, 484 aa, Synechococcus sp. WH 8102
MAGGFTEQSQRFRPSSKEEHVVQKAEEHFERTLITIRGELAGSVAALEHPSDDEALNYGEIFLRDNVPVMIYLLLKRRFSIVRQFLTVCLDLQSTSVQTRGVFPTSFVEENEELVADYGQRSIGRITSVDASLWWPILCWIYVKRSGDTEFGRSAEVQRGLQLLLDLVLHPSFEGTPVLFVPDCAFMIDRPMDVWGAPLEVEVLLFAALRSSIELMELCQRHESSVLLEERLRLSRRWMHDLRQYLLKHYWVTSKTMQVLRRRPTEQYGDNQYQNEFNVQPQVIPDWLQDWLDNRGGYLIGNMRTGRPDFRFYSLGNSLACLFGLLTAPQQRALFRLVQHNRQHLMAQMPMRICHPPMEGVEWENKTGSDPKNWPWSYHNGGHWPSLLWYFGGSILLHERIHPHADMLLMTQMKTLVEECYWSQLNQLPRQQWAEYFDGPTGTWVGQQSRTYQTWTIVGFLLLHHFLRVEPNDVLMLHLDAGLS

SEQ ID NO: 28030 - protein, 796 aa, Aspergillus nidulans FGSC A4
MPFSHDEHNVLPKTPGLSPTGSSPYDIAQQWTTQVDAQLRSDAPDLSCLLHQDSWWRDMLAFDWDLHTVRGRDKIRDYIISHQPRAHVKRITLVILPGQEPMAEKPQEGTTWVRAMFDFETYCGSGSGVVYLTCHASEWKAFVVYTALQEISGFEARIGRKRPEGTVESMPGGIAQGTWVERRLKQVEFAKEEPTVLVLGAGQSGLNISARLQSMGISCLAIDQNKRVGDSWRNRYRTLVAHDHVNVTHLAYLPFPKTWPKYSSKDKLADWFEAYATIMELNIWLESTVQSAEYDEGQQCWTVTIRRKDQQRVVRPSHVIWCGGQFGVEKVPSLPTLSVFRGTVYHSKYHRDAGLLSPSGKKVIVVGTGNSGHDIAQDFHEHGAEVTLLQRGGTYVLGQAGLPLLPENAFVDDELLPLDVVDLLSESLPWPIAFELLRQNTREILTADRDLLDGLEKSGFQLDYGPNRQGIIGLYVERGGGYYIDFGCSQLIIDGKIRLQQCAKGIFGFDEHHLLLGDGSRLEADIVVLATGYHSSLEAVRKVLGPEVARRCNKQVWGLDAAGEFNTVWRPSGHPGLWFMGGNLAQSRVYSSKEDGSKVQYVAEGTPLEDIIGFMKRDGVVIVRQLVSPADIDQAYEEIRPCLEQRPRWNGSFFPKETQRTPNLIAISPTYTRTQMMNPLFHQLCNHFLTTRSWNWWGDEWSETVSRPYISATSALRVGPGAKAQPLHRDDYVSHNYIVESPMFNYRQQVSITMIVAGCKVTKENGGTQFIPGSHLWHVPTNYLGPEQFVDMLLVP

SEQ ID NO: 28031 - protein, 865 aa, Lotus japonicus
MWSHHGFHLPQNCAAKEQIWGLVATVRHHRNHLFLLRSAVFHSIIFSFSYVVCNGNGSLTLEDSSWKSGNYRCSSKKYEQCTLSQGMTVHDGTFEAGFFHFENPQHHYFGVWYKSISPRTIVWVANRDAPLRNSTAPTLKVTHKGSILIRDGAKGVIWSTNTSRAKEQPFMQLLDSGNLVAKDGDKGENVIWESFNYPGDTFLAGMKIKSNLAIGPTSYLTSWRNSEDPASGEFSYHIDIRGFPQLVVTKGAAITLRAGPWTGNKFSGAFGQVLQKILTFFMQFTDQEISLEYETVNRSIITREVITPLGTIQRLLWSVRNQSWEIIATRPVDQCADYVFCGANSLCDTSKNPICDCLEGFMPQFQAKWNSLDWAGGCVSMEKLSCQNGDGFMKHTGVKLPDTSSSWFGKNMSLDECRTLCLQNCSCTAYAGLDNDVDRSVCLIWFGDILDMSKHPDPDQGQEIYIRVVASKLDRTRNKKSINTKKLAGSLVVIIAFVIFITILGLAISTCIQRKKNKRGDEGEIGIINHWKDKRGDEDIDLATIFDFSTISSATNHFSLSNKLGEGGFGPVYKGLLANGQEIAVKRLSNTSGQGMEEFKNEIKLIARLQHRNLVKLFGCSVHQDENSHANKKMKILLDSTRSKLVDWNKRLQIIDGIARGLLYLHQDSRLRIIHRDLKTSNILLDDEMNPKISDFGLARIFIGDQVEARTKRVMGTYGYMPPEYAVHGSFSIKSDVFSFGVIVLEIISGKKIGRFYDPHHHLNLLSHAWRLWIEERPLELVDELLDDPVIPTEILRYIHVALLCVQRRPENRPDMLSIVLMLNGEKELPKPRLPAFYTGKHDPIWLGSPSRCSTSITISLLEAR

SEQ ID NO: 28032 - protein, 469 aa, Oryza sativa (japonica cultivar-group)
MHMMRRLKSIASGRSSVSDPGGDSGTKRPKFDQDGAGDIVIEPHLTDDKPMRVDQESSSSHRDAEASTSTSKNPGRTEEAGADILPKEMNEMTISDDKVDGHNDKESEGVIVNANGTETGQIIVTSIGGQNGKPKQKVSYMAERVVGTGSFGVVFQAKCLETGETVAIKKVLQDKRYKNRELQTMQLLDHPNVVQLKHHFFSTTERGEVYLNLVLEYVSETVYRVAKYYNRMNQRVPILHVKLYAYQMCRALAYIHRVVGVCHRDIKPQNLLVNPHTHQLKLCDFGSAKKLVPGEPNISYICSRYYRAPELIFGATEYTTAIDIWSVGCVLAELLIGQPLFPGESGVDQLVEIIKILGTPTREEIRCMNPNYSEFKFPQIKAHPWHKLFGKRMPPEAVDLVSRLLQYSPNLRCTAVDACAHPFFDELRDPKTCLSNGRSLPPLFDFSAAELEGLPVELVHRIIPEHMRK

SEQ ID NO: 28033 - protein, 142 aa, Propionibacterium acnes KPA171202
MLGLMSDEERTLVLLKPDAVKRRLMGEIIGRYEAKGLTVRAMELSTIDTKIARKHYAEHVGRDYYAALEEFITSGPLVAMVLEGRRAISVVRAMNGTTDCAEALPGTIRGDFGTEKNHNLVHASDCLESAEREIGLWFPHLV

SEQ ID NO: 28034 - protein, 524 aa, Oryza sativa (japonica cultivar-group)
MATRVKDVARRSSKKYVDEALYRRLFRRGSTPQAVREEVDGFLDSRKRAFKWEVGVCVRRLRKQALYRPALKLSEVMARRGMNPTVSDQAIRLDLVAKSRGIAAAEKYFLDLPETSKTHLTYGALLNCYCKDLMTEKAEALMGKMKELNFAFTAMCYNSLMTLYTKVNQHEKVPSVIQDMKADDVLPDIYTYNVWMRALAARVDIKGVERVIEEMKRDGRVTPDWTTYSNLASIYVDAGLFEKAEAALKELEKWNTSNDLEAYQFLITLYARTQNLVEVHRVWRSLKRNQPRRANMSYLNMIQALANLKDLPGAEACFKEWEAQYINPPKTNTKAPGTAETSSNESDVKATKDKGTDGELKHPKYDIRVANAMIKAYITEGMFDKAVAVKKRAKMRGGRLNAKTWEIFMEHYLKEGDLKMVHWCADRAIKKGHSAGRIWVPPHEVTETLMDYFEKNKDVDGAEKFVEVLKKVQKDLGTVVFEPLVRTYAAAGKKLPGMRHRLKIENVEVSEETAKLLDSVCIDQ

SEQ ID NO: 28035 - protein, 388 aa, Mycobacterium avium 104
MTDRVSLRAGIPPFYVMDVWLAAAERQRSHGDLVNLSAGQPSVGAPEPVRAAAAAAVHSNELGYSVSLGTPELRAAIAADYRRQHGLEVEPDAVVITTGSSGGFLLTFLACFDVGDRVAVASPGYPCYRNILSALGCEVVEIPCGPQTRFQPTAAMLAELDPPVQGVIVASPANPTGTVIAPEELAAIASWCEASGARLVSDEVYHGLVYEGAPPTSCAWQTSRNAVVVNSFSKYYAMTGWRLGWLLVPVELRRAVECLTGNFTICPPVLSQLAAVAAFTPEATAEADGHLHHYAKNRALLLDGLRGIGITRLAPTDGAFYVYADVSDFTDNSMEFCSKLLEQTGVAIAPGIDFDTTRGNSFVRLSFAGPTTDIEEAVRRLGSWLRAR

SEQ ID NO: 28036 - protein, 1512 aa, Coccidioides immitis RS
MANAPPPFGVSALAADTGANFQDTVSSQTEVNGSEFQAKAYGDETKPSTASSVTAGKISELDDGDTGITKDQEHEIVDLARRVSRLSRRSSVYDHDNVVNPFLDAEANPELNPGDKQFKPRKWLKTILQIQSRDPERFPKRTAGVSFRNMNVYGYGTAADYQADVGNTPLKAVGGIKQLLGLGKKVRIDILRNFEGLVKSGEMLVVLGRPGSGCSTFLKTLAGETHGLYLDEGNDIQYQGVSWNQMHKNFRGEVIYQAETETHFPQMTAGDTLYFAARARAPVNRLPGVTRQQYAEHMRDVVMSMLSLSHTMNTKVGNEYIRGVSGGERKRISIAETTLSGSPLQCWDNSTRGLDSSTALEFVKSLRLSTQYSGTTAIVAIYQAGQAIYDIFDKAIVLYEGRQIYFGNAVRAKHYFIEMGFECPDRQTTADFLTSITNPAERRIRPGFQNRVPQTPDEFAERWRKSPERQALLAEIEEYNAEFPLDGAQLEKFQQSRQAEKSKAVRKSSPYTLSFWQQVQLCIWRGFVRLKGDMSMTLTSVIGNIVLSLIISSVFYNQPDNTSSFFGRGSLLFFAILMNGFASSLEILTLWHQRPIVEKHDKYALYHPSAEAISSMIVDLPSKAIVAIVFNLILYFMVNLRRTPGHFFVFFLFSISTTLTMSNIFRTIGAISRTLAQALVPSSIFMLALVIYTGFTIPVRDMRPWFKWISYLNPIQYAFESLMINEFHDRRFPCAMFVPMGPSYANATGDSIICGATGARPGEDFVDGDTFLNITYGYYASHLWRNLGIIFAFFFFFLVTYIGATELIKAKPSKGEILVFPRGKVPSYLKSKKNSDDPESAETVNQKQKLESTGHDQVGAIVKQTSIFHWQDVCYDIKIKNQPRRILNNIDGWVKPGTLTALMGVSGAGKTTLLDVLADRVTMGVVTGEMLVDGRIRDDSFQRKTGYVQQQDLHLEISTVREALVFSALLRQPATTPRAEKIAYVEEVIKMLGMEEYADAVVGVLGEGLNVEQRKRLTIGVEIAAKPDLLLFFDEPTSGLDSQTAWSICTLMRKLADHGQAILCTIHQPSAMLMQEFDRLLFLAAGGKTVYFGELGKNMSTLIDYFENHGSPKCPPNANPAEWMLEVIGAAPGSHTDKDWSQVWNNSPERAEVRRQLAEMKAELSEKPQAPRSAGYGEFAMPFWQQYLVVQHRMFQQYWRSPEYIYSKLCLCIVPTLFIGFTFYKEPTSLQGLQNQMFAIFMFLILFPNLVQQMMPYFVTQRSLYEVRERPSKAYSWKAFMLSSVLVELPWNTLMAVPAFFCWYYPIGFHRNAIASDAVTERSGTMFLLVWIFLMFSSTFSSMIIAGVELAETGGNLAQLLFSLTLIFCGVLATPQAMPRFWIFMYRLSPFTYYVSAVLSTGVANTNVNCSAREFLRLIPPAGQTCGQYLHDYMLLAGGALLNPESTSACDFCPVKDTNTFLEQVNIRYSERWRNIGILFVYIFVNVIGAIGFYWLLRVPKTGLFKKKAKKD

SEQ ID NO: 28037 - protein, 236 aa, Nostoc sp. PCC 7120
MTVTADPVTLMKQEVGKAAAALVKSGSIVGLGTGSTTAYTIQYLGDRLKSGELTDIVGIPTSFQSEVLSKQYGVPLTTLDAVDHIDIAIDGADEVDPHKNLIKGGGAAHTREKVVDYLANQFIVVVDSGKLVDRLGSVFAVPVEVIPMAITPVTNAIKQLGGKPELRMGVKKAGPVITDQGNFVLDVRFDSIDDPVNLEKILNNIPGVLENGIFVNCADIVLVGEVKDGQPLVRRL

SEQ ID NO: 28038 - protein, 274 aa, Lactobacillus reuteri
PTAASFGDPAHLLIGFVPIAIILLFNAFARGFMKSIAILLGILISSFIAGALGFVSLKPVSEAAWFHAPQLFFFGVPRFDMSAMITMILVSLTTMIESTGVFFALSDITGRQLTTNDLERGYRAEGIAAILGGLFNTFPYSTFSENVGVLKMSGVKSRQPVYYAAFLLLLLGLSPKVGALATVIPEPVLGGAMIVMFGMVGVQGVQILHKVDFSNNANLLSASVSIGLGLGITMYPQLFQHMPTEFQIILGNGIVVTSLSAVLLNLLFNHRWAN

SEQ ID NO: 28039 - protein, 218 aa, Photobacterium profundum SS9
MADIKQLFANNLSWSKSIKEETPEFFSHLAESQQPQYLWIGCSDSRVPAERLTGLDSGELFVHRNVANQVIHTDLNCLSVIQYAVDVLKVKHIIVCGHYGCGGVTAAIENPPLGLINNWLLHIRDLYLKHRSELGTLPREDWDNKLCEINVASQVYNLGNSTVMQQAWERGQQVKIHGWIYGMNNGVLRDLGVTATSRESLEIAYQAAMSAILPPKEL

SEQ ID NO: 28040 - protein, 416 aa, Rhizopus niveus
MSLSNKLSIRDLDLKNKRVLIRVDFNVPMKDGAITNNNRIVQALPTVKYALDNGASAVILMSHLGRPNGEAVAKYSLKPVAAEVEKLLGKPVEFLNDCVGPDVEKACQSATGGKVILLENLRFHIEEEGSAKVRWSKVKADAEAVKKFRASLTALADIYVNDAFGTAHRAHSSMVGVDLSQRAAGFLMQKELEYFAKALENPARPFLAILGGAKVSDKIQLIENMLDKVNALIVCGGMAFTFKKTLDNVKIGKSLFDEAGSKLVRNLVKKAAEKNVKLVFPVDFVTADKFAPDANTGYATDADGIPDEWEGLDCGKKSSELFREEILKSKTIVWNGPSGVFEFDAFANGTKSVLNAVIEATKEGATTIIGGGDTATAALKWGAEGKVSHISTGGGASLELLEGKELPGVTALSSKN

SEQ ID NO: 28041 - protein, 614 aa, Ehrlichia canis str. Jake
MLSQGDYQSICNLAIIAHVDHGKTTLLDSMLKQSGTFRENQDVAERVMDNNDLERERGITILAKCTSVIWQGKKINIIDTPGHADFGGEVERVLSMADGVLLLVDASEGPMPQTKFVLSKALKAGLLPIVIINKVDRPDSRIDEVLDEVYELFINLDATSEQLDFPILYASGRNGWCIKNLSDNRESLVPLFEAIVQYVKPVAYDANAPFSMLLTLLESDKFLGRILTGKIYTGTARVNDGVKVLSLSGEVVEYGKLTKLLAFSGLKRVPVKEAKAGDIIAVAGLEKASVSDSILDSSINFPIASTPVDPPTMAVTIGVNDSPFAGTEGVKLTSTVIKARLIAEAETNVAITVKETGQGDAYEVGGRGELQLGVLIETMRREGFELSVSRPRVLLRKDDKGQVLEPIEEVVIDVDEAYSGVIMEKLSFRKGDMRDLRPSGKDRVRMVFLVPSRGLIGYQGEFLTDSHGTGIMNRLFHSYAPHKGNIPTRNNGVLISTDKGDAVAYAIFNLQDRGVMFIKPQDKVYCGMIVGLHNRENDIDVNVLKGKQLTNIRAAGSDEAVRLVPPKIMTLEEMIAFINDDELVECTPKSVRLRKKYLDPNERKRASRANKNMV

SEQ ID NO: 28042 - protein, 331 aa, Triticum aestivum
MGDGRGGGSNRPAWLQQYELVGKIGEGTYGLVFLARLKPTHPQAAGRRGSPIAIKKFKQSKEGDGVSPTAIREIMLLREINHENVVKLVNVHINHADVSLYLAFDYAEHDLYEVIRHHREKLNLSINQYTVKSLLWQLLNGLNYLHSNWPDERGHKAPRVRVMGEGEEHGIIKIADFGLARIYQAPLKPLSDNGVVVTIWYRAPELLLGAKHYTSAVDMWAVGCIFAELLTLKPLFQGVEAKATPNPFQLDQLDKIFKVLGHPTVEKWPTLANLPCWQNDQQHIQGHKYENTGLHTIVHLPQKGPAFDLLSRMLEYDPRKRITAAQALEHE

SEQ ID NO: 28043 - protein, 167 aa, Ehrlichia canis str. Jake
MICKKKFLSPIINLFHSIIINCKGMYITLRYMFKPKVTLNYPLEKGPLSTRFRGEHALRKYKNGEERCIACKLCEAICPAQAITIEAQERDDGSRRTVRYDIDMTKCIYCGFCQEACPVDAIVEGPNFEYATETREELMYNKSKLLHNGQVWEEAIDFRIKKNSQFY

SEQ ID NO: 28044 - protein, 500 aa, Oryza sativa (japonica cultivar-group)
MENSQVWLLWGALSVAVLFYLSTLRRRHAGGKPLPPGPTPLPLIGNLHLAGGTSFHHKLRDLARVHGPVMTLKLGLATNVVISSREAAIEAYTKYDRHLAARATPDTFRACGFADRSMVFIPSSDPRWKALRGIQGSHVFTPRGLAAVRPIRERKVGDLMAYLRAHAGEEVLLGQAMHTGLLNLVSFSYFSIDIVDMGSQMARDLREVVDDIISVVGKPNISDFYPFLRPLDLQGLRRWTTKRFNRVFSIMGDIIDRRLAHIRDNKPSHNDFLDSLLELMAAGKIDRVNVLDMLFEAFVAGADTMALTLEWVMAELLKNPGVMAKARAELRDVLGDKEVVEEADAARLPYLQAVLKEAMRLHPVGALLLPHFAVEDGVEVGGYAVPKGSTVLFNAWAIMRDPAAWERPDEFVPERFVERAPLLDFRGKDAEFMPFGSGRRLCPGLPLAERVMPFILASMLHTFEWKLPGGMTAEDVDVSEKFKSANVLAVPLKAVPVLIK

SEQ ID NO: 28045 - protein, 338 aa, Oryza sativa (japonica cultivar-group)
GGRGGRRRQQQQTAALAEEESGMAGGGGGGNRLDLPVVDLASSDPRAAAESIRKACVESGFFYVVNHGVEEGLLKRLFAESSKFFELPMEEKIALRRNSNHRGYTPPYAEKLDPSSKFEGDLKESFYIGPIGDEGLQNDANQWPSEERLPSRRETIKMYHASALSTGKRILSLIALSLNLDAEFFENIGAFSCPSAFLRLLHYPGEVDDSDDGNYGASAHSDYGMITLLATDGTPGLQICREKNRNPQLWEDVHHIDGALIVNIGDLLERWTNCIYRSTVHRVVAVGKERYSAAFFLDPNPDLVVQCLESCCSESCPPRFSPIKSGDYLKERLSATYK

SEQ ID NO: 28046 - protein, 389 aa, Nostoc sp. PCC 7120
MKAVCWYGANEVRVETVPDPKILNPRDAIIKITSTAICGSDLHIYGGYIPTVQQGDIIGHEFMGEVVEVGSRVDNLKIGDRVVVPSTIGCGRCHYCEHDMWSLCDNSNPNGWLEEKLYGNITSAIYGYSHLLGGYAGAQAEYIRVPFADVGVVKVPPDLPDEMLLFISDAIPTGYMGAEMCDIQPGDTVAVWGCGAVGQFAMISAYMMGAEKVIAIDRFPERLEMAKKYAKAEVINYEEVNAGEALKEMTGGRGPDACIDAVGLEAHGVGLEDFYDQTKQKLKLESDRPHVLREMMVACRKGGTLSIMGVYGGFVDKIPFGAAFNKGLTFRMGQMHGQKYMNLLLQLILDGKLDPSFVVSHQLPLEQAPLGYHIFQQKKDNCIKVVLKP

SEQ ID NO: 28047 - protein, 300 aa, Synechococcus sp. CC9605
MLQVAPNDGADAGARLAIRLLQDAAERGDLDPWDVDVIAVIDGFLDQLRQRIEVPGQVAAALAGRGGSYERDLADSSEAFLAASVLVGLKAEMLETSMLPPPPEVEDHFDADFDGQGWLDPAFDLPRRPERHLQRRPVAPPPLRRPVTLGELIEQLESIAEQLESDELEARRRKRQKRYSNREAIAQVAGLAHREKLPETTAALGVFLNGWETALDWVGFDQLVDQWEVAAAADLDRDRVGVFWALLFLSSQGRVELEQEGWLHGPLRLKFIPASGTATQLPIRSLQVPDPSPTRTVVAA

SEQ ID NO: 28048 - protein, 389 aa, Nostoc sp. PCC 7120
MKAVCWHGTNDVRVETVPDPKILNPRDAIIKITSTAICGSDLHIYNGYIPTMQSGDILGHEFMGEVVELGSAVKNVKVGDRVVVPFTISCGSCFFCQRDLWSLCDNSNPNAWLVELQMGHSPAGLFGYSHLFGGYAGGQAEYARVPFADVGLLKIPDNLPDEQVLFLTDIFPTGYMAAENCNIKPGDIVAVWGCGPVGQFAIKSAYMLGAERVIAFDRIPERLQMAKEQCNAEVLNYEEVNIGEALKEMTGGRGPDACIDAVGMEAHGTDLMAFYDQVKQAVRLETDRPTALRQVIVSAAKGGHVSLAGVYGGFLDKIPMGSAMNKGLTFKMGQTHVHKYLKPLLERIQNGEIDPSFVITHTIPLEQAPHGYEIFKHKKDNCIKVVLKP

SEQ ID NO: 28049 - protein, 412 aa, Terrabacter sp. DBF63
MTDPRTVVVVGASVAGVRTAQSLRTEGFGGRIVLVGDEPDLPYDKPPLSKQFLAGCWSVERIALLTAEAAAAVGIELRLGVAAQRLDVAGRQVVLIDGSTIDYDAAVLATGAAARPAPWSATSGVHVLRSMADARALRDDLEVDRPVVIIGGGFIGAEVAATAHALGREVTVVDPLSAPIGRVVGREVGELFVDLHTRHGVTTKFGVGVESVEGEAGDLTVQLTDGSQLAAGTVVVGIGAVPNDGWLAGSGLLVDDGVVCDEHCRAVDAADVYAVGDVLRWFHPGHGEHVRVEHWTNAVESAAVVAHNIAHPEELRSHCPVEYVWSDQYDWKIQIVGRPVGATRHTLVGDLTSAHPRGAAVYTDDSGDLRGAVAVNWPKALLVCRRAVGAGASFDDVVAQLDRLSAAGAAPA

SEQ ID NO: 28050 - protein, 392 aa, Synechococcus sp. CC9605
MKAMILAAGKGTRVQPITHVIPKPMIPILQKPVMEFLLELLKEHGFTEVMVNVSHLAEEIENYFRDGQRFGVEIAYSFEGRIEDGELIGSALGSAGGLKKIQDFQHFFDDTFVVLCGDALIDLDLSEAVRLHKDKGAIASLVTKRVPKDQVSSYGVVVTDDQNRISSFQEKPSVNEALSDTINTGIYIFEPEVFEHIPSGQSFDIGSDLFPKLAELGAPFYAIPMDFEWVDIGKVPDYWQAIRSVLMGDVRQVGIPGKEVRPGVYTGLNVAANWDKINVSGPVYVGGMTKIEDGATIVGPTMIGPSCHICEGATVDNSIIFDYSRIGPGVQLLEKLVFGRYCVGKDGDHFDLQEASLDWLITDARRQDLVEPSPQQKAMAELLGTDLTQAAS

SEQ ID NO: 28051 - protein, 592 aa, Candida albicans
MPTIPVDKEDLFKLLGRSYTTEEFDELCFQFGIELDEDTTEDVKGTDERPQLKIEVPANRYDMLCIEGIAQALNEFLGNTSAPNYKLSPSKPEISLTIKESTYPIRQYAASAILRNVNLDERAYDSFIALQDKLHANLCRNRTLVAIGTHDLDTLTPPFTYEALAPKDIVFKPLNQTKEINGEELMEFYEKDKNIGKFLHIIKDSPVYPVMLDANRTVASLPPIINSDHSKITLNTKNVWIDVTGTDRTKTEIVINQLVAMFSRYCKEPFEIEPVQIISEHNNETRVCPNITPRTAKAEISYINSCVGLNYSGEEISKLLKKMSLDATPSTEERDILDVKIPITRSDILHQCDIMEDVAIGYGYDNLKKTKPQAESLVAAPLPVNKVADILRLASSQAGYLEVMPLTLSSHDENFAWLKQKDDGTKAVKLENPKTIEYQVVRTTLLPGILKTVKENRKHSLPIKVFECGDIVLKNPELERGAFNQRNWAALYVGKTSGFEMVQGLLGKIMQTMRTPWLENPSKDQRRGYWIEEDKENTTFFPGRGAKIYFRNADNAEAKAIGSIGVLHPEVMNNFDIPYAASSVEINAEVFL

SEQ ID NO: 28052 - protein, 215 aa, Synechococcus sp. CC9605
MFGFLKQVGDYTRDAVDAARNLAQGFSVTFDHMQRRPVTVQYPYEKLIPSERYRGRIHYEFDKCIACEVCVRVCPINLPVVDWVMNKATKKKELRNYSIDFGVCIFCGNCVEYCPTNCLSMTEEYELAAFDRHSLNYDNVALGRLPTSVTTDPSVVPLRELAYLPAGEMDPHGVASDRPRAGQLPAQVLETLTPPAKPTAKNDGQSSSEAKEGDA

SEQ ID NO: 28053 - protein, 301 aa, Frankia sp. EAN1pec
MALDPAALRFLEAVRDIPQPYEMALAEFRRAGEDLVRTSEPEPITKVDEFIIPGGDGQELRLRCYVPAHEGPRPVVVWLHGGSFIRGSLDMFDAIRRSFANGTGCIVLAVDQRLSPEAQFPAPLEDAYAAIRWAADNADSLGGDPNRLGVGGESSGGNLATAVTLLARKRGAPRLAFQVLVTPLVDATVGSVSAREYGEGYVLTRQQLIWAYEQYAPGVSRVDPLLSPLHEPRLDGLPPAVVLTVEYDPVRDEGELYARRLAAEGVPVSSARIDGFLHHFPGSQAVPTLVRLTCGLLELLE

SEQ ID NO: 28054 - protein, 221 aa, Zea mays
MGEEASCNATGAMQAATNARPAKENGRAPAVAEVVAQEAAADPRLQGISDAIRVVPHFPKHGIMFNDITTLLLRPRVFKDAVDLFVERYRGMRIDAVAGIEARGFIFGPAVALAIGAKFIPLRKPRKLPGEVISEKYVLEYGTDCLEMHVGAIERPGERVLITDDLVATGGTLCAAIRLLERAEADVVECACLIGLPKFKDFYKLNGKPVYVLVESRESDK

SEQ ID NO: 28055 - protein, 445 aa, Ashbya gossypii ATCC 10895
MVKKVLVLGSGFVAKPVVDVLDSTDGIEVTVGCRTLAKAKALTAGTAASAISVDASDSEGLDAAVGEHDVVVSLIPYIHHADVVRAAIRQRKHVVTTSYISPALRALEPEIKAAGITVMNEIGLDPGIDHLYAVKIIDEVHRAGGKINSFLSYCGGLPAPEDSDNPLGYKFSWSARGLLLALKNQAQFWKDGSKQVVKSEDLMASAEPYFIMPGYAFVCYPNRDSTVFRDLYGIPEAKTVIRGTLRYQGFPEFVKVLVDMGLLKEEPHSAFTQAQPWSAALAAYLGAKSASQEHLVAAIDARTSWKSQADRERIIAGLSWLGLLSDELIAPAGNPLDALCASLEQRMQYEEGERDMVCLQHKFDIEWADGSTETRTATLIDYGRPSGYSSMAATVGYPCAIATRLVLEGAISGPGLIAPYTPEVIEPIMRELKDKYGIYMKEKTT

SEQ ID NO: 28056 - protein, 132 aa, Leuconostoc mesenteroides subsp. mesenteroides ATCC 8293
MIGTEPDFNKQSQNGLIPAVIVDAETKAFLMLGYMNKESYSLTKSTGQTWFWSRERQELWHKGETSGNIQQVVSMTLDCDLDTLLIHVNPAGPACHTNAYSCFFNTIKGEGLADANQATIANKWTDGYFPKE

SEQ ID NO: 28057 - protein, 426 aa, Ashbya gossypii ATCC 10895
MQAISGQLTEFADNEQFYMRQQVQQTHPGQQQPGGLPQMFSPQVNHARLLGQQQQLMHGMEGGQDLQATYLLKQKMEAVNAVFGHQQQGLQPQQAQQQLLASGVLNAPPGVSLVHQGVGGMAPPPGALPPQLPLATGVHGSGLGLAPVPLIHHPNHLLVREVWANNLTAEFASIRRLVDQYNVIALTTEFVGTIVRPIGNFRSKNDYHYQTMRTNIDLLNPVQIGLSLSDAQGNKPDNVPSTWQFNFLFDMSKEMVSPESLDLLKKSGVAFDKHQSIGVNAYDFAQLLVDSGLLLTDEVTWVSFHAAYDFGFLVNILTDASMPNNKEDYEFWVQKFLPSFYDLNVLSKAVHDLKGQRSIPQPQHSLESLADELGIPRFPLFNTTGGQSLLALLAFVRLAKFPVFKLSNGSLDFAQFKNSIYGINKE

SEQ ID NO: 28058 - protein, 195 aa, Leuconostoc mesenteroides subsp. mesenteroides ATCC 8293
MSRTATIKRDTFETQIELTLDLDEQTPIKVDTGIGYIDHMLTLFAKHGRFGLQVDVKGDLQVDSHHTTEDIGIVLGEAFTQALGDKVGIERYGAQFVPMDETLTRAVIDLSGRSYLVLHAELTAPTLGTFETEVVEDFWQGFADQARANVHIEVLYGRNTHHKIESMFKAVGRAMRQAITINPEIKGVNSTKGRI

SEQ ID NO: 28059 - protein, 446 aa, Lactobacillus sakei subsp. sakei 23K
MADFQSDSARTIEPAPKLSHIKAAILGLQHLLAMYSGDVLIPLLVGAALHFNAAQMTYLVSVDIFMCGIATLLQLKRTPLTGIALPVVLGCAVEYVGPLTAIGTNSQLGIDVMYGSIIGAGVFILLISGVVARLRWLFPPIVTGSLITLIGFTLIPVAFQNLGGGDITAKSFGSVPNLIAGFSTIVLILIFSIWGRGFIQQIAILIGIIGGTLVGAAVGLVSLDPVGQASWFKLPELFYFGTPRFEWTSIASMSLAALTTMIESIGVFFALGEIVGRNITSNDLKRGFRAEGLAAILGGLFNTFPYSTFSQNVGIVQLSGIKTKKPVYYSAFFLIFLGLLPKIGAVATIIPTSVLGGAMVVMFGIVGIQGIKMLHKVDLEDNRNLLVATLSIGMGLGIAIHPTLLQALPASVQTILGNGLVVGSLTAVILNLLVNYRSLIEAKHQQ

SEQ ID NO: 28060 - protein, 583 aa, Euphorbia pekinensis
MDSTKSRRPIRHLHHQKRISEEVDDHRCLSPPLKASDALPLPLYLTNAVFFTLFFSVAYYLLHRWRDKIRNSTPLHVVTLSEIAAIVSLIASFIYLLGFFGIGFVQSLIARPSHDTWDLDDADRSYLIDGDHRLVTCSPAKVAPVNSPPPAKMSVPEPIVSPLASEEDEEIVKSVVNGTIPSYSLESKLGDCKRAAEIRREALQRMTGRSLEGLPVEGFDYESILGQCCEMPVGYVQIPVGIAGPLLLDGREYSVPMATTEGCLVASTNRGCKAIHLSGGADSVLLKDGMTRAPVVRFTSVRRAAELKFFLESPENFDSLSVVFNRSSGFAKLLNIQCTLAGRNLYMRFTCFTGDAMGMNMVSKGVQNVLEFLQSDFPDMDVLGISGNYCSDKKPAAVNWIEGRGKWVVCEAIIKEEVVKKVLKTSVAALVELNMVKNLAGSAVAGSLGGFNAHAANIVSAVFIATGQDPAQNVESSHCMTMMEAVNDGKDLHISVTMPSIEVGTVGGGTQLASQSACLNLLGVKGANKESPGANARQLATIVAGSVLAGELSLMSAIAAGQLVKSHLKYNRSSKDVSSFASS

SEQ ID NO: 28061 - protein, 192 aa, Brassica napus
MVRSINPKKAKRKNKKKGEASSSASVPSMPTRVWQPGVDKLEEGEELQCDPSAYNSLHGFHVGWPCLSFDILGDKLGLNRTEFPHTLYMVAGTQAEKAPLNSIGLFKISNVSGKRRDVVPKTVVNGDDAMEDEDDEDEDSDSDEESEDGASTTPIIQVRRVAHHGCVNRIRAMPQNPHICVSWADSGHVQVW

SEQ ID NO: 28062 - protein, 131 aa, Glycine max
  misc_feature (71)..(71): Xaa can be any naturally occurring amino acid
  misc_feature (74)..(74): Xaa can be any naturally occurring amino acid
  misc_feature (83)..(83): Xaa can be any naturally occurring amino acid
  unsure (1)..(131): unsure at all Xaa locations
SSEAEVQDRGDYDFLGLNKDEEDVPYPLEEGIATDFQKVTVWNQSEIKHRLLEMLHRSDRRCSSSREEEGXMDXKRKKMTHDXMRLKENIEDNIDGDHDHHKDEDTNVPVEKVEVVETAHAEEKIGFLGSI

SEQ ID NO: 28063 - protein, 183 aa, Glycine max
  misc_feature (101)..(101): Xaa can be any naturally occurring amino acid
  misc_feature (129)..(129): Xaa can be any naturally occurring amino acid
  unsure (1)..(183): unsure at all Xaa locations
MQGGMRSFLSHGNVIRNAVLQRVRMVNPLLQTIASSRFESVTPARIEEHGFESTTISDILNDKGKGADGSWLWCTTDDTVYDAVKSMTQNNVGALVVVKSXRIIAGIINKAIAGIITERDYLRKIIVQXRSSKSTKVGDIMTEENKLITVTPDTKVLQAMQLMTDNRIRHIPVIDEKGMIGMV

SEQ ID NO: 28064 - protein, 397 aa, Synechococcus sp. CC9605
MVAQQQTGDLRHARTGIELRPGLDGVPATQSAICDIDGEKGLLTYRGYPMQDLAANSSFLETAYLLIWGELPGRDQLAEFEHAVQMHRRVSFRVRDMMKCFPASGHPMDALQSSAASLGLFYSRRAIDDPQYIYDAVVRLIAKIPTMVAAFQLIRKGQDPIQPRDDLAYSANFLYMLTEREPDPLAARIFDRCLMLHAEHSLNASTFSARVTASTLTDPYAVVASAVGTLAGPLHGGANEDVLAMLEQVGSPENAGAFLDEAIAAKRKIMGFGHREYKVKDPRAVILQTLVEEMFASFGHDDLYDVARAIEAEAASRLGPKGIYPNVDFYSGLVYRKLGIPRDLFTPVFAIARVAGWLAHWREQLGANRIFRPSQIYSGSQPRSWMPIEERVSAPAA

SEQ ID NO: 28065 - protein, 456 aa, Issatchenkia orientalis
MSLRNFARSATRAYSTAEPTLKERFAELLPGWQAEVKELKSKHGKTVIGEVLLEQAYGGMRGIKGLVWEGSVLDPVEGIRFRGKTIPDIQKELPKAEGSSEPLPEALFWLLLTGEVPTLAQTKAFSAELASRSALPKHVEDLLDTCPTTLHPMAQFSIAINALESESKFAKAYADGVNKKEYWKYTYEDSIDLLAKLPNVAAKIYRNVFKDGKVAPVNASLDYSHNFANMLGFGDNKEFVELMRLYLSIHSDHEGGNVSAHTTHLVGSALSSPYLSLAAGMNGLAGPLHGRANQEVLEWLVGMKKELGDDIFNKEKIEEYLWKTLNAGRVVPGYGHAVLRKTDPRYTAQREFALKHMPDYDMFKLVSNIYEVAPKVLAEQGKTKNPWPNVDSHSGILLQYYGLTQESYYTVLFGVARAFGVLPQLIIDRGLGMAIERPKSFSTQKYKELVENLNKA

SEQ ID NO: 28066 - protein, 480 aa, Photobacterium profundum SS9
MSKEIKAQVVVLGAGPAGYSAAFRCADLGLETVLIERYSTLGGVCLNVGCIPSKALLHVAKVIEEAKALADHGIVFGEPQTDISKIRLWKEKVVNQLTGGLGGMAKMRKVTVVNGFGKFTGPNSIAVTNNSGEGEETTTINFDNAIIAAGSRPIKLPFIPHEDPRIWDSTDALELNEVPEKLLVMGGGIIGLEMGTVYHALGSKIDVVEMFDQVIPAADKDIVKVYTKRIKSKFNLMLETKVTAVEAREDGIYVSMEGKKAPAEPIRYDAVLVAIGRVPNGQLFDAGVAGIEVDERGFIHVDKQMRTNVPHIHAIGDIVGQPMLAHKGVHEGHVAAEVISGKKHYFDPKVIPSIAYTEPEVAWVGKTEREAKAEGINFETASFPWAASGRAIASDCADGLTKLIFDKDTNRVIGGAIVGTNAGELLGEIGLAIEMGCDAEDIALTVHAHPTLHESIGMAAEIYEGSITDLPNAKAKKKKK

SEQ ID NO: 28067 - protein, 356 aa, Bartonella quintana str. Toulouse
MDKIEFIYVHCNTLGVNTLRAATKSDQITNNQISLQSLINLTKDDMERVNKFILSMAKSDIEMIPEISNHLISSGGKRLRPMITLASAHMFDYQNDGHIKLATAVEFMHTATLLHDDVIDESNLRRGKSTARMIWGNQASILVGDFLLGQAFKLMVDVGSIEALSVLANAAAIIAEGEVMQLSAVKNIETSTSDYLKIINAKTAALFSAAAEVGPIIAGYKYKERFALREYGTLLGLAFQLIDDVLDYGGTAKHLGKNIGDDFREGKITMPVILAYARGNTAEKAFWKQALENCNNNDETFAHAQHLIEKYDSLTDTIEQARAYGKRATNALASMNESPAHSALIETVDFCIARVN

SEQ ID NO: 28068 - protein, 888 aa, Photobacterium profundum SS9
MSEVMKNDVDVLETQEWLEALESVVREEGVERAQYLLEQVLDKARLDGVDMPTGMTTNYINTIPSAQEPAYPGDTTLERRIRSIIRWNAIMIVLRASKKDLDLGGHMASYQSASAFYEVCFNHFFRAPNEVDGGDLVYYQGHISPGIYSRAFVEGRLTEEQLDNFRQEVDGKGIPSYPHPKLMPEFWQFPTVSMGLGPISAIYQARFLKYLAGRGLKDTSAQRVYAFLGDGEMDEPESRGAISFAAREKLDNLCFLINCNLQRLDGPVMGNGSIIQELEGLFKGAGWNVVKVIWGNNWDSLLAKDTTGKLLQLMNETIDGDYQTFKSKDGAYVREHFFGKYPETAALVADMTDDQIFALKRGGHESSKLFAAFSNAKETEGRPTVILAKTVKGYGMGEAAEGKNIAHGVKKMDMTHVQHLRDRLGLQDLVSDEDMKALPYLTLEEGSAEYNYLHARRNALHGYTPKRLPKFTQEFKVPGLEEFAPLLGEQKRDISTTMAYVRTLNILLKDKSIGKNIVPIICDEARTFGMEGLFRQVGIYNPHGQEYTPEDRGVVSYYKEATSGQVLQEGINELGSMASWVAAATSYSTNDLPMIPFYIYYSMFGFQRIGDMAWLAGDQQARGFLLGATAGRTTLNGEGLQHEDGHSHVLANTIPNCISYDPTFAYEVAVIMQDGIRRMYGENQENIYYYLTVMNENYAMPAMPEGTEEGIRKGIYKLESYAGSKAKVQLMSSGTIMNEARKAAQILSDDYGVASDVFSVTSFNELTRDGQAIERDNMLHPEAEEKVPYITQVLGNEPAIAVTDYMKNYAEQVRAFVPAESYKVLGTDGFGRSDSRENLRRHFEVNAGYVVVAALAELAKRGDIDKSVVAQAIAKFDIDADKTNPLYA

SEQ ID NO: 28069 - protein, 494 aa, Haloarcula marismortui ATCC 43049
MLSTRPDALPRAYVDVLSELQDNVPPDAWATIEPVIERELGDDIDTLFEAFDTTAISGASLGQVYEAQIDGQRVAVKVLRPNIRTRVESDLRVLSTLLPVLTYGADPGQAFTLENLTEEFATTVRREMDYGHEARMLREIGDNFANDDDIAIPDVVGSHSTDRVLTMTYLDGVKIDDVERLDELGIDRPALVRRLEEVYIQMIVEDGLFHADPHPGNLAVQPDGTLVFYDFGMTGYLGPRTQDQLLEFYVGLATDDVDRVMDAFVEMGALDPMADRNVMREAFDIVIEQFRGEDISEYRIEQLVGQFETQLYEFPMRLPQDLALVVRVTTVLEGVCRTLDPEFDFIEIISEYVMEQGAGDDVREQIKTEIQEAVTGSTRSAVRAAPKVEDALDRVEREELLVKTVLEDSDGLSRVLAKRLLLGIVASAGVPVSAYLYTVSGLQPAGLALGGSAAVLGILAWSFRRRRGPALSTPQFTRHEMQQRQATDAADGDE

SEQ ID NO: 28070 - protein, 957 aa, Oryza sativa (japonica cultivar-group)
MSSSRSNNRATCSRSSSARSKHSARVVAQTPMDAQLHAEFEGSQRHFDYSSSVGAANRSGATTSNVSAYLQNMQRGRFVQPFGCLLAVHPETFALLAYSENAAEMLDLTPHAVPTIDQREALAVGTDVRTLFRSHSFVALQKAATFGDVNLLNPILVHARTSGKPFYAIMHRIDVGLVIDLEPVNPVDLPVTATGAIKSYKLAARAIARLQSLPSGNLSLLCDVLVREVSELTGYDRVMAYKFHEDEHGEVIAECKRSDLEPYLGLHYPATDIPQASRFLFMKNKVRMICDCSATPVKIIQDDSLTQPISICGSTLRAPHGCHAQYMASMGSVASLVMSVTINEDEDDDGDTGSDQQPKGRKLWGLMVCHHTSPRFVPFPLRYACEFLLQVFGIQINKEVELAAQAKERHILRTQTLLCDMLLRDAPVGIFTQSPNVMDLVKCDGAALYYQNQLWVLGSTPSEAEIKNIVAWLQEYHDGSTGLSTDSLVEAGYPGAAALGDVVCGMAAIKISSKDFIFWFRSHTAKEIKWGGAKHEPIDADDNGRKMHPRSSFKAFLEVVKWRSVPWEDVEMDAIHSLQLILRGSLQDEDANKNNNAKSIVTAPSDDMKKIQGLLELRTVTNEMVRLIETATAPILAVDITGSINGWNNKAAELTGLPVMEAIGKPLVDLVIDDSVEVVKQILNSALQGIEEQNLQIKLKTFNHQENNGPVILMVNACCSRDLSEKVVGVCFVAQDMTGQNIIMDKYTRIQGDYVAIVKNPSELIPPIFMINDLGSCLEWNEAMQKITGIKREDAVDKLLIGEVFTHHEYGCRVKDHGTLTKLSILMNTVISGQDPEKLLFGFFNTDGKYIESLMTATKRTDAEGKITGALCFLHVASPELQHALQVQKMSEQAAMNSFKELTYIRQELRNPLNGMLELEAMLQKGVKFEIEALSACSISFLSEEYIPKKIKQGRHI

SEQ ID NO: 28071 - protein, 281 aa, Ashbya gossypii ATCC 10895
MGREQYKVKAGLAQMLKGGVIMDVVTPEQAIIAEKAGACAVMALERIPADMRKSGQVCRMSDPKMIREIMESVSIPVMAKVRIGHKVEAQILEALQVDYIDESEVLTPADWANHIEKHDFKVPFVCGAKNLGEALRRIEEGAAFIRSKGEAGTGDVSEAVKHINLIYQEIQWCKENLKTDEQFEAHAKELRVPVELLKETVAAGKLPVVTFAAGGVATPADAALLMQLGCEGIFVGSGIFKSSNPEKLARAIVQATTHYMSPEKLLEVSSDLGEMMAGYDR

SEQ ID NO: 28072 - protein, 630 aa, Schizosaccharomyces pombe 972h-
MIAFYLHLEKIAIFDEVYEKLSASNSVSQKEKLEGDLKTQIKKLQRLRDQIKTWASSNDIKDKKALLENRRLIEAKMEEFKAVEREMKIKAFSKEGLSIASKLDPKEKEKQDTIQWISNAVEELERQAELIEAEAESLKATFKRGKKDLSKLSHLSELESRIERHKWHQDKLELIMRRLENSQISPEAVNDIQEDIMYYVECSQSEDFAEDENLYDELNLDEASASYDAERSGRSSSSSHSPSPSASSSSSSENLLQDKAEAEEKVSADASVQDIAEKESLDADKELATNDQEDDEEENQAETQKDGAISNNENMQSEVQTTNPSASTSAVTNITKPTLIQNPSTPLSVSNSKVASPETPNATHTAPKVEMRYASAAAAAAAALAKESPSHHYIMQQVRPETPNSPRLNSTVIQSKWDSLGHTASPKMQTQPVRSVSQSSATTETNVKPTKEENADVPVSSPDYLKDLVNALNTSKEQHKGAIDKEKLTEALNISCVYVPDATDAAKPQYYIPKDPYPVPHYYPQQPLPLFDSSEMTELVDPDTLFYMFYYRPGTYQQYIAGQELKKQSWRFHKKYTTWFQRHEEPKMITDEFESGSYRYFDFEGDWVQRKKADFRFTYQYLEDDDDWTR

SEQ ID NO: 28073 - protein, 1512 aa, Ashbya gossypii ATCC 10895
MSDEQCQSDHQWPMESSKVPPAGLSLSRVSTGASTSADPAHRPYVGLAEDREEQEVIRSLARTLSGSSGAAGRDYQTGTADELAFFGANSDPRLDPESGEFDSQFFVRTLRKLYMSDPDHYKPAELSVVLRNLRVCGEAADTDYQATVGNWPWKTARSLYDMTFRRGHTKAEFDILKPLDAVFEAGRLCVVLGRPGAGCSTLLKTVGARTYGFNVAPESEVSYSGFTQKEISKNLRGEVIYSAEMDTHFASLPVGYTLEFAARCRCPQVRPGGVSRETYYKHYASAVMATYGLSHTRNTKVGNDYIRGVSGGERKRVSLAEVTLAGAKVQCWDNSTRGLDSATALEFVRALRDNAHVMHTTQLIAIYQCSQDAYDLFDDVLVLYEGYMIYFGPREFAKDYFLRMGWACPPQQTSADYLTSVTSPAERQPRPGYEDKVPRTAKEFYDRWMASPERAAVQERINMHMADYETGVARQQLKEHHKSRQAKHMRPSSPYLISFYMQFRAVVDRNLKRLGGDPWVYLFNILSNTIMGLILASCFFNQKEDTASFFYRGSALFTAVLFNSFSSMLEIMSLFEARAIVEKHKSYAFYRPSADAFASIFTELPSKVITCVSFNIPFYFMVNLRRSAGAFFFYLLISMTSTFAMSHLFRTLGAATTSLYVTMLPVSILLLAISTYVGFVIPQKNIVGWSKWIFYLNPIARSMEAMVANEFDGRTFECSQMMPSGPAYENVPLANKVCVAVGSLPGETTVSGTRYMELSYDYLAKHKWRNWAIVLAYAIFFLGLYLLLIEYNKGEMQKGEMAVFLRSTLKKIRKQNKAVKGDVESGNAQGKESSTIDSDQSRELIKKIGSDKIFHWRNVCYDVQIKKETRRILTNVDGWVKPGTLTALMGSSGAGKTTLLDVLANRVRVGVVTGDMFVDGLPRGASFQRNTGYCQQQDLHGCTQTVRDALKFSAYLRQPQSVSEAEIDAYVEDIIRLLEMEAYADAIVGVTGEGLNVEQRKRLTIGVELVAKPELLLFLDEPTSGLDSQTAWSVCQLMRKLANHGQAVLCTIHQPSAILMQEFDRLLLLASGGRTVYFGGLGKGCATMVEYFEKHGSQKFPEGCNPAEFMLEIIGAAPGSHALQDYHEVWKNSEEYRSVQEELLRMETELSKKPRTESPEQNREFAASLWYQYKVVSKRVFQQYWRSPGYLWSKIFMGTFSALFIGFSFFKSKSSMQGMQNQMFATFLFLLIINPLIQQMLPQYEEQKKTWYEVREEPFEAIFLEGVHLISVNCRLPWAIFVGTLAFFSVYYPVGFYNNAVDTSDRSERGFLFWLLAVCYYIFSATFGYFCIALLGSRESAAMFANFVFMIWTVFCGVLVNGDNLPRFWIWAYRISPLTYLVSSIMSTGMAKAKIQCAPEELVKFIPPAGQTCEQYLRPFQSYAQGTALLNPTATDLCTMCPMQSSDTFLAGLGIYYKNRWRDWGIFMVFIFTNIAGFILFYWFLRVPKATGVTIKKATNEEEDEEKGQQRK

SEQ ID NO: 28074 - protein, 369 aa, Oryza sativa (indica cultivar-group)
MRPGGPPSLRAGLLQQQQQQPGTPGRSRRRPDLTLPLPQRDLTSLAVPLPLPLPPSSAPSSTSSSGSSSLGGVPTPPNSVGSAPPAPPPLSELERVRRIGSGAGGTVWMVRHRPTGRPYALKVLYGNHDDAVRRQITREIAILRTAEHPAVVRCHGMYEQAGELQILLEYMDGGSLEGRRIASEAFLADVARQVLSGIAYLHRRHIVHRDIKPSNLLIDSGRRVKIADFGVGRILNQTMDPCNSSVGTIAYMSPERINTDLNDGAYDGYAGDIWSFGLSILEFYMGRFPLGENLGKQGDWAALMCAICYSDSPAPPPNASPEFKSFISCCLQKNPARRPSAAQLLQHRFVAGPQQQQQPQPQPLAPPPS

SEQ ID NO: 28075 - protein, 147 aa, Triticum aestivum
MRGVGGPLLTVSDLLSDLTVEGGDDHLDGGGDASAPSSPLEAHQVEEADPSELQRLFAEDYDNLMKSLQENDPSWPSLMLKLCRTLKTSDKLLSYANMKAEQLLEKAEKLEHVLERGDREVGSIIEVLQSMQLTEDHQISKTNPPSK

SEQ ID NO: 28076 - protein, 478 aa, Zea mays
GRLPRGLLSAVFVRSFCQSRYKSNLYRKPSPFPLSPYLVQKLRKYEARHKKCGPRTKRYRRAVKLLKAGRNTDDSECKYVVWFPCNGLGNRMLTIASTFLYALLTDRVLLVHVPAEQEGLFCEPFPVSSWVLPGSFPQNNPHKLHIGAPESYANMLKNNIVRNDDGPGAPASSSLPPYVYLHLEQFQLKLSDNVFCDEDQVTLSKFNWMLLKSDSYFAPALFLTPMFEAELAKMFPRREAVFHHLGRYLFHPTNRVWGIVRRYYEAYLARVDEKIGFQIRIFPEKPIKFENMYEQLMRCVREQRLLPELGPAEPPTNATADAGDGKVKAVLIASLYSGYYEKIRGMYYESPTKSGEIVAVFQPSHEEQQQYTSNDHNQKALAEIYLLSYCDKITMSAWSTFGYVAYSFAGVKPWILIRPDWNRETSDVACVRSTSVEPCLHSPPILGCRAKTDVDVAAVKPYVRHCEDVGFGLKLFDS

SEQ ID NO: 28077 - protein, 372 aa, Arabidopsis thaliana
MAATTSSGDEPPETKSPAQLIPLLSEDVALSCLARVPRCHYPILSLVSKTFRSLPTSPLLYATRALVGATENILYVAIRIPPESGACWFTLLHRTLSNSTNSKMLVPIPSCPSPSLVGSAYVVVDSEIYVIGGSIRDVPSSSVWVLDCRFHTWRRVSNMRVGREFAAAGVIDGKIYVIGGCVVDNWARSINWAEMFDIKTQTWEPVASPGMEVREKWMHASAVMEGKVYAMADRNGVVYEPKEKKWEMPEKRLDLGWRGRACVIENILYCYDYLGKIRGYDPKERIWRELKGVESLPKFLCGATMANRGGKLTVLWEGKAGSGGSRRMEIWCAEIDVGRRGEREIWGKIEWSGTVLTVPNESAIVNCLAATV

SEQ ID NO: 28078 - protein, 514 aa, Wolinella succinogenes DSM 1740
MGFLRLYSPWRVWKVFRFLATIFLLIKKRDSFLWITPLSPRALHGVILDLGASFIKLAQVLATRSDFFDESYLEPLRTLHDDIPPMDHEAFSRVFERSFGESDPFLEFASKPLASASIGQVHRARLKSGEEVAVKLLREGIGARVQADICIITFFNLLFRPLFSPYTKHSVESVLLEFSSMILKEVNLAQERYHLELFWEVYRESGVLFPLPFADYCTSEALVMSFHEGVRFDDKEGLLTLGVDFGSLMEKLVEFYVEQMLVTGLFHADPHPGNLLVDASGNLIFLDFGMVKKISTPTRIAIIELVKAAHERDFEHYILACKKLGIIAQEAPSGEMEEFASRMFAIFDNTSLDSASMQKLAFEVLESMRDMPFKLPQEAIYILRVSAIIEGLGTRYIENFNGIKDILPILQKNLSRALGMREGLLEGIWSEAKSLPMSLKHLKNILAKADEGELRVRIAQGDAEALAWRLKGYIRGVLPGILSLLGAFFLLGAGFREEAFWLFGAGIVWLFYKV

SEQ ID NO: 28079 - protein, 171 aa, Triticum aestivum
  misc_feature (85)..(85): Xaa can be any naturally occurring amino acid
  misc_feature (117)..(117): Xaa can be any naturally occurring amino acid
  unsure (1)..(171): unsure at all Xaa locations
MAPAVMASSATTVAPFQGLKSTAGLPVSRRSSGSLGRVSNGGRIRCMQVWPIEGIKKFETLSYLPPLSTEALLKQVDYLIRSKWXVPCLEFSKVGFVFREHNSSSGYYDGRYWTMWXKLPMFGCTDATQVLNEVEEVKKEYTTQGVSYPLPSSKISWPPWRSCFVCLPVLF

SEQ ID NO: 28080 - protein, 198 aa, Oryza sativa (japonica cultivar-group)
MAGKAAKATATNANNNGGGGYIRTVTLRGFDGIRVRVSAATMAAASATARARLDEAIRRTPRHAAVPDDVLINVPGVARPVLARVADYCDRHYGGGGGGEGGEFAAPEGYGFDDPLARFDDELMDGADVGTVVDLLRAAAFLRVERLADLASREVAACMRGRTVEGIRQVFGIANDYTDEEEQDVRKENSWAFDAYND

SEQ ID NO: 28081 - protein, 407 aa, Pseudomonas putida
MAIEIKAPTFPESVADGTVATWHKQPGEAVKRDELIVDIETDKVVLEVLATADGVLGAIVKGEGDTVLSDEVLGSIVEGGAAAAAPAAAPAAAAPAAAAADAGEDDPIAAPAARKLAEENGIDLAAVTGTGKGGRITKEDVVAAVANKKSAPAAAPAAKPAAAAAAPVVVAAGDRTEKRVPMTRLRAKIAERLVEAQSSMAMLTTFNEVDMTEVMALRSKYKDLFEKTHNGVRLGFMSFFVKAATEALKRFPAVNASIDGNDIVYHGYADVGVAVSSDRGLVVPVLRNAESMSLAEIENGIATFGKKARDGKLAIEEMTGGTFTITNGGTFGSMMSTPIVNPPQAAILGMHNIIQRPMAINGQVVIRPMMYLALSYDHRLIDGKEAVTFLVTIKNLLEDPSRLLLDI

SEQ ID NO: 28082 - protein, 386 aa, Brassica napus
KMKKKYYSWDECINLREVKSLRRMDHPNIVKLKEVIREHDILYFVFEYMDYNLYQLMKDRQKLFTEAVIKKWCFQVFHGLSYMHQRGYFHRDLKPENLLVSKDIIKIADFGLAREVNSSPPFTGYVSTRWYRAPEVLLQSYVYTSKVDMWAMGAIMSELLSLRPIFPGASEADEIYKICGVIGSPTEETWLEGLNLANTINYQFPRLSGVPLSSLMPSASEDAIDLITRLCSWDPCNRPTAAEALQHPFFQSCFYVQPSLRPKPSVARTPPPVGPRGSFEHQTVKRQTLSLAKAKTFNSHSSPKSNAAFGSGVHRKLDLAKQDATRNTKPVRSSVKDTIYRPPGRKSPSGSSVNKNRVARGVSETGDKLSNMSIRGTVSRRHSVSV

SEQ ID NO: 28083 - protein, 284 aa, Debaryomyces hansenii CBS767
MISSRSVLRKIGQANLRTVSLNSTRLFSSTLIRQNENEELVDLNKLPRKDPGVPIVPLVNPVDYYKDQSEELHKFGKYIMGCLPKFIQQFSVWKDELVIYVAPSALRPTMMFLKNHTAAQFKAVMDVTAADYPSRTNRFDVVYNMLSVRHNSRIRVKTYASEVSPVPSIVPLFQGTNWFERETYDLFGIFFEDHPDLRRIMTDYGFEGHPLRKDFPTTGYTEVRYDEEKKRVVYEPLELSQAFRNFAVGSSVWEPVGDGKDFTPESFKLPTPEPEPTKDDDDKK

SEQ ID NO: 28084 - protein, 990 aa, Synechocystis sp. PCC 6803
MVAQIDSQQQYEQATQAIAKELLAQTREKRSLWDKIGDNLRLDDKLLDWTMGHPGLRVQLFKFIDCLPALQSNSEIANHLQQYMSEEEVELPEALKKLLNFADAHSTPAQIAAGTVSKATEQLAFKYIAGETIAQVIKTVERLRKEKMGFTIDLLGEAVITESEAAEYWQNYLDLMAQLSQQAKSWSKVPQIDQADGEILPQVQVSVKLTAFYSQFDPLDPAGSKAKVCERIRELLRRAQELGVAVHFDMEQYHYKDLILNILKELLVEEEFRSRTDVGITMQAYLRDSTEDLEALIPWAKHRGYPVTVRLVKGAYWDQETIKAQQNHWQIPVYVEKAQTDANYERMTRLLLENHEYLYAAIGSHNVRSQALACAIAEELNIPKRRYEMQILYGMGEPLARAIVKRGHRVRVYAPYGRLLPGMAYLIRRLLENTANSSFLRQNLEERPIEELIAPPQVKGINDLPTKGYGNAPDTDYADADLRQQAFQALTRVKQQLGKTYLPYINGEYVETANYIDSVNPCRPSQAIGKVGLISVEQADHALEIAKAAFPAWKKTPVRERCGILRKAADIMEERRHELNAWICLEVGKIIPQADAEVSEAIDFCRYYADEMERLDQGVNLDIPGETNRYFYQPRGIALVISPWNFPMAIAVGMTVAALVTGNCTLLKPAETSTVIAAKIAEILIAAGVPPGVFQYVPGKGSVVGSHMVNHPDVHLIAFTGSREVGCRIYADAALVQPGQKHLKRVIAEMGGKNAIIVDESADLDQAVAGAVYSAFGYTGQKCSACSRVVVLSPVHDAFVERFVEATRSLNVGPTDDPSTQVGPVIDAKAQARIQEYIEQGKAECELAIACDAPSEGYFVGPTVFKNVDRHATIAQEEIFGPVVTIIRAANFDEALEIANGTDYALTGGLYSRTPDHINRAAAEFEVGNLYINRTITGAIVSRQPFGGFKMSGVGSKAGGPDYLLQFLEPRHVTENIQRQGFAPIEGADQ

SEQ ID NO: 28085 - protein, 503 aa, Zea mays
MMLAILARRRAAEAVLRRPQAAAGAAVSAWRAYAAAGEESDVVVVGGGPGGYVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLSSPSEVSVDLIDGGSTVVKGKNIIIATGSDVKSLPGITIDEKKVVSSTGALCLSEIPKKLVVIGAGYIGLEMGSVWNRLGSEVTVVEFAPDIVPSMDGEVRKQFQRMLEKQKFKFMLKTKVVGCDTSGDGVKLTLEPAAGGEQNILEADVVLVSAGRTPFTSGIGLETLGVETDKAGRILVDKRFMTNVKGVYAIGDAIPGPMLAHKAEEDGVACVEFIAGKEGHVDYDTVPGVVYTHPEVASVGKTEEQVTALGIPYRVGKFPLLANSRAKAIDDAEGVVKVIAEKETDKILGVHIMAPNAGEIIHEAVIALQYGASSEDVARTCHAHPTVSEALKEACLQTFNKAIHI

SEQ ID NO: 28086 - protein, 1590 aa, Sclerotinia sclerotiorum
MGSTTFENPTRIEILGKEDIIVDFDIWRNFVAEDLLSDLPSSTYVLITDTNLSPLYVPAFQQSFEALAAKSSSTPRLLTYEIPPGENSKSRETKAEIEDWMLSHQCTRDSVIIALGGGVIGDMIGYVAATFMRGVRFVQVPTTLLAMVDSSIGGKTAIDTPLGKNLVGAFWQPQRIYIDLRFLETLPVREFINGMAEVVKTAAIWDEAEFSALEDNANLIMTTIRAKNTDCSTRLGPIRDILKRIVLGSAKTKADVVSADEREGGLRNILNFGHSIGHAFEAILTPQVLHGEAVAIGMVKEAELARHLGVLKPGAVARLVKCIASYGLPTSLADKRIQKLTAGKLCPVDVLLEKMGVDKKNDGRKKKIVLLSAIGKTYEPKASVVEDRSIRVVLSDSVEVRPSVPETLNVEVTPPGSKSISNRALVLAALGTGPCRIKNLLHSDDVEFMLTSIGKLGGATYAWEDAGEVLCVQGKGGDLHASPTELYIGNAGTASRFLTTVVSLCKPSASTKSTILTGNARMKVRPIGPLVDSLRANGVDIEYLEKEHSLPLNVAASGGFTGGDINLAATVSSQYVSSLLMCAPYAKNPVTLRLVGGKPISQLYIDMTTAMMAAFGIHVVRSQTGEHTYHIPQGVYKNPEEYVVESDASSATYPLAVAATSGTTCTIPNIGCKSIQGDARFAIDVLKPTGCKVVQTDYSTTVTGPPIGSLQAIEEVDMEPMTDAFLTASVLGAVAKGTTKIRGIANQRVKECNRIKAMKDELAKFGVTCRELEDGIEVDGVPIKDLKHPAEGIHCYDDHRVAMSFSVLSVAASQPVLIEERECVGKTWPGWWDILSKSFQVELAGKEVKATHSKKIGIPTLPDKSIFIIGMRGAGKTTAGAWAAKILGRPYKDLDVELERISGMSIPDMVRSKGWDFFRAAELDLLKHCLTDQPEKHVFACGGGVVEMPEARELLINFHKSGGIVLLVHRDTEQVMDYLRIDKTRPAYVEDMMGVYSRRKPWFNECSNFQYHSKGSGASALSVAEQDFARFLHHISGKSLHFDEMRNKPQSFFVSLTMPDISGAAYILPSVAVGSDAVEVRVDLLEDPSSTNGIPGTDFLSVQIAHLRSVVHLPVIFTVRTVSQGGRFPDAAHEEALKLYKLAVKMGIEYIDLEIAFPDELLQEVTEAKGFSRIIASHHDPQGTLSWKNGGWFQHYNRALQYGDIIKLVGSAKSIEDNFALAKFKKTMAAAHDTPLIAINMGVTGKLSRVLNGFMTPVSHPSLPFKAAPGQLSAAEIRSTLSTLGEIEPKSFYLFGTPISQSRSPALHNTLFKQTGLPHRYSRLETDRVADVQDVIRAPDFGGASVTIPLKLDIIPLLDSVTDAVKVIGAVNTIIPTPDNPPRLVGENTDWLGMTHSLMSASHTPSPVDSPSPALVIGAGGTARAAIYALHSLGHSPIYMVARTPSKLDTLINSFPSSFNIIPLPSTTSATELTTPPAVAISTIPADRPIESNMRETLAVLLRHEKKDEGKQRTLLEMAYKPSQTPLMRMAEDAGWVAIPGLEVLSAQGWYQVSLFPFHLLVCYEVIFLNGFTKIYRLVSKMDKHPTFVC

SEQ ID NO: 28087 - protein, 428 aa, Dehalococcoides ethenogenes 195
MSAVVKSIKAREILDSRGNPTVEADVVLSDGSFGRAAVPSGASTGSHEAVELRDGDKSRYNGLGVQKAVTNVNTAIAKAISGFKASDQQGLDNLLIELDGTPNKAKLGANAMLATSLAVAHAAAASCHMPLYRYLNNCDEYILPVPMFNILNGGKHASNSTDFQEFMVMPTGAKSFAEALRMGTEVYHSLKKVLKGMNQNTTVGDEGGFAPSLPTNKDAVEVILKAIEKAGYRPGEDIFIALDPASSELYQDGKYTLATENKTLSSAEMVDYWCGWVEKYPIISIEDGLFEDDWDGWKMLTKKIGSKVQLVGDDFYVTNIKRLERGIKENASNSILIKLNQIGTLSETIAAIKMANNSAWTAVVSHRSGETEDTTIADLAVAMNAGQIKTGAPCRAERTAKYNRLLRIEEELGGKAKYPGKEAFFNLK

SEQ ID NO: 28088 - protein, 617 aa, Oryza sativa (indica cultivar-group)
MGGAHSREDLDLTSSDGEDDDEEYDAQTATSAASREDILRTSTPSSLEFLDAKLKALDLKYQAPNAAKLYLHVGGASASARWVPAERRATYAFVDKATAAGDSDCGGPRWVLEVGPGPRVSAPVGPALQLKALPAQRRADFAAGGSVWALRLPTDAAFRRFRQEYDRCLFENTYGVEATDEGRKEVFGADFAAWARPGESDDAVWADAEDSFTPPVATPARDLLEEFEEEAGDGSIQSLALGALDNSFLVGGSGIQVVKNFRHGVHGKGVSVRISDGRGGGNAYMTPQKALLMRGETNMLLMSPGETGTRHSNGVHHVDIETGKVVAQWRFEKDGTDITMRDIANDSKGAQLEPSGSTFLGLDDNRLCRWDMRDSRGRVQTIGSSSESPVLQWSQGHQFSRGTNFQCFASTGDGSIVVGSVDGKIRLYSKSSMRMAKTAFPGLGSPITHVDVTYDGKWILGTTDTYLILICTIFKDKDGKEKTGFSGRMGNRIAAPRLLKLSPLDSILAGSENKFHGGQFSWVTENGKQEKHLVATVGKFSVIWNFQQVKDSNHECYRDQEGLKSCYCYKVVLKDESIVDSRFMHEKFATTDSPEAPLVVATPMKVSSFSLANRRLH

SEQ ID NO: 28089 - protein, 137 aa, Leuconostoc mesenteroides subsp. mesenteroides ATCC 8293
MVERTFMMIKPDGVSRGKIGEIIQRIEHKGYAIKAMKMVQPTPELLAKHYAEHVGKSFYPSLVQYMTLGPVIAMIGEGTNIVSGWRTIMGTTNPTLAAPGTIRGDLGREWEGEAVMNIVHGSDSVEAAEYEIKLWFA

SEQ ID NO: 28090 - protein, 479 aa, Arabidopsis thaliana
MKIELVFIPSPAISHLMATVEMAEQLVDKNDNLSITVIIISFSSKNTSMITSLTSNNRLRYEIISGGDQQPTELKATDSHIQSLKPLVRDAVAKLVDSTLPDAPRLAGFVVDMYCTSMIDVANEFGVPSYLFYTSNAGFLGLLLHIQFMYDAEDIYDMSELEDSDVELVVPSLTSPYPLKCLPYIFKSKEWLTFFVTQARRFRETKGILVNTVPDLEPQALTFLSNGNIPRAYPVGPLLHLKNVNCDYVDKKQSEILRWLDEQPPRSVVFLCFGSMGGFSEEQVRETALALDRSGHRFLWSLRRASPNILREPPGEFTNLEEILPEGFFDRTANRGKVIGWAEQVAILAKPAIGGFVSHGGWNSTLESLWFGVPMAIWPLYAEQKFNAFEMVEELGLAVEIKKHWRGDLLLGRSEIVTAEEIEKGIICLMEQDSDVRKRVNEISEKCHVALMDGGSSETALKRFIQDVTENIAWSETES

SEQ ID NO: 28091 - protein, 115 aa, Mycobacterium avium 104
MMLDPQIAARLKRNADGLVTAVVQERGSRDVLMVAWMDDAALARTLETREATYYSRSRGQQWVKGETSGHTQYVHSVRLDCDGDTVLLTVDQVGGACHTGDHSCFDADVLLHPQD

SEQ ID NO: 28092 - protein, 394 aa, Synechococcus sp. CC9605
MTQLETRTEPMVVNFGPHHPSMHGVLRLVVTLDGEDVVDCEPVIGYLHRGMEKIAENRTNVMFVPYVSRMDYAAGMFYEAIVVNAPEKLANIPVPKRASYIRVLMLELNRIANHLLWLGPFLADVGAQTPFFYIFREREMIYDLWEAATGQRLINNNYFRIGGVAADLPWGWLEKCRDFCDWFGPKIDEYEKLITNNPIFRRRIEGLGRIEKEDAINWSLSGPMLRASGVPWDLRKVDHYECYDDFDWQVAWEKEGDCYARYRVRIEEMRQSLKILRQACDMIPGGPTENLEAKRLNEGKGSDAAGFDFQYVAKKVAPTFKIPNGELYTRLESGKGEIGVFIQGNNDVTPWRFKIRAADSNNLQILPHILKGHKVADIMAILGSIDVIMGSVDR

SEQ ID NO: 28093 - protein, 858 aa, Gibberella zeae PH-1
MALLQRFVAPSARGALRQSPAITLMITRKASNASPPKLKDPSLFKQDVCYVNGKWVKAKSGKTFKVNDPSTGDLIGTCPEFDSKDAQLAIRAAADAFPSFRNKTGRERSKLLRAWYEQMTANAEDIAKLITWENGKPMADAKGETTYAANFLEWFSEEAPRVYGDTIPSSVPGNRVWTLKEPVGVCGLITPWNFPAAMITRKIGPALAAGCTVVAKAPAETPFTSLALAELAHRAGIPKGVVNVVTSHENTPELGELLTSDPTIRKVSFTGSTNVGKLLMKQSAGTLKKLSMELGGNAPFIVFDDADADAAVAGAITSKFRSSGQTCVCANRIYVQRGIYDEFVSKFTEKVKSFNVGHGFDQGVTHGPLIHDKAIEKVEAHVKDAEKKGGKVTIGGKRLSDLGSNFYAPTVIRDMTPEMDMASQETFGPVAGLFPFETEEEVVKMANNTEVGLAGYFFSRDLERVHRIAEALEVGMVGVNTGLISDAAAPFGGVKESGFGREGSLYGISEYQITKMITYGVYYGEGSNEYNIHTLNHENVVVITFALQIIERAKCRRFEPCHDQRNFDLYLDPRNAQNRFNHNTLFEMAFSLANAPLRTCLRQLVRSKGPAPLRSIAASPRAFSTSHVLLKKRKISAPANSPNTATAKAAAGSMNKAEYDTAKVPAPDPEDPLDFTAVIAAYAPIDAHFKTQLAGMIHGGRFNPTNLGSLPVTIKDEEGADATFPLRELAQVVPRSGRAISLLVNDKEYIKPIMSAVQSSREFNQQPQRSEDNELELLLKVELERKDDVERRVKEAVQQWKDRIRNARSRHEKTLKDWKKNGTVLPDIVKKAEKELQKVQDKKMKEIDQEEAQTIRQL

SEQ ID NO: 28094 - protein, 330 aa, Triticum aestivum
MPLPIDGRRERAVCVRGAGAGAMEINIVDKYEKLEKVGEGTYGKVYKAQDKATGQLVALKKTRLEMDEEGIPPTALREISLLNLLSHSIYIVRLLAVEQAAKNGKPVLYLVFEFLDTDLKKYLDVYRRGPSARPLPATLIKNFLYQLCKGVAHCHSHGVLHRDLKPQNLLVDKEKGILKIADLGLGRAFTVPMKSYTHEIVTLWYRAPEVLLGATHYSTGVDMWSVGCIFAEMARRQALFPGDSELQQLLHIFRLLGTPTEEQWPGVSDLRDWHEFPQWKPQGLARVVPTLEPEGVDLLSKMLQLDPSNRISALAAMEHPYFNSLDKSQF

SEQ ID NO: 28095 - protein, 461 aa, Thermoanaerobacter tengcongensis MB4
MENLHTREYDLAVIGGGPGGYVAAIKAAKKGAKVALFEKDKLGGTCLNRGCIPTKAYARAAEVYGILKKAKEFGFDIQINYFDYAQVVKRKDTIVGELVEGIKALLKANKIEVFNKEAKVDKEKNVIFEGEKIKAKNIIIATGSSPAELPIEGIDSKNVLNSDTILEITSLPKSLCIIGGGVIGMEFAFIMNQFGVEVYVVEMMPNILPSLDKKVSSAVKFAAQKRGIKIYTSSTVEKVEEEGENSVVTIRSGDDIKKISVDKVFVSIGRKLNTSIGPIVDLLEFDKKAIKVDEHMRTNIEGVWAVGDVTGKMMLAHVASSQGEVAVDNIFGKSRTLDYYKIPAAVFTEPEIGYFGYTEEEAKEKFGEIKVGRFDFKHNGRAKTYGETEGFAKIISTEDGEVVGAWVVGSGASELVHIISTACQSGAKAEELKDVVYAHPTKSETIMEAFKDIFKEAIHKI

SEQ ID NO: 28096 - protein, 428 aa, Methanosarcina acetivorans C2A
MTLMEDAKKGIVTPSIEAVAKAEGIDAETVRSCVAKGLIAIPKNNRRETLPIGIGKYMSTKINANVGTSRDCIDIDAEVEKAKAAEAFGAHAVMDLSTGGDLNEIRTRILKAVNIPVGTVPIYQAAASQKVVVEMTSDDMFNAVRKHAEQGVDFVTVHAGVNLNSLERLRQSDRIMNVVSRGGSFTLAWMLHNGEDNPFYAEFDYLLEIAKEYDMTLSLGDGMRPGCIADASDRPKFMEFITLGELVKRSRAANVQTFVEGPGHVPLNEIELSVRGMKELCDGAPLYLLGPLVTDIAPGFDHITGAIGGAVAGMYGTDFLCMVTPSEHLALPSLEDIKEGLFVTKLAAHTIDLIKEGPRERAWRQDTAMAYARRDLDWEKQFELAIDGDRARKIRDARKTESDACSMCGELCAVKIVKEAFGEKKAEE

SEQ ID NO: 28097 - protein, 136 aa, Glycine max
KVRKEKLGDRITTLHQLVSPFGKTDTASVLLEAIGYIRFLQGQIEALSSPYLGSASKYMRNQQSVHGERNSVPEDPGQLLNDNNIGLKRKGAPNQAAEDHKAKDLKSRGLCLVPVSCTQNMHVGSYYWAPAYGRGF

SEQ ID NO: 28098 - protein, 486 aa, Polaromonas sp. JS666
MTSEYVQDHQLNAMRLAGRKLGAERSGERAIQVFNPYTEALIGTVPKATLEEVRETFARAHAYKPQLTRYERAAILNRAAAIIQSRLDEVANLITAESGLCLKDSMHEAGRVSDVLLFGASEALRDDGQIFSCDLTPHGRKRRVYTQRSPLLGVITAITPFNHPMNQVAHKVVPSIASNNRMVLKPSEKVPFSAILFADILYEAGLPPEMLSVVTGDPREIADELITNPLVDLVTFTGGVAIGKYIASKAGYRRVVLELGGNDPIIVMEDADIDEASTLAVQGSYKNSGQRCTAIKRLLVHEAVAGQFVEQVLAKTLAWKYGDPTDRANDMGTVIDEAAAMLFESRVNEAVAQGAKLLAGNQRRGALYSPTLLDHVLPQMTVAREETFGPVSPVIRFKNIDEAIQISNGTAYGLSSAVCTNRMDYITRFVSELQVGTVNVREVPGYRLELTPFGGIKDSGLGYKEGVQEAIKSFTNLKTYSLPWSG

SEQ ID NO: 28099 - protein, 831 aa, Rhodobacter sphaeroides f. sp. denitrificans
MTLTRRDLIKAQAAATAAAAAGLPVSALAQPVTGGAEALRIRWSKAPCRFCGTGCGVMVGTRDGQVVATHGDTQAEVNRGLNCVKGYFLSKIMYGEDRLTTPLLRMKDGVYHKEGEFAPVSWDEAFDVMAAQAKRVLKDKGPKAMGMFGSGQWTIWEGYAASKLMRAGFLSNNLDPNARHCMASAATAFMRTFGMDEPMGCYDDFEAADAFVLWGSNMAEMHPILWSRLTDRRLSHEHVRVAVLSTFTHRSMDLADTPIIFRPGTDLAILNYIAHHIISTGRVNRDFVDRHTNFALGATDIGYGLRPEHQLQLIAKGAADAGAMTPTDFETFAALVSEYTLERAAEISGVEPALLEELAELYADPDRKVMSLWTMGFNQHVRGVWANHMVYNLHLLTGKISEPGNSPFSLTGQPSACGTAREVGTFAHRLPADMVVTNPEHRAHAEEIWKLPAGLLPDWVGAHAVEQDRKLHDGEINFYWVQVNNNMQAAPNIDQETYPGYRNPENFIVVSDAYPTVTGRCADLVLPAAMWVEKEGAYGNAERRTHFWHQLVEAPGEARSDLWQLMEFSKRFTTDEVWPEEILAAAPAYRGKTLFEVLFANGSVDRFPVSDVDPDHANHEAALFGFYPQKGLFEEYAAFGRGHGHDLAPFDTYHEVRGLRWPVVEGEETRWRYREGYDPYVKPGEGLRFYGKPDGRAVILGVPYEPPAESPDEEFGFWLVTGRVLEHWHSGSMTLRVPELYKAFPGAVCFMHPEDARSRGLNRGSEVRVISRRGEIRTRLETRGRNRMPRGVVFVPWFDASQLINKVTLDANDPISRQTDFKKCAVKIEAV

SEQ ID NO: 28100 - protein, 362 aa, Rickettsia sp. RDa420
WQDVIDISKVYSEADCFTYDPGFMSTASCRSTITYIDGDQGILRHRGYDIKDLAEKSDFLEVAYLLIYGELPNSKQYNDFTKKVAHHALVNERLHYLFQTFCSSSHPMAIMLAAVGSLSAFYPDLLNFFKEADYELTAIRMIAKIPTIAAMSYKYSIGQPFVYPDNSIDFTENFLHMMFATPCEKYKVNPVIKNALNKIFILHADHEQNASTSTVRIAGSSGANPFACVSTGIASLWGPAHGGANEAVINMLKEIGSVENIPKYIAKAKDKNDNFRLMGFGHRVYKNYDPRAAVLKETCKEVLKELGQLDNNPLLQIAIELEAIALKDEYFIERKLYPNVDFYSGIIYKAMGIPPQMFTVLF

SEQ ID NO: 28101 - protein, 393 aa, Gossypium barbadense
MNLSATEKDLMIVNMGPHHPSMHGVLRLIVTLDGEDVVDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELVYDLFEAATGMRMMHNYFRIGGVAADLPYGWLDKCLDFCDYFLTGIVEYQKLITRNPIFLERVEGIGVIGGEEAINWGLSGPMLRASGIKWDLRKVDHYECYDEFDWEIQWQKEGDSLARYLVRISEMTESIKIIQQALEGIPGGPYENLEIRCFDRERDPEWNDFEYRFISIKPSPTFELPRQELYARMEAPKGELGIFLIGDQSGFPWRWKIRPPGFINLQILPQLVKRMKLADIMTILGSIDIIMGEVDR

SEQ ID NO: 28102 - protein, 369 aa, Rickettsia sp. RDla440
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSFEYIPKYIAKAKDKNDPFRLMGFGHRVYKNYDPRAAVLKETCKEVLKELGQLDNNPLLQIAIELEAIALKDEYFIERKLYPNVDFYSGII

SEQ ID NO: 28103 - protein, 93 aa, Oryza sativa (japonica cultivar-group)
MWFVGRGYSDAARASDRGSKPDKEIITRVSGPEIGYITTPIVLVQCALVLLSQRGNLPKGGVYTPGAVFGPTDIQQRLQENGLSFDLVSTRTL

SEQ ID NO: 28104 - protein, 60 aa, Colletotrichum sp.
AIRRLARRGGVKRISAVIYEETRGVLKSFLEGVIRDAVTYTEHAKRKTVTSLDVVYALKR

SEQ ID NO: 28105 - protein, 166 aa, Tridax balbisioides
MFPMVTEFMNYGQQTVRAARYIGQGFMITLSHANRLPVTIQYPYEKLITSERFRGRIHFEFDKCIACEVCVRVCPIDLPVVDWKLETHIRKKRLLNYSIDFGICIFCGNCVEYCPTNCLSMTEEYELSTYDRHELNYNQIALGRLPMSIIDDYTIRTILNLPEIKT

SEQ ID NO: 28106 - protein, 311 aa, Glycine max
  misc_feature (268)..(268): Xaa can be any naturally occurring amino acid
  unsure (1)..(311): unsure at all Xaa locations
MEGSGSGVVTVYGNGAITETKKSPFSVKVGLAQMLRGGVIMDVVNAEQARIAEEAGACAVMALERVPADIRAQGGVARMSDPQLIKDIKRAVTIPVMAKARIGHFVEAQILEAIGIDYVDESEVLTLADDANHINKHNFRIPFVCGCRNLGEALRRIREGAAMIRTKGEAGTGNIIEAVRHVRSVMSDIRVLRNMDDDEVFTFAKSIAAPYDLVMQTKQLGRLPVVHFAAGGVATPADAALMMQLGCDGVFVGSGVFKSGDPAKRARXIVQAVTHYSDPEVLAEVSCGLGEAMVGINLTDDKVERFANRSE

SEQ ID NO: 28107 - protein, 512 aa, Schizosaccharomyces pombe
MLNSVIKRSALCRFKFTCLQVSECRPAQIEISKRLYSAKASGNGEYDLCVIGGGPGGYVAAIRGAQLGLKTICVEKRGTLGGTCLNVGCIPSKALLNNSHIYHTVKHDTKRRGIDVSGVSVNLSQMMKAKDDSVKSLTSGIEYLFKKNKVEYAKGTGSFIDPQTLSVKGIDGAADQTIKAKNFIIATGSEVKPFPGVTIDEKKIVSSTGGPYLYQRYPKKMTVLGGGIIGLEMGSVWSRLGAEVTVVEFLPAVGGPMDADISKALSRIISKQGIKFKRSTKLVSAKVNGDSVEVEIENMKNNKRETYQTDVLLVAIGRVPYTEGLGLDKLGISMDKSNRVIMDSEYRTNIPHIRVIGDATLGPMLAHKAEDEGIAAVEYIAKGQGHVNYNCIPAVMYTHPEVAWVGITEQKAKESGIKYRIGTFGFSANSRAKTNMDADGLVKVIVDAETDRLLGVHMIGPMAGELIGEATLALEYGASAEDVARVCHAHPTLSEATKEAMMAAWCGKSIHF

SEQ ID NO: 28108 - protein, 389 aa, Beta vulgaris
MAIDCMRNLSSTPKSYQNSKQEQNNPLIFDASFLNHQSHIPQQFIWPDGEKPDFIEPEELAVPLIDLQGFLSDDPEKTLKASKLIGEACLKHGFFLVVNHGVERDLIKDAHNLMDDFFEEPLSLKQKALRKLGEHCGYASSFTGRFSCNLPWKETLSFNYSPQESSSSKTHVQDYFNNKFGDSFNHLGTTYQQYCEAMSTLSLRIMELLGLSLGVGRRHFREFFEGHESVMRLNYYPPCQRPDLTLGTGPHCDPTSLTILHQDQVGGLQVFADGKWRSISPNFNAFVVNIGDTFMALSNGRYKSCLHRAVVNSEKPRKSLAFFLCPNKDKVVKPPRELVDEENNPRVYPDFTWPLLLEFTQKHYRADMNTLKVFSQWVQQQRSTQQVEK

SEQ ID NO: 28109 - protein, 442 aa, Rhodobacter sphaeroides 2.4.1
MPGHIFGRSTRGSLPVAAEGEGCYILDTEGRRYLDGSGGAAVSCLGHSNAAVRAALHDQLDRLAFAHTGFFTSEPAERLADRLAAAAPEGIERVYLVSGGSEAVEAALKLARQYFMEVGQPGRHRVIARRQSYHGNTLGALAAGGNEWRRAQFAPLLVETSHVSPCYEYRGRAEDESLEAYGLRVADELEAEIQRLGPETVMAFVAEPVVGATAGAVPAVPGYLKRVREICDRHGVLLILDEVMCGMGRTGHLFACAEDGVAPDMITIAKGLGAGYQPIGALLVQGRIYDAIAAGSGFFQHGHTYMGHAMAAAAANAVLDEIEGRDLLQAVRRQGARLEALLQERLGQHPHVGDIRGRGLFRGIELVADRETKEPFDPARKLHARIKAEAFAGGLICYPMGGTLDGVRGDHILLAPPFIISDAELDELVDKLSGALDRALAA

SEQ ID NO: 28110 - protein, 577 aa, Oryza sativa (japonica cultivar-group)
MAKFTLDDADDDPPVATARDKRKRDDGPADAEDEPPRARGSAVAGREPAAPGAEAEAAGRRGPAEEMANGEVEGGLSVQIDPDVLDCSICFESLRPPLYQCQNGHVACFSCWSKLSNKCHICSRDAKFARNIALEKIVESIKSSCSYAKWGCCKFINYAQRDAHEEACLFAPSVCPISNCGYRGFTGRWSGHFLTSHSSDVMRFIYGQPFEVNIEVSVPFLVFLGEDDHLFLLQNNNLTPFGHAFSVVCLRSGNLNWMFSYQIEATSRKKPENRLQLKASVTNTRQWTGIYPSEAFLLVPFDFCHSSNIVLNISIERYAVVRVDASRRLQRRADGRRAQRRVASAAGARRGVVGPGQAADGAGARRGVVGPGQAPGHSLPPRLLRRRARLAAAAAPPPCLTLASPLPPPFRLPHRRLASSAADLVSSAVIAVVIPELRRARWGRRDGRRAPRTLKMTTASSGAVEDDNDDDDELGHGGSDGRGRRDSEQKGGRLHPRHFAALRRDRGGHRAPSRPPATGRLFTTPAAPPPRPPPAPAQPRPAALATRRARRPSARRCRRPLPSTRTCEAEREGGGED

SEQ ID NO: 28111 - protein, 395 aa, Zea mays
  misc_feature (185)..(185): Xaa can be any naturally occurring amino acid
  unsure (1)..(395): unsure at all Xaa locations
MGDDVRGLRAAAVTTAAGVVPAKTPERARLHVAMLALQFGYAGFHVVSRLALNMGVSKLVFPVYRNLIALCLLAPFAYFLEKKDRPAMTPAFLLQFFLLALCGITANQGFYLLGLDNTSPTFASAIQNSVPAITFAMAAALGIERVRLRRRDGLAKAAGTVLCVAGATVITLFKGPAVFGPAPSXPQPCPCPCPRRGGGNNNNNNKSWALGCVYLMGHCLSWSGWLVLQAPVLKRYPARLSVTSYTCFFGLLQFLAVAAVFERDAAAWALGSGSELLTILYAGLVASGVAFAVQTWCIDRGGPVFVAVYQPVQTLLVAVMASLLLGEQFYLGGIMGAVFIIAGLYLVLWGKSQERALAAKQTAAAAAGSVCDDDAAASCLKQPLLPPPPATSEAV

SEQ ID NO: 28112 - protein, 485 aa, Ginkgo biloba
MASIFVPVCVSVAVITITCLKKFNGWRYECGLSSKKPLPPGDMGWPLLGNMLSFLIAFKFNRPNSFVSAFVSRFGRTGLYKPFMFGSPTILATTPETCKQVLMDDAHFVPGWPVSTVQLMGRKSFVALSHEDHDRLRKLTAPSINGHEALSNYLGWIEQRVVSAYEDWANQDRIVLLNELKKVTFDIISYIFLSYESKTGTKLASLEREYTSLNMGIRAMAINLPGTAYHKALKARKNLVAILQSVTEERRSSPDPQAKSNKDVLNALLHVKDENGSLLTDEEIIDLLVMYLNAGHESSAHITMWAIIFLVSHPRLYAEAKAEQEKIVNKRPDGQTHLIMYEIREMNYLRKIIDESLRMVNISLMVFREAMDDVEINGYTIPKGWKTQVWLRSVHMDPQVYPNPTKFDPDRWDKLIPKSGMFIPFGAGSRLCPGSDLAKMEICVFIHHLLFHYKIERLNPDCPVRYLPHPRPTDYCKGRVRKLST

SEQ ID NO: 28113 - protein, 334 aa, Dehalococcoides ethenogenes 195
MVTRIGINGFGRIGRITLRTINQYHRGELEVVAVNDLADNKSNAHLLKWDSTYGKYPGTVESDDCSIIVDGKPIKVFSERDPMQIPWETAGVDLVIESTGLFTDAAKASSHLRGSVKTVVISAPAKGEDITVVMGVNEEKYNCNTHRVISNASCTTNCVAPLIKVLHDKFGVKKGFMTTCHAYTNDQKIQDMFHKDIRRARAAAVNVIPTTTGAAKAVALVLPELKGKLDGISFRIPSASVSLVDFVGELARNVTVEEVNAAFKEAAQGKLAGILEYCEEELVSSDFKGNPASSIIDAPSTMVLDGNMVKVLSWYDNEWGYSTRLGDLIAYISK

SEQ ID NO: 28114 - protein, 309 aa, Mesembryanthemum crystallinum
FVGVYDGHGGPETSRYINDHLFHHLRRFASEHQCMSADVIRKAVQATEEGFLSIVSKQWPVKPQIAAVGSCCLLGVICNGMLYVANLGDSRAVLGRLVKATGEVLAVQLSTEHNACLEAVRQELRSTHPDDSHIVVLKHNVWRVKGLIQVSRSIGDVYLKKAEFNREPLYAKFRLREPFRRPILSSEPSISVHELQPHDQFVIFASDGLWEHLSNQKAVDIVQNNPHNGSAKRLVKIALQEAAKKREMRYSDLKKIDRGVRRHFHDDITVIVVFLDSNLVSRATTGSKGPHISVRGGGITLRSNTPAPS

SEQ ID NO: 28115 - protein, 103 aa, Zea mays
MSCRGKGRKGSGKGRAKRHRKGRGDNIQGITKPAIRRLARRGGVKRISGLIYEETRGGLKIFLENGIRDAGTYTEHARRKTGTGMDGVYALKRQGRTLYGFGG

SEQ ID NO: 28116 - protein, 586 aa, Ginkgo biloba
MITVRSIPCSFSKDTVQFIGFRKVLTVRNVVSCGVSSSFRLPGSKFFPRCESSSTERATKSNRTLLDNASNFLTNLLSGGQLGTMPIAEGAVSDLFGKPLFFSLYDWFIEHGSVYKLAFGPKSFVVVSDPIVVRHILRENAFAYDKGVLADILEPIMGKGLIPADLGTWKPRRKAIVPGFHAAFLEAMVKVFGDCSERTINKLQSLLLAAEADKTMHIDVDMEAEFSNLALDIIGLSVFNYDFGSVTRESPVIKAVYGTLFEAEHRSTFYIPYWKFPLARWLVPRQRKFHEDLKIINECLDSLIQGAKETRQEDDIEALQGRDYSKVKDASLLRFLVDMKGVDVDNGQLRDDLMTMLIAGHETTAAVLTWALFLLAQNTDKLVKAQAEIDTILDQRKPTFEDIKRLQYIRLIIAEALRLYPQPPLLIRRALRQDTIPGGYRGDKDGYLIPKGTDIFISVYNLHRSPYFWDQPHEFRPERFLIPKDNKGIEGWAGFDPYRSQGALYPNEVLADFAFLPFGGGPRKCVGDQFALMESTVGLAMLLQKFEVELKDPPESLRIVTGATIHTQNGLWCKIKRRKHYSESLQ

SEQ ID NO: 28117 - protein, 322 aa, Candidatus Protochlamydia amoebophila UWE25
MEKNKLDQLKSMTTIVIDTGDIEAIKEYSPTDATTNPSLILSAVEKPAYKPLMEEAYHYSQKAKSSGEQISLFLDKLFVNVGCEILKLIPGRVSTEVDARLSFDVEGSIQKAQSLIALYKEMGIEKERILIKLASTWEGGLAAKQLEKMGIHCNMTLLFSMPQAIHCAEAQATLISPFVGRILDWYKKHDNVPGYAPAEDPGVKSVTTIYHYFKKFSYKTQIMGASFRNKEEILELAGCDLLTISPHFLQELHDASGNVEQKLDAAKSKQLNIEPIKMNEKAFRLALNDDAMATEKLSEGIRNFAKDAQKLEKMLRTTYKIG

SEQ ID NO: 28118 - protein, 796 aa, Ashbya gossypii ATCC 10895
MADLSGTAVKREPEKGPASALDTTGDLPHIYDTVSVETPGPFETSEKKVDKEGADTEGDSGEFTDVLVEDDSPYPEVRAAVPSFDDTTMLQNTVRMWTIGLLMTTIGSAVNMLFSMHAPSMAVSTFVTSMLAWPLGRFWARWVPNVRIFGRFGGPFLNPGPFSLKEHALITVMGNISFGGGAAYATDILLSMNMFYKRDYGWLFDLLAIWSTQCIGFSLAGLCYKILITPPLMIWPSTLVQCTFLSNIHIHNNKVANGWKVSRLKFFMIIFIAGFIYYWLPGYLFQALSSFAWVTWIAPKNVVVNQIFGSSTGLGLLPITFDWNQIAGYVGSPLVPPISAIFTILCSMVTIFWIVVPIVHYSNTWYGNYVPISDSTSMDRFQQRYNVTKVVNQRLSLDLEAYHSYSRLYLPTTFAISYGMSFASVMATISHTACFHWRTIYNGVRNINTQDRDVHARLMERYKAPPYWWYLVTFFVFLALSIATVRAWDTQLPVWALFLALAIAGFFLLPVGIIYALTNMAVGLNVITEFIIGYMLPGRPIAMMFFKTFGYITNSQAITFAQDMKLGHYLKVAPKLMFTAQFIATIWGSTVQIAVLRWSEANIKGLCTKAQPGHFTCPGATVFFTASIIWGVIGPQRMFSAGQMYSSLNYFFVLGFFLPIVNWLILSKWSKRFEKSGRGLKFVAKYLSWPVFFSGTGLIPPATPYNYGSYCIVGIFFGYFIKRYYFQWWCKYNYSLSAALDIGLAWGALIIFFSTGIAVRKAPVWWGNTVIDTLDTNGQAIKYILQEGEYFDRASP

SEQ ID NO: 28119 - protein, 440 aa, Schizosaccharomyces pombe 972h-
MDAQSAPSGQVQVRFTTRNEDLAVGDTPIFVPTSLKRYGLSQIVNHLLKTEKPTPFDFLVQGQLLKTTLDEYIVQNGLSTESILDIEYIQSTLPPAYLASFSHDDWISGIQLTSDTILTSSYDGIARVWDKSGEIKFQSTGCGSSLKSASWHIPNQSFLTASLDQKIFHWVIEEPESMLDAEKKSSGILQTLFVGHKDIVERVRSLESSSVFISASADNTVGIWDFERSPETTLESFSSSISKKRRRKNAEFTPQAGARSPLILCEGHTGPVMDIVFSDDPSVAYSVGQDHTIKTWDLITGQNVDSKITKAPLLCVEKLTDLHLVICGSSARHIVVHDPRAGSDKIVSHTLSGHKNLVSGLSASPENPYMFASVSHDNTCRVWDVRATSGSIYTISRAEKTGSQWDKLFAVDWNKSIGIVTGGTDKQLQINQSSSFGKSE

SEQ ID NO: 28120 - protein, 1113 aa, Ashbya gossypii ATCC 10895
MSTAGISDEASASAFTTAGYCPQLIKGIDSVLIIGSGGLSIGQAGEFDYSGSQAIKALKETGKRTILINPNIATNQTSYSLADEVYFLPVTPEFITHVIKRERPDGILLTFGGQTGLNCGVALQRAVTLEKYGVTVLGTPISVLETTEDRELFARALKEINMPIAESVACSTVEDAVAAANDIGYPVIVRSAYALGGLGSGFADDDLQLRQLCAQSLALSPQVLVEKSLKGWKEIEYEVVRDRVGNCITVCNMENFDPLGIHTGDSIVLAPSQTLSDEEFHMLRTAAIEIIRHLGVVGECNVQYALQPDGLAFKVIEVNARLSRSSALASKATGYPLAYTAAKIALGYTLPELPNPVTKSTVANFEPSLDYIVAKVPRWDLSKFQHVDKTIGSAMKSVGEVMAIGRNFEEAFQKAFRQVDPSLLGFQGSDEFADLDEALQFPTDRRWLAVGEALMNRGYSVERVHELTKIDRFFLHKCMNIVRMQKQLETLGSINRLDEVLLRKAKKLGFCDKQIARAISDDLSELDIRALRKSFGILPFVKRIDTMAAEVPAVTNYLYVTYNAVKDDVTFGDNGIMVLGSGVYRIGSSVEFDWCAVNTVQALRKEGHKTIMINYNPETVSTDFDEVDRLYFEELSFERVMDIYEAECASGCVISMGGQQPQNIASQLYEQGANILGTSPEDIDKAEDRHKFSTILDTLGLDQPRWSELKSLSEVKHFLDDVGYPVLVRPSYVLSGAAMSTVYNSEDLEGVFESAVAVSPEHPVVISKFIEGAQELDIDAVAYKGSLLVHAISEHVENAGVHSGDATLVLPPQSLKEEEKTRLKQLAAQVAAAWNITGPFNMQIIKTAEGGHTCLKIIECNIRASRSFPFVSKVLGVNFVEIAVKAFLGGDLVPPSCDLMARSYNYVATKCPQFSFTRLPGADPFLGVEMASVGEVAAFGSNALESYWVALQGLMSFCVPLPPSGILLGGDLSKEHLGRVAALLAPHGFTLLALSEATCEYLSRYLPAESSVTVLQMPETGREVRALFEQHNVQCVVNLAARRASSPIDPDYRIRRSAIDFAVPLFNEPQTTMLFARALSAYLPAELEMRQSDGPETPSYVLPWREYLGFKPT

SEQ ID NO: 28121 - protein, 617 aa, Beta vulgaris
MTTAEALLSGSALWNPTFQSDIFLKPKLTHSGVFSCTKRLKGLRGKRNKWEIDCRRKIYPVPPCRTRVKRPGCLSSDGLNGPLFSGESEKLNPSSADVNAKPHVSELIASEKLAAAAAKSEKALRVKADSLEDEAWELLNESIVNYCGSPVGTIAANDPTSTSILNYDQVFIRDFVPSAIAFLLKDDYDIVRNFLLNTLQLQSWEKTMDCHSPGQGLMPASFKVRTVPLDGDDSATEEVLDPDFGEAAIGRVAPVDSGLWWIILLRAYGKCSGDLSLQERVDVQTGMKMILKLCLADGFDMFPTLLVTDGSCMIDRRMGIHGHPLEIQALFHSALRCAREMLTPEDGSADLIRALNSRLLALSFHIREYYWLDMRKLNEIYRYKTEEYSFDAVNKFNIYPDQIPPWLVDWMPEKGGYLIGNLQPAHMDFRFFSLGNFWSIVSSLATSGQSHAILDLFEAKWVDLVADMPIKICYPALEDQEWRIVTGGDPKNTPWSYHNAGSWPTLLWQLTVACIKMNRPEIAEKAVKVAERRISKDRWPEYYDTKGARFIGKQSHLFQTWSIAGYLVAKLLLANPEKAKILINEEDSELVNAFSSLIPRGRKRSRKGVGAKQSYII

SEQ ID NO: 28122 - protein, 186 aa, Xanthomonas axonopodis pv. citri str. 306
MTDCSRCAGTNTSGPNHWPERIRDIVDFPKPGIVFKDITPLLSDGPDFASALDEMAQPWRTTPLDAVLGIEARGFILGAALARELRTGFVPVRKPGKLPGRTLIQEYALEYGTDRIEMHEDALPRGARVLIVDDVLATGGTLRAALGLAAQLELEVVGAAVLVELQGLQGRQKWANDVPLLATLSY

SEQ ID NO: 28123 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 28124 - protein, 568 aa, Propionibacterium acnes KPA171202
MSVPFQYAHDDDGGLLRIAARGQEVLTNPLANRGTAFTIEQRKALGLTGLLPSGVMTITDQLKRVYAQYSAQPDDLAKYLYLNHMHDRNEVLYFRLLAEHIEEMLPIVYTPTIGKAIEEYSHWYDRPRGIYLSIDDPEDMEQALAQLGHGPDDVDLIVATDAEGILGIGDQGVGGVAITVGKLAVYTAAAGIHPHRVLPVILDVGTDNMERLNDDGYLGVRHPRVRGERYDEFVQQYVETAHRMFPHALLHWEDFAAGNATRILNKYRDDYCTFNDDIQGTAAVVVAAVLSAVKSSGIPLNDHRIVIHGAGSAGTGIANLLVQLMVSQGADEKTARSHFWGLGSHGLLREGLRLRDFQQPFARNKEELEGWTLDSPDQYTLGDVVRNVHPTILIGCSAQPGAFTEDIVKTMAAQCERPVIMPLSNPTRKAEALPSDVLTWTDGRALVATGSPFKPVMINGVTYQIAQANNALVFPGIGLGTIAVRASRVTSGMIAAAAEAVAMHIDNRVVGASLLPSIKSLRPLSASVAIAVAQQAMEEGVATEVTDNPVEKVFSAMWQPRYPRIAVV

SEQ ID NO: 28125 - protein, 371 aa, Xanthomonas axonopodis pv. citri str. 306
MGDTASGAARAPYLHSIGVCRAGSSCTCLRRAIAANSRRLRIGCEPDSGERCRLATVSSALASLLRPYLIPLPAHLTILPMPSRASRWFRPAILLLGSLTMTACSSVFFGGINAASGRSGIVEHRDQVFDPAHGLALDVYQPRGAVDAPMVVFFYGGTWKRGSRANYRWVGRALARQGVVAMVADYRKYPQVGLHGFMSDAAGATVWSYRHAHEYGGNPNRLAVMGHSAGAHMAALLGTDARWLQAQGLKPHQLCGVVGLAGPYDFMPMTDPELVEIFGDAPAAQRQSQPVRYVGGDEPPMLLLHGDADCVVELQNSISLQQALKREGGSAELKVYPGMGHLGILLALRKSPERSQVLSDTLQFVRQCRAP

SEQ ID NO: 28126 - protein, 361 aa, Sisymbrium irio
MKNEKGESSSTFKMGNSAQERGLPYVPDCYVVPPSYEPRDALDSNSEIVPTIDISRLKGSDDERQGVIQELRSACQLFGFFQIVNHGINQDILDEALVVANGFFQLPAKEKKKFMSNDVYAPVRYTTSLKDGLDKIQFWRIFLKHYAHPLHRWIHLWPQNPPGYREKMGKFCEEVRSLSLEIMGAITESLGLGRDYLSSRMDEDGMQVMAVNCYPPCPGPKTALGLPPHSDYSCITILLQNLTGLEIFNLSAHGGSGRWVLVPEVKGILKVHIGDHVEVLSNGLYKSVVHKVTLNEEKTRISLASLHSLGMEDKMSVPYQLVNNENPLRYRESSFKDFLDFLVKNDISQGNRFIDTLRIKD

SEQ ID NO: 28127 - protein, 758 aa, Synechococcus sp. CC9605
MGCALPEVRRHPIRHPDDYGIALPEWLRECIANVPPGIGQSCPTDAEALLVSAFDFGFQLHEGQFRASGDPYIVHPVAVADLLRDIGASAPVIAAGFLHDVVEDTDVTPDQIELHFGSEVRELVEGVTKLGGIHFNDRTEAQAENLRRMFLAMASDIRVVLVKLADRLHNMRTLGALKEEKRQRIARETREIYAPLANRLGIGRFKWELEDLAFKLLEPEAFREIQEEVATKRSEREQRLGVTVGLLNERLERAGLDHCEVSGRPKHLFGIWSKMQRQQKEFHEIYDVAALRILTPNVESCYRALAVVHDTFRPIPGRFKDYIGLPKPNGYQSLHTAVIGRHRPIEVQIRTLEMHHVAEFGIAAHWKYKEGGSPASSSSDAERFNWLRQLVDWQQEGGNDDHNDYLSSIKEDLFDEEVFVFTPKGDVLGLRKGATAVDFAYRIHSEVGNHCHGVRINDRLCPLPTPLQNGDFVRVLTSKTAHPSLDWLNFVATPTARNRIRQWYKRSHRDETIERGKDLLERELGRDGFDALLNSEAMQRVAQRCNVPTTEDLLASLGFGDVTLQQALNRLREEMRLLAEQQQAPPSNEDVAAALVPSRDPAADRSVGAGAILGLEGLDYRLGGCCSPLPGELIVGTVALGNHGITIHRQDCSNVETIPRERRLPVRWNTAHAEQEKQRFPVQLRIEVIDRVGILKDILLRLSDGAINVSDARVTTAAGKPARIDLRVELEGADQLSRTMDQIRSMADVIGIARVGTS

SEQ ID NO: 28128 - protein, 854 aa, Gibberella zeae PH-1
METTLPLPFLVSVASANDQPTNDGLNRQEIALLGAPFYETSSKDWGRPSAGTNVHMDATGLSDPDDVVALLDSGVRTVFVISESYSEYEQYGARVIPAVSSLILSSATEHGLLVKDFDVSSSDVDKFIEVAQSKQIKSLYVKPTPETDIEKFIEVAKKANAIPIIPSTRLTTDKNDSSRLLLSKLIASYWKSDRTDGLIPTVVTDDAGIALGLAYTSEESILEALRTQTGVYQSRKRGLWVKGLTSGDTQELLRIGLDCDNDTIKFVVNQKGRFCHLQQFGCFGDLNGISALEQTLKSRKESAPEGSYTARLFSDEKLLRAKIMEEAEELCDGKTKENIAFEAADLIYFALTKAVGAGVSLADIEANLDAKSLKVKRRTGNAKGKWAEKEGIKTEETPAKAPQPEAEKPADGRIAMERVDSTKISQADLVEKLKRPSQKSPDAILKIIKPIIEEVRTGGDKAVLSYTHKFEKATSLTSPVLKAPFPKELMDISPETIEAIDISFENIKKFHSAQQEEKSLQVETMPGIVCSRFSRPIERVGLYIPGGTAVLPSTALMLGVPAMVAGCQKIVFASPPRSDGRITPEIVYVAHKVGAESIVLAGGAQAVAALAYGTESVTKVDKILGPGNQFVTAAKMHVSNDTNAGVGIDMPAGPSEVLVVADKDANPAFVASDLLSQAEHGVDSQVILIAVDLSEQELQAIEDEVHNQAVALPRVDIVRGSIAHSVTVQVKDITDAMRISNDYAPEHLILQIKDAEKAVDQVMNAGSVFIGHWTPESVGDYSAGVNHSLPTYGFAKQYSGVNLGSFQKHITSSNLTADGLKNVGTAVMQLAKVEELEAHRRAVEIRLNYLKQQQ

SEQ ID NO: 28129 - protein, 638 aa, Thermoanaerobacter tengcongensis MB4
MKKTFYITTPIYYPSDKLHIGHSYTTVAADAMARFKRLTGYDVMFLTGTDEHGQKIQRIAREKGMSPKEYVDGIVEWIKDLWKTMDISYDHFIRTTDAYHEEIVQKIFMKLYEQGDIYKGEYEGWYCTPCESFWTESQLVDGKCPDCGRPVERVTEEGYFFRLSAYGDKLLKYYEEHPDFIQPESRRNEMINFIKAGLEDLFVSRSTFDWGIKVPFDPKHVIYVWIDALSNYITALGYMTENDEKFKKYWPADVHLVGKEIVRFHTIIWPAMLMALGLPLPKKVFGHGWLILEGGKMSKSKGNVVDPKELVDRYGVDAIRYFLLREVPFGADGVFSNEALINRINSDLANDLGNLLSRTVTMIEKYFDGVLPKPSSQEEIDEDLINVAQNLPQKVEEYMDKLQFSNALIEIWKLVSRANKYIDETMPWVLAKDESKRGRLGTVLYNLAESLRFIGILISPFMPNTPKKMFEQLGITEDLTTWESLKFGLLKEGTRVKRGEILFPRIDVEKELASLEKKTEEKTKETKEEKIDYITIEDFSKVQLRVAEILEAEKVEGSDKLIKMKLKVGEEIRQIVGGIGKYYSPEELIGKKIIIVYNLQPRKLMGIESQGMLLAATNEGKMALLTVDKDIESGSKIS

SEQ ID NO: 28130 - protein, 401 aa, Synechococcus sp. CC9605
MAKRSLASLNAGDLSGKRVLVRVDFNVPLNDTGAITDDTRIRAALPTINDLIGKGAKVILSAHFGRPKGQVNDAMRLTPVAARLSELLGKPVAKTDSCIGPDAEAKVGAMANGDVVLLENVRFFAEEEKNEAGFAEKLAGLAEVYVNDAFGAAHRAHASTEGVTKFLKPSVAGFLMEKELQYLQGAVDEPKRPLAAIVGGSKVSSKIGVLDTLIDKCDKVLIGGGMIFTFYKARGLSVGKSLVEEDKLELAKELEAKAKANGVQLLLPTDVVLADNFAPDANSQTADINAIPDGWMGLDIGPDSIKVFQEALADCQTVIWNGPMGVFEFDKFATGTNSIATTLADLSGKGCCTIIGGGDSVAAVEKAGLAEKMSHISTGGGASLELLEGKVLPGVAALDAA

SEQ ID NO: 28131 - protein, 139 aa, Prochlorococcus marinus str. NATL2A
MDQPDESLFEEALNRYKAGSPADELIEDFQKIASSTPNNAAAWTCLSWLQLLCDSPQEALRSARYAVKLNGQDPQSRINLSLALLETNSKGVRDHIDYVKRAMLVLPELEKELKESFEDGLSRKPDWKTLLKIKNWLDL

SEQ ID NO: 28132 - protein, 230 aa, Polaromonas sp. JS666
MHELTIPKNYPVSKNQAAASPSALSSLAPEGASGADGRRIQTRRSGVHGKGVFALQDLAEGETLIEYVGEVVTWKEALRRHPHDPKDPNHTFYFHIDEKHVIDAKYGGNSSRWINHSCKPNCEADEDEGRVFIKALRNIKAGEELFYDYGLIIDAKYTKKLKAEYPCWCGAKNCRGTLLAPKDKDNGKNAAKDKPKAKDKASDRADGKAKAKTKLDSKKSQAKKNKKKKD

SEQ ID NO: 28133 - protein, 247 aa, Oryza sativa (indica cultivar-group)
MEERPRDRTVEEAAAFSGDESDGEFEFPFVSRETDAGGVADELFADGRIRAFYPVFGRVLDDVAVTPAAAAEEERRPPLGRLFLEEGRTSSVGSTSSSSSTDIAELDGVSPDSYCVWVPGSSPASSPSRPPRKSGSTGSIARWRRISELVVGRSHSDGKEKFRFLSAPSSPARDHPKPKPTTKGGAAAATKLHTELDTIAAGHRLSYSPNHKAHGGATRRTFLPYRQDLMGIFANVNGLSRTHHRPF

SEQ ID NO: 28134 - protein, 191 aa, Schizosaccharomyces pombe 972h-
MVKVCLFVADGTDEIEFSAPWGIFKRAEIPIDSVYVGENKDRLVKMSRDVEMYANRSYKEIPSADDFAKQYDIAIIPGGGLGAKTLSTTPFVQQVVKEFYKKPNKWIGMICAGTLTAKTSGLPNKQITGHPSVRGQLEEGGYKYLDQPVVLEENLITSQGPGTAMLFGLKLLEQVASKDKYNAVYKSLSMP

SEQ ID NO: 28135 - protein, 160 aa, Glycine max
DIARRDDERDAIRSLDLLYRRVETEILKSEATPAMRLLNDLLNLHDGGDNEKWLKKCRKRMLEVFPREDPFTVVFPAGFNMENREGRIELPPQDDDLLLRVDFVREVDELLKEVRAVEDKNKQQIGFDPESVAYMLKQQEKMQTMRQVESLLDLASSLKW

SEQ ID NO: 28136 - protein, 414 aa, Arabidopsis thaliana
MAKSEKISLKLLVDEKKNKVVLAEAGQDFVDVLFGLLTFPMGTIARLLEKHQKLPQILGCYKNLSRSVSDMAVDDFKTEACKSMLLSPKSSMEIHCRRLKLHIDDTQATMFYVCSKKHESDSSKYSNFYKSRCSCGSLMIYQIHVPEDEQVVDSLGNAEDVVFVSCRSSFILTDDLKVMLNSIDEIVKVLNGLGYPNINDLKEMLIDVGSEEVLSLLGNLFTSESALTSTFLMKQCMTTMLTLSPPPMFKTGRVEQGSGCHIKVFVGKLDRKILYAECSEDFIDSLLTFLVLPLESASSFFEDNTIIGWQKVVTLNPIDPKTSKSCTSVVADSGFVKRNTKFIVSDDLIITPMNKFSTIGLLKKMQINMNDFEAQSICIYKAELVNILRASLTSSSALTNVLSNLLAKEPKKES

SEQ ID NO: 28137 - protein, 407 aa, Wolinella succinogenes DSM 1740
MFDEIQFDKIKRLPKYVFAAINEIKLEMRRNNEDVIDFSMGNPDGITPAHIIDKLCEAAQKPKNHGYSASRGIYKLRLAICNWYKRKYNVDLDPELEACAVMGSKEGYVHLVQAIANFGDSAVVAEPVYPIHYYAFIIVGANVTKFGLKWNDRFELDEDDYFENLKRSLRETMPKPKFVVVNFPHNPTTVVVKKSFYERLVALAREERFYIISDIAYADLTFDGYSTPSILEVEGAKEVAVESYTLSKSYNMAGWRVGFVVGNPKLVGALQKIKSWIDYGMYAPIQVAATIALDGPQECVEEIKGKYEKRMDVLIKSFSEAGWEMDKPQASMFIWAKLPECAQGLGSLEFSKRLLREAKVAVSPGVGFGEHGEGYVRIALIENEKRIRQAARNIKQFLKTLQNTKEA

SEQ ID NO: 28138 - protein, 611 aa, Propionibacterium acnes KPA171202
MSAPQPGSTDPAVIRNFCIIAHIDHGKSTLADRMLQITGVLDERSARAQYLDRMDIERERGITIKSQAVRMPWEVDGVTHLLNMIDTPGHVDFSYEVSRSLQACEGAILLVDAAQGIEAQTLANLYLALEADLEIIPVLNKIDLPGAESDRHAAEIAGIIGCDESEVLRVSAKTGEGVSDLLDTIVAKVPAPEGVADAPARALIFDSVYDTYRGVVTYVRVVDGALRHREKILMMSTGAAHEVLEIGVISPEMVPAQGLSVGEVGYLITGVKDVRQSRVGDTVTNASKPSEKDLGGYQHPKPMVYSGLFPIDAKDFPDLRDALDKLQLNDAALVYEPETSTALGFGFRVGFLGLLHMEIVRERLEREFDLDLISTAPSVVHHVLMEDGSTVAVTNPSEYPTSGRIAEVREPIVDATILSPAEYIGTILELCQQRRGVQQGLDYLSSDRVEIRYRLPLSEIVFDFFDQLKSRTKGYASLDYHEAGEQAADLVKVDILLNGDPVDALSSIVHRDKSYSYGVAMAAKLKELIPRQQFEVPVQAAIGARVIARETIRAVRKDVLAKCYGGDISRKRKLLEKQKAGKKRMKVVGSVEVPQEAFVAALRTGESTEKK

SEQ ID NO: 28139 - protein, 458 aa, Sisymbrium irio
MEFTEAYKQTGPCCFSPNSRYVAVANDYRLVIRDTFSFQVVQLFSCLDKISYIEWALDSEYILCGLYKKPMIQAWSLTQPEWTCKIDEGPAGVSYARWSPDSRHILTTSEFQLRLTVWSLLNTACVHVQWPKHGSKGVSFNQDGKFAAICTRRDCKDYVNLLSCQSWEIMGSFAVDTLDLADLEWSPDDSSIVVWDSPLEYKVLIYSPDGRCLFKYQAYECGLGVKTVSWSPCGQFLAIGSYDQMLRVLNHLTWKTFAEFLHLSTVRAPCCAAIFKEIDEPLQLDMSELSLDDNFMPSNYDASEGYISVRYEVMELPVAFPFQKPPADKPNPKQGVGLLAWSKDSQYICTRNDSMPTALWIWDMQRLKVATILVQKEPIRAAVWDPTCTRLLLCTGSSHLYMWTPSGAFCVCNPLPGFSITDLKWNIDGSCLLLKDKDAFCCATVPPLPESSDYSSDD

SEQ ID NO: 28140 - protein, 264 aa, Zea mays
  misc_feature (34)..(34): Xaa can be any naturally occurring amino acid
  misc_feature (49)..(49): Xaa can be any naturally occurring amino acid
  unsure (1)..(264): unsure at all Xaa locations
RGSEAPGSKCTRDMEATSFARRSVAAPRPPHAKXRRRHPLRLRRGTGPXHCSPLRAVVDAAPIQTTKKRVFHFGKGKSESAILGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNT

SEQ ID NO: 28141 - protein, 355 aa, Salmonella typhimurium LT2
MSQKYLFIDRDGTLISEPPSDFQVDRFDKLAFEPEVIPVLLKLQKAGFKLVMITNQDGLGTQSFPQADFDGPHNLMMQIFTSQGVCFDEVLICPHLPADDCDCRKPKVKLVERYLAEQAMDSANSYVIGDRATDIQLADNMGITGLRYHRETLNWTMIGEQLTKRDRYAHVVRNTKETQIDVSVWLDREGNSKINTGVGFFDHMLDQIATHGGFRMEITVKGDLYIDDHHTVEDTGLALGEALKLALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 28142 - protein, 336 aa, Nicotiana tabacum
AGFAGDDAPRAVFPSIVGRPRYTGVMVGMGQKDAYVGDEAQSKRGILTLKYPIEHGIVSNWDDMEKIWHHTFYNELRVAPEEHPLLLTEAPLNPKANREKMTEIMFETFNVPAMYVAIQAVLSLYASGRTTGIVLDSGDGVSHTVPIYEGYALPHAILRLDLAGRDLTDYLMKILTERGYSFTTAAEREIVRDLKEKLAYVSLVFEQELETSKNSKDVEKSYELPDGQIITIGAERFRCPEVLFQPSFIGMEAVGIHETTYNSIMKCDVDIRKDLYGNVVLSGGSTMFPGITDRMSKEISALAPNSMKIKVVAPPERKYSVWIGGSILASLSTFQQ

SEQ ID NO: 28143 - protein, 203 aa, Methylobacillus flagellatus KT
MQIKEPLRVGIGGPVGSGKTALTLALCQRLRNVYNIAVVTNDIYTREDAEFLTRNEALAPERIIGVETGGCPHTAIREDASMNLEAVAQLSERFNPLDIVFVESGGDNLAATFSPELSDLTIYVIDVAAGEKIPRKGGPGITKSDLLVINKIDLAPMVGASLEVMEKDARRMRGERPFIFTNLKRGQGLEDIVGFIEKQGLML

SEQ ID NO: 28144 - protein, 758 aa, Dehalococcoides ethenogenes 195
MQKGHEAIVWFNEVTKNDIPLVGGKGANLGEMTGAGIPVPPGYIVTANAYFDFINSSNLRPSISKALESLDINDSKQLAVVANSVKEMIMATPLPTELASQIKAAYEKMGQGLVAVRSSATAEDLPEASFAGQQSTYLNIEGGDEVVEAVQKCWASLFEARAIYYRVQQNFDHLQVGIAVPVQKMVQSQASGVCFTIEPITSDPTKIVIEAIYGLGEGLVSGEITPDLYIIDKEGPAVLSRTISHQERRLVRKNGNSASGPEDESGNNYWQPVPSTKQEQQKITEDDIITLAKLAMLIEKHYNGPQDIEWAKEENTIYIVQSRPVTALKDASELEPEIEAPIMLQGAAASPGLATGEVKVLQDPSEIDLVLQGDILVAEMTTPDFVPAMKRAAAIVTNRGGRTSHAAIVSRELGIPCVVGTGEATRLLKNEQIITVDGTHGKVYNGKVTRNVKTSNIASIVREAIRTKTRVYVNLAQPELADKVAARNVDGVGLLRAEFIFSQIGKHPRYMIEMGQQEEYIQQVYEGVLSFAKAFHPRPVVYRTNDFKTNEYRDLLGGDKYEGQEENPMLGYRGVSRYIKDIEVFKMEIEAIKRVRKDYPNVYVMLPFVRTVDELKKVKQILEDEGLKRGPDFKLWMMVEVPSNIFLIDKFIDAGIDGISIGSNDLTQLILGVDRDSEMLRETFDERNEAVLVALEKAVTTAARRGITASICGQAPSVYPELTEKLVSWGITSVSVSPDMIGTTREIIAKAEAKLKIK

SEQ ID NO: 28145 - protein, 336 aa, Nicotiana tabacum
AGFAGDDAPRAVFPSIVGRPRHQGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRGLTDYLMKILTERGYMFTTSAEREIVRDVKEKLAYVALDFEQELETAKSSSSVEKSYELPDGQVITIGAERFRCPEVLFQPSFIGMEAAGIHETTYNSIMKSDVDIRKDLYGNIVLSGGSTMFPGIADRMSKEITALAPSSMKIKVVAPPERKYSVWIGGSILASLSTFQQ

SEQ ID NO: 28146 - protein, 560 aa, Aspergillus oryzae
MVPAMSRKNRVWSRREIEGLIADGRKIIILGDQVLKVDTWIPYHPGGNKSILHMVGRDATDEITALHSKEAQAHMQKYVIGTINGRWENFLPPIQGGIFRPLASKGVDDETLDAEEDISSSGKSTPPSPVFDPVEKGDGVRRRRTGTETPISRASSVYSSELELAPFGSAEASIAHAISSDLSKYPRLDQKSQDEVVTKYRQLDAKLQSEGLYDCPYSSYAVEFIRYSVLCVLFLTSLHYSYYALSGLFLGLLWHLLAFTVHDAGHLSITHGFHTDSCIGIFVADFLGGLSVGWWKRNHNVHHIATNSPEHDPDIQHMPFFAISSRFFTSLRSTYYDRDMNLDAAARFFIKYQHYLYYPILLFGRFNLYRLAWSYLLDPAQAPRKGSAWWHRYLEMAGQVFFWYWYGYRTLYLSIPTWSSRITFLLISHMVTAPLHVQLTLSHFAMSSADVGVHESFAQKMVRTTMDVDCPSWLDFIHGGLNFQVVHHLFPRLPRHNLRRAQPYVKEFCQDVGMPYVIFGFTRGNKEVISRLGEVAEQLRVLEECRKVAARDLVEGRHGH

SEQ ID NO: 28147 - protein, 538 aa, Prunus cerasus
MADRRAEYNAVVSGQPQKNIADFDPPGKPKRNKYAFACAILASMTSILLGYDIGVMSGAVIYIKKDLKVSDVEIEVLVGILNLYSLIGSAAAGRTSDWIGRRYTIVLAGAIFFAGALLMGFAPNYAFLMFGRFVAGIGVGYALMIAPVYTAEVSPASSRGFLTSFPEVFINAGILFGYVSNYGFSKLPTHLGWRLMLGVGAIPSIFLAIGVLAMPESPRWLVMQGRLGDARKVLDKTSDSLEESKLRLGEIKEAAGIPEHCNDDIVEVKKRSQGQEVWKQLLLRPTPAVRHILMCAVGLHFFQQASGIDAVVLYSPRIFEKAGITNPDHVLLCTVAVGFVKTVFILVATFMLDRIGRRPLLLTSVAGMVFTLACLGLGLTIIDHSGEKIMWAIALSLTMVLAYVAFFSIGMGPITWVYSSEIFPLQLRAQGCSIGVAVNRVVSGVLSMTFISLYKAITIGGAFFLFAAIAAVGWTFFFTMLPETQGRTLEDMEVLFGKFYRWRKANALLKQKKQVDHGDGNNNPNNPQIQLGTKGQAN

SEQ ID NO: 28148 - protein, 203 aa, Salmonella typhimurium LT2
MLTEQQRRELDWEKTDGLMPAIVQHAVSGEVLMLGYMNPQALDKTIESGHVTFFSRTKQRLWTKGETSGHVLNVVSIAPDCDNDTLLVLANPVGPTCHKGTSSCFGDASHQWLFLYQLEQLLAERKTADPTSSYTAKLYASGTKRIAQKVGEEGVETALAATVNDRFELTNEASDLMYHLLVLLQDQDLNLTTVIDNLRKRHQ

SEQ ID NO: 28149 - protein, 163 aa, Triticum aestivum
  misc_feature (2)..(2): Xaa can be any naturally occurring amino acid
  misc_feature (8)..(8): Xaa can be any naturally occurring amino acid
  misc_feature (10)..(10): Xaa can be any naturally occurring amino acid
  misc_feature (23)..(23): Xaa can be any naturally occurring amino acid
  misc_feature (28)..(28): Xaa can be any naturally occurring amino acid
  misc_feature (37)..(37): Xaa can be any naturally occurring amino acid
  misc_feature (49)..(49): Xaa can be any naturally occurring amino acid
  misc_feature (52)..(52): Xaa can be any naturally occurring amino acid
  misc_feature (54)..(54): Xaa can be any naturally occurring amino acid
  misc_feature (58)..(58): Xaa can be any naturally occurring amino acid
  misc_feature (63)..(63): Xaa can be any naturally occurring amino acid
  misc_feature (71)..(71): Xaa can be any naturally occurring amino acid
  misc_feature (87)..(87): Xaa can be any naturally occurring amino acid
  misc_feature (92)..(92): Xaa can be any naturally occurring amino acid
  misc_feature (110)..(110): Xaa can be any naturally occurring amino acid
  misc_feature (114)..(114): Xaa can be any naturally occurring amino acid
  misc_feature (117)..(117): Xaa can be any naturally occurring amino acid
  misc_feature (132)..(132): Xaa can be any naturally occurring amino acid
  misc_feature (134)..(134): Xaa can be any naturally occurring amino acid
  misc_feature (139)..(139): Xaa can be any naturally occurring amino acid
  misc_feature (146)..(146): Xaa can be any naturally occurring amino acid
  unsure (1)..(163): unsure at all Xaa locations
MXPTVMAXSXTSVAPFQGLKSTXGLPVXRRSNGASLXSVSNGGRIRCMXVWXIXGIKXFETLXYLPPLSTXALLKQVDYLIRSKWVXCLEFXKVGFIFREHNASPGYYDXRYWXMWXLPMFGCTDATQVINXVXEVTKXYPDSYVXIIGFDNIRQVQLRQASP

SEQ ID NO: 28150 - protein, 136 aa, Cucumis sativus
VFGILSMLTGLVLYDRLLVPFAKKLTHNPSGITCLQRMGVGFAINILATLVSSIVEIKRKKVAASHGLLDNPTATIPFSVFWLVPQFWLHGIAEVFMSVGHLEFMYDQSPESLRSTATALYWLAISVGNYIGTLMV

SEQ ID NO: 28151 - protein, 434 aa, Bacillus clausii KSM-K16
MNRKTSESLYQEAQHVIVGGVNSPSRAYKGVGGGTPVFMERGEGAYFYDVDGNRYIDYLAAYGPIITGHAHPVITKAIQDQAAKGVLFGTPTRLENEFAQELTNAIPSLEKVRFVNSGTEAVMTTIRVARAYTGKEKIIKFAGCYHGHSDLVLVAAGSGPSTLGTPDSAGVTAATASEVITVPFNDIEAFKEALAHWGSETAAVLVEPIVGNFGIVEPEPGFLEAVNDLAHSAGALVIYDEVITAFRFMYGGAQDYLNVKPDMTALGKIIGGGLPIGAYGGRMDIMEQVAPLGPAYQAGTMAGNPASMSAGIACLEVLRTEGVYEKLDELGARLEEGLYLAAAKANVPISINRLKGALTVYFTDEPVIDYEGAKRSNGDQFSVFFKAMLNEGIHLAPSKYEAWFLTIAHTKNDIDETIEAAYRSFKTVAAGFYS

SEQ ID NO: 28152 - protein, 336 aa, Solanum tuberosum
AGFAGDDAPRAVFPSIVGRPRHAGVMVGMGQKDAYVGDEAQSKRGILTLKYPIEHGIVNNWDDMEKIWHHTFYNELRVAPEERPVLLTEAPLNPKANREKMTQIMFETFNAPAMYVAIQAVLSLYASGRTTGIVLDSGDGVSHTVPIYEGYALPHAILRLDLAGADLTEYMVKILTERGYSFTTTAEKEIVRDMKEKLAYLALDFEQELETTTTGSAVEKNYELPDGQVITIGAERFRCPEVLYQPSLIGMEAAGIHETTYNSIMKCDVDIRKDLYGNIVLSGGSTMFPGIADRMSKEIQALAPSSMKIKVVAPPERKYSVWIGGSILASLSTFQQ

SEQ ID NO: 28153 - protein, 91 aa, Triticum aestivum
NKFVQKSIPLPVRNSRDIVDPRVRKFCSMKITEDIRKYADEHGYGTVEEAVRQGMSEMSAEFLAARKTISGEQHGEAGGEIYVPESYVVQK

SEQ ID NO: 28154 - protein, 495 aa, Xanthomonas axonopodis pv. citri str. 306
MYAPLALYDTAAARTLDAQATTLLGGDGYTLMQRAGQAAWQWSLERWPQARRLVVVCGTGNNGGDGYVLARLAHRAGRQVRVVHLPEHGPGSDLAQRACTDYLAVGGAIELFPYPLGQADVIVDALFGIGLNRAPDDATAALIDAINAAGVPVFALDVPSGIDADHGVAFGAAVRAARTLQFIVPHLGLYTGDALEHAGEREVASLEVPVSAFDGLTPVAHSWNSDALAAQLRPRRRNTHKGESGRVLCVGGNLGSGGAIMLTAEAALRSGAGLVQVATRAEHVTPLLARCPEAMARAVQADDDIATLAEAADAVALGPGLGQDDWAQALWRAALGAATAVVLDADGLNLLAANDVPVHGPRVLTPHPGEAGRLLGLSTRQIQRDRPAAAAALATRYDAVVVLKGAGTVVASPSNLPRIIDAGNPGMAVGGMGDLLTGVIAALLAQGFSPFDAASLGALLHACAGDAAAHAGERGLLPTDLLPELRRLANAGAIA

SEQ ID NO: 28155 - protein, 950 aa, Pseudomonas putida KT2440
MLELANEQIAMGQKAADKAEALRLLADRLVADGLVAEGYLQGLQAREAQGSTFLGQGIAIPHGTPQTRDLVYATGVRLLQFPEGVDWGDGQMVYLAIGIAARSDEHLRLLQLLTRALGETDLAEALRRASSAEALLKLLQGAPQALALDAQLVGLNVPAEDFDELAWRGARLLQRADCVDSGFAAVLQQAEPLPLGEGLWWLHSERQVRQPGLAFITPQQPLRYRDQPLNGLFCLASLGAAHEALLERLCEVLIEGRGQVLYQATSSRAVLEVLGGEVPADWPSARVVLANPHGLHARPAKVLAQLAKGFEGEIRVRLVDSAQPAVSVKSLSKLLSLGARRGQALELVAEPSIAADALPVLLAAIEQGLGEEVEPLPQSVAPIADDVPEVLQAPAAGSRIQGVGAAPGIASGPAHVCVEREFDYPLRGESCALERQKLREALATVNGELQALVLRSDKAIGEIFVTHQEMLADPALTDDVEQRLAQGESAAAAWMAVIEAAARQQEALHDALLAERAADLRDIGRRVLAQLCGVQAQVEPEQPYVLVMTEVGPSDVARLDPNRVAGIVTAQGGATAHSAIVARALGIPAVVGAGASILLLESGTPLLLDGQRGVVSVAPPADELQRALAERDLREQRLQAAWANRFEPAITRDGHAVEVFANIGDSNGIAKVVEQGAEGVGLLRTELIFMAHPQAPDVATQEAEYRRVLDGLDGRPLVVRTLDVGGDKPLPYWPIAAEENPFLGVRGVRLTLQRPQVMEDQLRALLRAADQRPLRIMFPMVGQVHEWREARAMVERLRAEIPVADLQLGIMVEVPSAALLAAQLAREVDFFSIGTNDLTQYTLAIDRGHPSLSAQADGLHPAVLSLIDMTVRAAHAHGKWVGVCGELAADPQAVAVLLGLDVDELSVSARSIAEVKALVRQADHQTARALAREALQQDSAAAVRALVERY

SEQ ID NO: 28156 - protein, 471 aa, Nostoc punctiforme PCC 73102
MSSKIKFGTDGWRGIIADDFTFPNVRKVTRAIATYLETAYTKNRPVLIAYDTRFLADQFAKTAAQVLADLGWTVKITVRDCPTPVIAYNARHLNSAGALMFTASHNPAPYCGIKYIPDYAGPATPEITDTIVANIESASDELPGSNPSGSISIFDPKPDYLQFIYTLLDIEKIKRANLKVKYDALYSTSRGYLDEVLQHSGVQLESFHDWRDVLFGGGMPEPKGEQLVELVEAVVRDQADLGLATDGDSDRFGIVDEQGTVLTPNTVLLVLARHLIKNKGKTGAIVRTVATTHLLDNFAAKNGLQIYETAVGFKYIGEKMRETAVLIGGEESGGLSIIGHIPEKDGVLADMLVAEAIAYEGKPLSQMVKEAIAEADGPLYNNRLDLHLTEAHKTAVIDSFTKNPPTEVVGIKVKEVGRKDGIKLYLEEGSWVLLRPSGTEPLVRVYLETNTPEKLTQIAQELESVIAKLEG

SEQ ID NO: 28157 - protein, 852 aa, Arabidopsis thaliana
  misc_feature (307)..(307): Xaa can be any naturally occurring amino acid
  unsure (1)..(852): unsure at all Xaa locations
MEFSELKEAIEKIELVDAHAHNIVSLDSSFPFIGTFSEAAGDALTFAPHSLSFKRNLREIAQLYGTEVSLEAVEEHRKTSGLDSFTSKCFKEARISALLIDDGLKLDKKHDIEWHRNFVPFVGRVLRIETLAEQILEEECPGGYFYGSESTEPPVWDLDSFTKTFVERLSSLVPEIVALRTIAAYRSGLDIDTYVSKEVAENGLVEVLRAGKPVRIGNKGLIDYILTISLEVAVRRDLPLQIHTGFGDKDLDLRLSNPLHLRTLLEDKRFGKCRIVLLHAAYPFSKEASFLSSVYPQVYLDFGLAVXKLSVHGMVSSVKELLDLASIKKVMFSTDGYASPETYYLGAKKAREVIFLVLSDACASGDLSLMEAIDAAKDIFSRNSIGFYKLNIDTDSSSPQNIISPKLKIKEPDVQEDSSSFVRIIWVDTSGQQRCRAVQAQRFNRSVKKNGVGLTFASMGMTSFTDGPAEESKLTGVGEIRLVPDLSTKQTIPWTKQESMVLADMQLKPGEAWGYCPRETLRRVAKVLKDEFDLVMNAGFENEFYLLKNVVREGKEEYMPFDFGPYCATSSFDAASPIFHDIVPALESLNIEVEQFHAESGKGQFEVSLGHTIASHAADNLVYTREVIRSVARKQGLLATFVPKYDYCDIGSGSHVHLSLWKNGENVFPASNNSSSHGISSVGEEFMAGVLFHLPSILAIIAPLPNSYDRIQPNTWSGAFQCWGKENREAALRAASPPGTPDGLVTNFEIKSFDGSANPHLGLAVIMAAGIDGLRRHLQLPTPIDINPADVAATLNRLPETLSEAVEALDKDKVLHDLLGQKLLVAIKGVRKAEVEYYSKNPDAYKQLIHRY

SEQ ID NO: 28158 - protein, 230 aa, Arabidopsis thaliana
MASSSSLASSTKLVFFACLFLFTFSYNVVAGESDKVKLNLYYESLCPSCQNFIVHHLGKIFNTDLHTITDLKLIPFGNAHVSDDLTVTCQHGEEECKLNALEACAIRTWPNQRLHYKFIRCVETNTNAWESCVKKYGGEKAINDCYNGDLSKELILGYANQTLSLKPEHKYVPWMTLNGEPLYENIGDFVDLVCKAYKGKAALPKLCYSSVLSQRTMMLEFSYVDEAINH

SEQ ID NO: 28159 - protein, 430 aa, Synechococcus sp. CC9605
MIDSLDLVIDTIVAREVLDSRGNPTVEAEVLLEGGAMGRAIVPSGASTGAHEAHELRDGGDRYMGKGVGQAVNHIEERIATALCGLSALDQAAVDAAMLELDGSDNKSNLGANAILAVSMATARAAANGLGIPLYRYLGGPMANLLPVPLMNVINGGAHAANSLDFQEFMLVPHGAPSFREALRMGTEVFHTLKKLLSDKGMSTAVGDEGGFAPDLGNVEAGEILVEAISKAGYKPGEQISLALDVASTEFFENGRYAFDGGSYTSAEMVGQLEQLVEKFPIVSIEDGLAEDDWDGWKLLTERLGGKVQLVGDDLFVTNTKRLQQGIDSATANSILIKVNQIGSLTETLQAIDLAGRSGYTSVISHRSGETEDTTIADLSVATRAGQIKTGSLSRSERVAKYNQLLRIEDELGSQAVYAGAVGQGPRGKA

SEQ ID NO: 28160 - protein, 545 aa, Oryza sativa (indica cultivar-group)
MASPNSEALERYKNAITAASSVVGAAMLLRRIVADVLPDTALGALLLLPPPSSRRHCVVIEEFDGAFYNRVFLAAKAYVSTLLAAAPVPLMKASLPRGAGAEQITLAMRPGTAVVDVFDGAELTWRLSSHGGGGGGRRRGGDDAREVFKLSFDGRHKDMVLGAYLPAVMARVAAMSQGQRQAKLYSNEWGKWRPVRLRNASTFATLAMDAALREAVVDDLDRFLGRKEYYERTGRAWKRGYLIHGPPGTGKSSLVAAISNHLRFDVYDLELGGVRSNTELRKLLIRMKNRSILLIEDVDCAVVAAPRREPHGGPDGSNPPSVNRKVTLSGLLNMVDGLWSSSGHERILIFTTTHVDRLDQALLRPGRMDMHVHMGYLGFGAFRELAATYHGVAGDDHPLFPEIEALLREVEVAPAEVAERLLMTDDAGAAIEMVAKLLRDRKAGTEEDGGGDGVESAAEDEDGDRGIPATRETVMYMVFSCADSRVCPTLTFGLQPGEAFTVRNIASMVPAYDKRGQCSIGSAIEYAVVVLKVTSSLRIINVLLI

SEQ ID NO: 28161 - protein, 506 aa, Burkholderia pseudomallei K96243
MNHADMQHLNIEFPYRKQYGNFIGGEWVAPVGGEYFDNVSPVTGRPFTAIPRSREADIELALDAAHAAKAGWAAKGAAERANVLLRIADRMEANLTRLAVAETIDNGKPLRETTAADVPLAIDHFRYFAGCIRAQEGSIADIGGDMVAYHFHEPLGVVGQIIPWNFPLLMAAWKLAPALAAGNCVVLKPAEQTPASILVFAELIQDLLPPGVLNIVNGFGLEAGKPLASSKRIAKIAFTGETSTGRLIMQYASENLIPVTLELGGKSPNIFFADVMDRDDSYFDKALEGFAMFALNQGEVCTCPSRALVEESIYDRFIERALKRVEAIKQGHPLDSQTMIGAQASAEQLEKILSYIDIGRGEGAQCLTGGERNVLGGELAEGYYVKPTVFRGHNKMRIFQEEIFGPVLAVTTFKTEEEALEIANDTLYGLGAGVWTRDGNRAYRFGRGIQAGRVWTNCYHAYPAHAAFGGYKQSGIGRETHKMMLDHYQQTKNLLVSYSEKPLGFF

SEQ ID NO: 28162 - protein, 282 aa, Oryza sativa (indica cultivar-group)
MEQLGYRWMSQLLALTIYAILLMPGFLQVLSWFTVGYYYFFSSQVRRSIVYGEQPRNRLDLYIPKDINRPCPVVAFVTGGAWIIGYKAWGSLLGRRLAERGIIVACIDYRNFPQGTIGDMVSDASQGISYVCNNIASYGGDPNRIYLVGQSAGAHIAACALIEQAVKESSGQSISWSVTQIKAYFGLSGGYIGSCCHVLQTFADVLQQAGAQAKLQLYEGKTHTDIFIQDPLRGGRDPLVEDVLSIIHVDDEITQEKIALAPAPRRLVFEWQLQLARRFSPF

SEQ ID NO: 28163 - protein, 745 aa, Pseudomonas syringae pv. syringae B728a
MSQLDKDAFEVLLANCADEPIQFPGAIQPHGLLFTLAEPELTILQVSANVQTVLGHVPEQLLGKGLDCVLGAGWAEVIRSASAHDSFIDAQRLLMSINGIEFEALLHRHQGVLVLELEIQGKDAQSVSYSERTGNMGRMLRQLHAASDLQTLYEVSVREIQKMTGYDRVLIYRFEEEGHGQVIAEASAPSMELFNGLFFPASDIPEQARELYRRNWLRIIPDADYIPVPLVPQLRPDTQQQLDLSFSTLRSVSPIHCQYMKNMGVLSSMSVSLIQSGKLWGLISCGNRTPLYVSHELRSACQAIGQVLSLQISAMEALEISRQREAKVRALEQLNLAMAGSEENVFDGLAQQPQLLMDLVGATGVAIIEDRQTHCFGICPEPSDIRALHAWMIAGGEPVYASHHLSSVYAPAEAYQPVASGVLAMSLPKPVDNGVIWFRPEVKETVQWSGDPKKPLNMESSAGGMRLRPRTSFEIWKVEMTGIATKWSYGDVFAANDLRRSALENDLARQVRREQQAVRARDELVAVVSHDLRNPMTVISMLCGMMQKSFSSDGPHTSRRISTAIDTMQQAASRMNVLLEDLLDTSKIEAGRYTITPQPLEVSQIFEEAYTLLAPLAMDKSIEISFNAEPDLKVQADPERLFQVLSNLIGNAIKFTPKMGTIGVAAMSNGTEIVFTVRDSGEGIPPEQLPHIFERYWTVKEGNPTGTGLGLYISQGIIKAHGGELAAQSQVGEGSEFRFTVPMAV

SEQ ID NO: 28164 - protein, 352 aa, Yarrowia lipolytica CLIB122
MQTLSEFADRHAFHSASDSVALYHSIPPHQRPAQATLKLRERALSADNEHEYADDMIAHMHMLEKAYSCDTDMMRQQPHVTFANRREALEDVVNSHRYFDLSSDTLFTAVALLDRYTSKCIIVDGYYPLVALAALWIAAKYVERKVAVPTLDQLHRLQPAYSKREYLQMEGYMLNVLEWSVSAPTADAFLDMFIGTTDPIFDDKFRTLRLFGLYLCECALFNEQLIDARKSSVAMAAQLLAMYYTHGIPDYPVSPRPDVNFIINQLETQAVPACIQSKYASTKFEFMRNAIGLRGGETPDPEDVMMTPPVTPERSKRYGFVGAQNQPQTQPQTQAIPKQPYDYGYNQGYYHS

SEQ ID NO: 28165 - protein, 570 aa, Kluyveromyces lactis NRRL Y-1140
MSLSDDEDFNDIYGDENTAQTTVNNNESTSSTATSTDNQNNTQSNNNQNNVSNSSTDDHKDQASTTNKEANSSSTNTTAATSQLDQLAALQALSSNLSQLQQQVASSNNQPDSNLASNNDKAENNNKENYSASVPEMLQMPQMPQMPGMPDMSQLQQLQQTMSQLQQTASQHEPKAIKADLSRDINKMFIGGLNWETTEEGLRDYFSKYGAVAEVKIMKDTATGRSRGFGFLTFENASSVDEVVKTQHILDGKVIDPKRAIPREEQDKTGKIFVGGIGPDVRPKEFEEFFSQWGSIIDAQLMLDKDTGRSRGFGFITYDTPDAVDRVCQNKFIEFKGKQIEIKRAEPRQLQKQKQPQMTQPMGQNMSNPMQQYQMFQNPMMAGGFNPMMATGFNPQSMNEYYTKMQEYYQQMQQQTGIDYTQMFQQQMQQMQQMMGMMGGLPAGQQPSQSGAGSPPSHSSTPQHNDDSNGVTTIGSSNNGNRSNSGVESGDDSRYDNSSSRDDSRRSGHRAYDRNSDRSSYGSSNRDRDSCRGPSSNYRGGGGRDRDSRRGGNGYGGGSRDRRGYHPYAR

SEQ ID NO: 28166 - protein, 339 aa, Polaromonas sp. JS666
MTQGELQATMHALVQKGKGILAADESGPTIAKRFKTINVESTEENRRAWRSLLLTTPGLGEFVSGVILHEETLGQATDDGTPLPQCAARQGIVAGIKVDAGKIPLAGAPGDEITQGLDGLAGRLAAYQRQGARFAKWRAVYNVSDTLPSRLALEANAEALARYAAICQEQGIVPIVEPEVLIDGDHTMARCAEVTEAALHEVFHALHRHRVVLEHMLLKPSMVVPGKTHAHQAAPAEVAVQTVRILRRTVPAAVPSINFLSGGQTPEEATANLDAMNLLGPQPWQLSFSYGRALQEPALQAWKGQAAHARSSQDALLKRARLNGAACRGRYSAAMEAAD

SEQ ID NO: 28167 - protein, 200 aa, Oryza sativa (japonica cultivar-group)
MRTAGPSSTSPPPPATPRQVVRVLAAMGGDAAASVVNGKDEEGWAPIHTAASSGKAEIISILLDQGANVDLTTDAGRTALHYAASKGRLNIAETLIAHSANVNKKDKFGCTPLHRAASTGNAELCEFLIEEGADVDAVDKTGQTPLMHAVISEDKAVALLLVRHGADVAIEDKEGYTVLGRASDSFRPALIDAAKAMLEG

SEQ ID NO: 28168 - protein, 432 aa, Pseudomonas syringae pv. syringae B728a
MRVISRNVAAWSAGLIVVAIFLSAWLSHPQHRIAPFAVSPAPVGAESVAPKASYMSRFASSDLDDFVHSSAVTALPGGDLMSVWFAGSREGAGDVEIRTSRFDAASGEWGGEQVLATRESTQAGTGKYIRKLGNPVIALAPDNRLWLFYVSVSVGGWAGSTVNAMVSSDMGASWSPPWQLVTTPFLNISTLVRGAPVFHADGSIGLPVYHEFLGKFAEYLYLSADGEVIDKFRLSRGNNSLQPTVVPLDGQRAVALLRYAGETFHRVLASRTEDGGQSWSEPYPLTPSNPNSSLAAVGVPGKGLLVALNDLREGRFKLSLYGTDEEMNVWRPLMDFDKSPDPLGTPFTLEAYKEVIGEGFRSSSGALRQPMEEAFLSNLDQRVCSPQGCDFEYEYPYFIRSPDGLYHLVYSWNNTFIKHVSFNEAWLAEQLL

SEQ ID NO: 28169 - protein, 293 aa, Oryza sativa (indica cultivar-group)
MSDPTAAVIPKPGGIGVGGGGSDDEEPVEIREVWADNLEEEFALIRDVVDEFPFVAMDTEFPGIVCRPVGAFRSPADYNYATLKANVDMLHLIQLGLTFSSPRGELPALGPGRRRCVWQFNFREFDDARDIFASDSIELLRRSGIDFRRNSERGVDARRFAELLMSSGVVLNDSVYWVTFHAGYDFGYLLKILTCSSLPDTQAGFFKLMKIYFPTVYDIKHLMKFCNSLHGGLNKLAELLDVERVGESHQAGSDSLVTSCAFWKLKDSFFAGSTEKYAGVLYGLNAENVVSAH

SEQ ID NO: 28170 - protein, 692 aa, Pseudomonas aeruginosa PAO1
MISKSRRSFIRLAAGTVGATVATSMLPSSIQAALAIPAHRRHGNLKDVEHVVILMQENRSFDHYFGTLKGVRGFGDRMAIPLPDGQRVWHQKGSKGEILPYHFDTSTTSAQRVDGTPHTWPDAQQAWNEGRMDKWLPAKTERSLGYYKEQDIAFQFAMANAFTICDAYHCSFQGGTNPNRLFLWTGTNDPLGQHGGPVTTNDHDSNGPVEQGYTWTTYPERLQAAGITWRVYQDMADNFSDNPLIGFRQYRAAAPDSPLIVNGLSTWKLDALKRDVLANSLPQVSWIVAPAKYSEHPGPSSPIWGAEYTSWVLDALTANPEVWSKTALLVMFDENDGFFDHVAPPAAPSLNKDGTLRGKTTADATLEWHTKGDIRYRNQPYGLGPRVPMYVISPWSKGGWVNSQVFDHTSVIRFLEQRFGVMEPNISPWRRAVCGDLTSAFNFANPNNEPFPELPDTSQADAIVASQIKLPKPKPPAVAAMPKQEMGIRPARALPYELGVHARYRSGGDALSLTFANTGKAGAVFQVFDLLDSENPPKRYTVGARKRLHDSFQGDASGDYHLEVHGPNGFLRVFRGNLRRDLAERKAPLPEVRIDYEPLFGNLRVQLINRGRHPVKLTVKDNVYRQGERRTVNVPPGQRREVRYSLRSSGNWYDFSVSAQGADSFLRRFSGRMEDGRSGFSDPGMGLGTLTF

SEQ ID NO: 28171 - protein, 357 aa, Citrus sinensis
MVTPTARRVESLARSGIQAIPKEYVRPKEELMGIGNIFEEEEKDEGPQVPTIDLKEIDSEDRVEREKCREELKKAAMDWGVMHLVNHGISDDLTERVKRAGQAFFDQPVEEKEKYANEQASGKIQGYGSKLANNASGQLEWEDYFFHLIYPEDKRDMSIWPKTPSDYTEATSEYARQLRSLATKILAVLSLGLGLEEGRLEKEVGGLEELLLQMKINYYPKCPQPELALGVEAHTDVSALTFILHNMVPGLQLFYKDKWVTAKCVPNSIILHIGDTIEILSNGEYKSILHRGLVNKEKVRISWAVFCEPPKDKIILKPLPETVSEQKPAMFPPRTFQQHIEHKLFRRTQDALLSDEE

SEQ ID NO: 28172 - protein, 458 aa, Arabidopsis arenosa
MEFTEAYKQTGPCCFSPNSRYVAVANDYRLVIRDTFSFQVVQLFSCLDKISYIEWALDSEYILCGLYKKPMIQAWSLTQPEWTCKIDEGPAGISYARWSPDSRHILTTSEFQLRLTVWSLLNTACVHVQWPKHGSKGVSFNQDGKFAAICTRRDCKDYVNLLSCQSWEIMGSFAVDTLDLADLEWSPDDSSIVVWDSPLEYKVLIYSPDGRCLFKYQAYECGLGVKTVSWSPCGQFLAIGSYDQMLRVLNHLTWKTFAEFLHLSTVRAPCSAAIFKEIDEPLQLDMSELSLDENFMPSNYDASEGYISVRYEVMELPVAFPFQKPPADKPNPKQGVGLLAWSKDSQYICTRNDSMPTALWIWDMCRLEVAAILVQKEPIRAAVWDPTCTRLLLCTGSSHLYMWTPSGAFCVCNPLPGFSISDLKWNIDGSCLLLKDKDAFCCATVPSLPESSDYSSDD

SEQ ID NO: 28173 - protein, 449 aa, Bacillus cereus ATCC 10987
MKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKEEIGEHPLVGDIRGKGLLVGIELVNDKETKEPIDNDKIASVVNACKEKGLIIGRNGMTTAGYNNVLTLAPPLVISSEEIAFVVGTLKTAMERI

SEQ ID NO: 28174 - protein, 282 aa, Zea mays
  misc_feature (35)..(35): Xaa can be any naturally occurring amino acid
  unsure (1)..(282): unsure at all Xaa locations
MEMLSMLKVGYTILRSETPATDLVNTFMDWAARRXDVAGKVVLITGAASGIGQVARLALVARMVGSLHDVAARARDGGSPDVLVVAGDVAKPEDCRRFVQATVEHFGRLDHLVNNAGVANVCWFEDVPDVAALKRVLAVNFWGAVHATHCALPHLKKSGGGKVFVNSSAAAALAMPGMSLYNASEAAVLNFFETLRVELRDEVGITIATSGWIVSEMTGGKQLSKEGTVEVAVRCAEATVDAICRGRRHLTVPLWYRALFLWRALAPEVVEFSQRLLCRRTA

SEQ ID NO: 28175 - protein, 112 aa, Glycine max
  misc_feature (18)..(18): Xaa can be any naturally occurring amino acid
  misc_feature (26)..(26): Xaa can be any naturally occurring amino acid
  misc_feature (86)..(86): Xaa can be any naturally occurring amino acid
  unsure (1)..(112): unsure at all Xaa locations
TTVNRAGAGMADPLTALXSMAVCPTXNTIIDFTSFASNAGRAQYMQMWPPVGYKKFETLSYLPDLDDAHLGKDGEYLLRTGWSPRXEFELEHGFLCREHNRAPEYYDGRYWT

SEQ ID NO: 28176 - protein, 512 aa, Fusobacterium nucleatum subsp. vincentii ATCC 49256
MKKGGIVILDFGSQYNQLIARRVREMGVYAEVVPFHEDVDKILAREPKGIILSGGPASVYAEGAPSLNIKLFQKNIPILGLCYGMQLITHLHGGKVARADKQEFGKAELELDDKNHILYKNIPNKTTVWMSHGDHVTEMASDFKIIAHTDSSIAAIENNDKNIYAFQYHPEVTHSQHGFDMLKNFVFGIAKAEKNWSMENYIESTVKQIKERVGNKQVILGLSGGVDSSVAAALINKAIGKQLTCIFVDTGLLRKDEAKQVMEVYAKNFDMNIKCINAEERFLSKLAGVTDPETKRKIIGKEFVEVFNEEAKKIEGAEFLAQGTIYPDVIESVSVKGPSVTIKSHHNVGGLPEDLKFELLEPLRELFKDEVRKVGRELSIPDYMVDRHPFPGPGLGIRILGEVTKEKADILREADAIFIEELRKADLYNKVSQAFVVLLPVKSVGVMGDERTYEYTAVLRSANTIDFMTATWSHLPYEFLEKVSNRILNEVKGINRLTYDISSKPPATIEWE

SEQ ID NO: 28177 - protein, 326 aa, Methanosarcina acetivorans C2A
MQNRKVQNRKVQNRKVQNRNKAVKPVNDMKALTFGEALFDIIKGTVHLGGAPLNLAAHLAKLGAKPAVLTAVGKDELGKTLLSRAEEMGVDTSYILLDEKRPTGTVTVELQAEGIPIFTINEGVAWDAITPDEREFEALAAEEWDVFCFGTLAQRSEENRKTLKRLLSEIKAKHFFYDVNLRAGFYRKEWILSSLERCTILKMNEEEAAKISGMLFGTTYACRTLCRLLTDRYPKISVICITKGPEGAAVYQDGVYEEIKTTPVEVADTVGAGDAFSAGFLYTFLSGYGVSKAVSVAIMLGTYVASKPGSVPEYSEELRKELGILE

SEQ ID NO: 28178 - protein, 297 aa, Prochlorococcus marinus str. NATL2A
MPVDLLTQSADSGARLAIRLLQDAAQRGDIDPWDVDVIPVVDGFLDQLKQRIEIPKKISQHFSQNGGSYEVDLAQSSEAFLAASVLVGLKAEVLEAEMFSVDMEVEEDSELDFGEQGWLDESFQLPVRPERHLFRRPVAPPPFRRPVTLGELINQLETIAESLKNDDLNNRRNLRQKKLSNREVIAQVSSLAHREKLPETTAALAIFINKWEKALHWVDFELLVKSWKENSASNDLDTDRVGVFWALLFLCSQGKVEIDQKGSLFSPISLKRLLQPGMVAQLPLASLDVTDVSPAAA

SEQ ID NO: 28179 - protein, 373 aa, Rickettsia conorii str. Malish 7
MSQNYYQILGVSKTASQADLKKAYLKLAKQYHPDTTDAKDAEKKFKEINAAYDVLKDEQKRAAYDRLGHDAFQNQQSRGGGGNHGGFHPDINDIFGDFFSDFMGGSRRSSRPTSAKVRGSDLKYNLTINLEEAFHGIEKNISFSSAVKCDTCHGSGSEKGETVTTCDACSGVGATRMQQGFFTIEQACHKCQGNGHIIKNPCKKCHGMGRYHKQRNLSVNIPAGVENGTRIRHTGEGEAGIRGGNSGDLYVDITIKPHDIYKVDGANLHCKLPISFVNAALGGEIEVPVIEGGKVNLTIPAGTQNGDQLRLRSKGMSKMRSTIRGDMLTHIHVEVPKNLSKRQRELLEEFKKESINEKENDGSFFNKMKSLWS

SEQ ID NO: 28180 - protein, 496 aa, Pseudomonas syringae pv. syringae B728a
MVAELLARLGVANSAHTQGDYPVYTPIDGSRIASVTLEGKAQVVARIDSAHSAFLKWRTVPAPRRGELVRIFGEVLREHKADLGELVSVEAGKITQEGLGEVQEMIDICDFAVGLSRQLYGLTIASERPGHHMRETWHPLGVVGVISAFNFPVAVWAWNTTLALVCGNPVIWKPSEKTPLTALACQALFDKALKIFGDAPAALAQLVIGDRDAGEALVDDPRVPLISATGSTRMGREVGPRVAARFGRSILELGGNNAMILAPSADLDLAVRGILFSAVGTAGQRCTTLRRLIVHRSIKDEVVARVKAAYAKVRVGDPREGNLIGPLIDQQAFSAMQNALTKARDEGGQVFGGERQLQDKYPNGYYVTPAIAEMPGQSEVVRHETFAPILYVLAYDDFEEALRLNNEVPQGLSSCIFTTDLREAEAFQSAAGSDCGIANVNIGTSGAEIGGAFGGEKETGGGRESGSDSWRAYMRRQTNTVNYSRELPLAQGIVFD

SEQ ID NO: 28181 - protein, 499 aa, Arabidopsis thaliana
MVFSVSIFASLAPYLVSALLLFFLIEQLSYLVKKRNLPGPLFVPPIIGNAISLVRDPTSFWFKQSDTAGTSPGLAANYLIGKFIIYIRDTELSHQIFSNVRLEAFHPLGHPFGKQLFGDHSLIYLFGEDHKTVRRHLAPNFTPKALSTYSDLQQIVMLRHLRQWEESFSGGTKPVSMRDLVRELNLETSQTVFVGPYLDKEARNTFCTDYNLFNLGSMALPINLPGFAFNKARRAVMNLEKTLSVCAGKSKKRMATGEEPTCLIDFWMHAFVTEIESGNPPPLHSEDEAIGGLLFDFLFAAQDASTSSLLWAVTFLESHPKVLSKVREEVAKIWSPQSGHLITADQLAEMKYTRAVAREVVRYRPPATMVPHIATNDFPLTESYTIPKGTIVFPSVFDASFQGFTEPNRFDPDRFSETRQEDQVFKRNYLAFGWGAHQCVGQRYALNHLVLFIAMFSSLFDFKRLQSDGCDDIIYCPTISPKDGCTVFLSKRIVTYPNL

SEQ ID NO: 28182 - protein, 284 aa, Oryza sativa (japonica cultivar-group)
MAAATSTMSLLPPITQQQRWHAADSLVVLASRCHNSRRRRRCRYVVPRARLFGPAIFEASKLKVLFLGVDEEKHQHPGKLPRTYTLTHSDVTARLTLAVSHTINRAQLQGWYNKLQRDEVVAEWKKVQGHMSLHVHCHISGGHVLLDLIAGLRYYIFRKELPVVLKAFVHGDGNLFSRHPELEEATVWVYFHSNLPRFNRVECWGPLRDAGAPPEEDDAVAAAAAEEAGGGADARGRRVAAAVPGAVRLLLPAIQPHPLAAPARRRRRRRPAAAVTAAPPRFVD

SEQ ID NO: 28183 - protein, 321 aa, Mycoplasma gallisepticum R
MMYYKVILGIESSCDDLSIAIAIDNKIVTTKTKSSSSVHANYGGVVPEIAARYHEEILHQTLNEALTEANLTINKIDLITYTENPGLLNCLHVAKVFANTLGYLLKIPAQGINHLYGHIFSPMIDDGDCLYQKSDLIYPALGIVVSGGHTAIYDVQSPSKITLLDETLDDAIGEVYDKVGRALGLQYPAGAKIDQLYNPEQAETVEFLKTNKLSAFSYSGFKSAVLRYIELNKNQPDFNLVQAVSSFQKFIIDDFIDRIKNVINKADSKYQTILLGGGVSANSYLRSELKELAIKTLVPKPIYSGDNAAMIINYAQYLLNE

SEQ ID NO: 28184 - protein, 534 aa, Bradyrhizobium sp. BTAi1
MTAQPDTPASAATETSVAALHDKILIVDFGSQVTQLIARRVREDGVYCEIVPFQKAEAAFRQMQPKAVILSGGPESVHEAGSPRAPQLIFDSGVPVMGICYGQMTMAAQLGGTVEGGHHREFGRADVEVKTSSRLFDGVWQPGEQHQVWMSHGDRITQMPPGFSVAGVSPNAPFAVIQDETRKYYGLMFHPEVVHTPDGAKLIRNFVRNIAGLGGDWTMHAFRAEEIKKIRAQVGKGKVICGLSGGVDSAVAAVLIHEAIGDQLTCVFVDHGLLRLNEAETVVDLFRHHYNIPLVHVDASKLFLGELAGVTDPEQKRKTIGRLFIDVFEAEAKKIGGADFLAQGTLYPDVIESVSFTGGPSVTIKSHHNVGGLPARMNMKLVEPLRELFKDEVRVLGRELGLPDVFVGRHPFPGPGLAIRCPGEITVDKLDILRKADAIYIDEIRKAGLYDTIWQAFAVLLPVKTVGVMGDGRTYDYVVGLRAVTSTDGMTADFYPFDMKFLGNTATRIINEVKGVNRVVYDVTSKPPGTIEWE

SEQ ID NO: 28185 - protein, 439 aa, marine gamma proteobacterium HTCC2207
MNTRVAVAEVIAQVLRGKSLSALLPEYASKVVEKDVGLFKQLCFGTLRWYPAIELLLQELMQKPMREKEFEIQGLLACGLYQLMHTRIADHAAINETVTAVTKLKRPWAKGLVNAVLRNFLRQRTELETKLAKNPVFVRAHPQWLLNDLFTSWGSAVAIDVLAANNEQAPMTLRVNQLQGSRDEYLQQLSAADIRAQTTQFSEQGIQLQSAIDVATLPGWDSGAVSVQDEAAQLTAALLELEPDQQVLDACCAPGGKTCHILETQPQLSKLVAVELESRRMPRVEENLRRLGLKADLVVNDASATADWWDGKPFQRILLDAPCSASGVIRRHPDIKLLRKTTDIVKLAELQLQLLHSLWQTLDEGGILLYATCSVLPQENDQVIETFLAETSLATTSAAELYSIEAEWGTKTAFGRQLFPKIDGNDGFYYSRLRKTSQK

SEQ ID NO: 28186 - protein, 432 aa, Bradyrhizobium sp. BTAi1
MTPAARLSAAIDIIETIEADRAPAAKALKDWGTSHRFAGSGDRAAIAGLVWDVLRRRASSAWVMEDDSARARVLGMLKLERGLDVPTIGAMCDGSRFAPPPLTDQEEKALASRTTEGAPSPVAGDYPDWLDPYLAAVFGDDRVAEAMAMASRAPLDLRVNTLKAKREKVQASLKHLGAVPTPWSPIGLRITLGADARNPGIHAEEDFIKGAIEVQDEGSQLAALFTAAKPGEQVIDLCAGAGGKTLALAAMMGGKGRLIATDDDKRQLAPIHERLSRAGVHNADVRSPKGDADPLADIRASADLVVIDAPCTGTGTWRRNPDAKWRMRPGALEIRLKDQAEVLDRAAGLVKPGGRIAYITCSVLQPENGDQVRGFVARHPEFSIQPPDQTATVLWDKAEAFAEAALKSDEGWLMTPRRTGTDGFFVSVLKKA

SEQ ID NO: 28187 - protein, 433 aa, Candidatus Protochlamydia amoebophila UWE25
MPFTLTMPKLSPTMEEGTLIKWHKKIGDSIQTGDLLIEVATDKATVEYNAIDDGWLRQILIQEGKDAAVNQAIAILTVDQNESLEGYQADGVKEKALQLSSDSIEMPELNYKEKKEPKSKTTAFQQPVFVPEFPLENYTFEFPIERGDKKLLASPLAKKLAKEKGLDLTTVKGTGPQQRIISRDLDKAQAAGVVNFGHRETPQLPPGSYEELSLTPMRKVIGQRLQESKSFIPHFYVTLTIDASPLTQIREQLKNNQVKVSINDFIVRACALALRQNPGLNCGFNSANQSIIQFKTIDIAVAVSLEEGLITPIIRHADFKNLGELSVEMRVLAQKAREGKLEPQEYKGGSFTISNLGMFGVSEFQAILNPPQAAILAVSGILDVPVIQNNMVIPGKTMNLTLSVDHRVIDGVAAAKFLQSLKQLLENPAGLLL

SEQ ID NO: 28188 - protein, 157 aa, Zea mays
MAAAAPAPASVAPSSAPKATGDSRKTVVSVDASELEKHVLAVDDSSVDRAVIARILRGSRYRVTAVESATRALELLALGLLPDVSMIITDYWMPGMTGYELLKCVKESAALRGIPVVIMSSENVPTRITRCLEEGAEGFLLKPVRPADVSRLCSRIR

SEQ ID NO: 28189 - protein, 330 aa, Candidatus Protochlamydia amoebophila UWE25
MSTEKQTIDIREALRQAINEEMARDSSVFVMGEEVGEYNGAYKITKGMLDKWGANRIIDTPISELGFAGLCIGAAMTGLRPIVEFMSFNFSFVAADQLISNAIKMYYMSGNRFSVPIVFRGPNGAAAQVSSQHSHCVEAIYGNLPGWTIIAPSNAYDAKGLLKSAIRDNNPVLFLESELSYGDKMEIPVDEYLIPIGKAQIVVPGADVTLIAHSRMVTICKEVVNELTKMGICAELIDLRTVKPLDIATIANSVKKTNRCVIVEEGHLFAGIAAEVGFQIMEHCFDYLDAPLERVCQRETPMPYSKVLEKETMPNKQRILSAIYKTLQKN

SEQ ID NO: 28190 - protein, 342 aa, Candidatus Protochlamydia amoebophila UWE25
MKTDVLPQFFSVDQDAVIKKLGPQALIECFQQMLKIRNFELRAESAYQQGKIGGFFHAYVGQEAIQTAAVQAIGQSNWYATSYRCHALALLLGATPNELMAELYGRATGNAKGRGGSMHFFTDRLLGGFGIVTGQVPIATGAAFALKYKGNKNEVAVCFMGDGAVPQGSFHESLNLASLWNLPCIYVIENNQWGMGTAIQKAVSVKRLAEDKASGYNMKAYTLDGMDFFNCYGGFAQIHQEVLQRQRPVLVEVVTERFKGHSISDPGLYRAKDTLKQIMAKDPILALQAVLIKKGILTEDMVKQMNKENREKIIEAMSFAENSPWPDPQTLEEDVFAPNFIV

SEQ ID NO: 28191 - protein, 340 aa, Bradyrhizobium sp. BTAi1
MSQAKRIVLAARPVGEPKPSDFRLEEHAIPTPGAGEVLLRTIWLSLDPYMRGRMSDGPSYAQPVPVGGVMEAGTVCEVVASNNPGFKAGDIVLARAGWQTHAISDGKGLAKVDPKLAPISTAVGVLGMPGMTAYTGLLDIGQPKPGETVVVAAASGAVGSAVGQIAKIKGARAIGIAGGKDKCDYVKNEFGFDDCLDHRDPDLAAKLKAACPKGIDVYFENVGGPVFEAVFPLFNAFARMPVCGLIAHYNDTQSVAPKWAGALMRNVLTKRLTIRGFIVSDFASRHGDFLKDMSAWVRDGKVKYKEHVTEGLENAPDAFMGLLKGANFGKQLVRVGPDKA

SEQ ID NO: 28192 - protein, 636 aa, Schizosaccharomyces pombe 972h-
MGEKDKLHEISSKFASLGLGSLKSTPKARETTEPPPPSSQQPPSTPNGKEAASPSALKQNVRPSLNSVQQTPASIDAVASSSNVSLQSQQPLSKPVVSSKPNQTTAMPPPSNNPSRHVSSTSNKPAAVSPNPAAHHAELPSGSVPPSASVSRANSTATTTPHKAGVVSNPAAANVHVLSVAASPNPSTPSNGPAPVSTTATPSRNPVTRLQRIFSQNSVSRQNSRTGRGAAVANTEETNSTGGSETGGAANSSSTSNPSSAKWSRFTVYDDASHTHQLRPARRQEKLGKMLKDFLAGNSKKREEERIAKEAADAQHQLSLVQSWINGYGQEKLADKKDPAKVSASFVEKYGRCQEVIGRGAFGVVRIAHKVDPQNSGSETLYAVKEFRRKPAESQKKYTKRLTSEFCISSSLRHPNVIHTLDLIQDGKGDYCEVMELCSGGDLYTLIMAAGRLEPMEADCFFKQLMRGVDYLHDMGVAHRDLKPENLLLTVSGSLKITDFGNGECFRMAWEKEAHMTCGLCGSAPYIAPEEYTESEFDPRAVDVWACGVIYMAMRTGRHLWRVAKKSEDEYYSRYLMDRKNESGYEPIEMLERSRCRNTLYNILHPNPTYRLTAKQIMKSEWVRSITLCEAGNAGL

SEQ ID NO: 28193 - protein, 356 aa, Capsella rubella
MEKGEDSSTFKMGNSAQERGLPYVPDCYVVPPSWQPCDSNSEIVPTIDVSRLNGGDDERRGVIREISLACQHLGFFQIVNHGINQNILDDALEVAKGFFELPAKEKKKFMSNDVYAPVRYSTSLKDGLDKIQFWRIFLKHYAHPLHRWIHLWPENPPGYREKMGKFCEEVRKLSIEIMGAITESLGLGRDYLSSRMDENGMQVMAVNCYPPCPGPDAALGLPPHSDYSCITILLQNLAGLKIFDPMAHGGSGRWVVVPQVTGVLKVHIGDHVEVLSNGLYKSVVHKVTLNEENTRISLASLHSLDMNDKMSVPCELVNNENPVRYKESSFNDFLDFLVKNDISQGDRFIDTLRIKD

SEQ ID NO: 28194 - protein, 342 aa, Zea mays
MEKMLHSAPAHGRLPECFIFPADKLPQAKATSATVSLPIVDLSLGRDEVRRAILEAGKEIGFFQVVNHGVSLEAMQDMETVCQEFFRLPAEDKAGLYSEDTGRATRIYSSTMFDTGGEKYWRDCLRLACSFPAVGDSAAAWPDKPRRLREVVERFTVQTRGLGMEILRLLCEGLGLRPDYLEGDISGGDVVLHVNHYPPCPDPNATLGLPPHCDRNLLTLLLPSMVPGLEVAYRGDWIRVEPVPGAFVVNFGCQLEVVTNGILKSIEHRVMTNLGVARTTVATFIMPTTDCLIGPAAEFLSDDNPPCYRTLTFGDFKRIYSVVKLGSSLNLTTNLKTVQKEL

SEQ ID NO: 28195 - protein, 858 aa, Vibrio angustum S14
MLSIIEQIKQGKLWDFHGGIHPAENKKISNQAPIVSAGIPQELVLPLKQHIGSKGDIIVAVGDKVQKGQALTQGDIAMCVPVHAPTSGTVIAIEQRTTAHPSGLSDLCIVLHPDHTDTWGEKKTYADYQDRDPAELIETIRLSGIAGLGGAGFPTARKLQGGLGNVDILIINAAECEPYITADDRLMRDYAEEVIEGVRILRHIISPKLTIIGIEDNKPEAIKALEQHVTEADNILIRVVPTKYPSGSSKQLVKILTGREVPSQSRSTSVGVIMQNIGTAFAIKRAIIDGEPLIERVVTLTGEAFKKRGNVFAMLGTPIAYLLDKFGYKADKKHPRVIIGGSLMGFTLPHSNVPITKITNCILAPKRKELPLHTYEMACIRCSACADVCPSSLLPQQLQWYAKDQNYDKCEEYNLKDCIECGACAYVCPSEIPLVQYYRQAKAEIWARSQDEMNAERARQRFEAKQARMERDKAERENRFKKAADSRRDEMAKTGGDDAVAAAIARVKAKQAAAAKADTAEVKPAVAAAIAKAKAKQAASAQGATSESLPDNSEMAKLREERKRQARERKAEKEATANNQPAAENDSKKDAVAAAVARAKARKAAQQTEAQAESASEPIVETENVDPKKAAVAAAVARAKARKAAQQAEAQTESAPEPVVEAENVDPKKAAVAAAVARAKARKAAQQAEAQAESAPEPVVEAENVDPKKAAVAAAVARAKARKAAQQAEAQAESAPEPVVEAENVDPKKAAVAAAVARAKARKAAQQAEAKAESAPEPVVEAENVDPKKAAVAAAVARAKARKAAQQAETQAESAPEPVVEAENVDPKKAAVAAAVARAKAKKAAQQAAKEQQNIEED

SEQ ID NO: 28196 - protein, 239 aa, Thermoanaerobacter tengcongensis MB4
MSNFEILMIGAFAGVAGTGLGGVFAYFFKNPNPKFFSGIMGITAGLMLSVVMFDLLPHSFEISGMPVGVIGVIIGAFLISLFDSHIEKTKFNKGFIREGLLLGIAIALHNFPEGLAVGSGFMVSSSLGIDIALVIALHDFPEGVAVAVPLSAGGVSPCKVLLYTFLTGLPTALGTFIGILSGGISNTFIGLNLALAGGAMLYVTCGEIIPEARDIYRGKISILGMILGVIGGIIITRYL

SEQ ID NO: 28197 - protein, 396 aa, Burkholderia pseudomallei K96243
MAARPFTSPGGSMQSAAAPRSKLPDVGTTIFTVIGQLAAEHEALNLSQGAPNFAPDPALVERVARAMRDGHNQYAPMAGIAALREALGVKTERLYGERYDPDSEVTIVASASEGLYAAISALVHPGDEVIYFEPSFDSYAPIVRLQGATPVAIRLSPERFRVNWDEVAAKITPRTRMLIVNTPHNPSATILGEADVARLAQLVAGTDIVVLSDEVYEHVVFDGARHHSMARDRALAERSVIVSSFGKSYHVTGWRVGYCLAPAELTRELRKVHQFMTFAADTPMQHAFAAALAEPASYLELGAFYERKRDLLVRELAGSRFELLPSEGSFFMLARFGHFSDESDADFVLRAIRDARVATIPLSAFYADGANTGCIRLSFSKDDATLVEGARRLCSL

SEQ ID NO: 28198 - protein, 402 aa, Staphylococcus epidermidis RP62A
MAQDRKKVLVLGAGYAGLQTVTKLQKELSADAAEITLINKNEYHYESTWLHEASAGTINYEDLLYPVEKTVNKDKVNFVVAEVTKIDRNAKRVETDKGVYDFDILVVALGFVSETFGIDGMKEHAFQIENVLTSRKLSRHIEDKFANYAASKEKDDKDLSILVGGAGFTGIEFLGELTDRIPELCSKYGVDQSKVKLTCVEAAPKMLPMFSDDLVSYAVKYLEDRGVEFKIATPIVACNEKGFVVEVNGEKQQLEAGTSVWTAGVRGSHLMEESFEGVKRGRVINKQDLTIEGHNDIFVIGDCSAFIPAGEERPLPTTAQIAMQQGEHTASNIKRLLNGESTQDFQYVNRGTVCSLGANDGVGIVYGRDIAGKKAAFLKKVIDTRAIYKLGGIGLAFKKGKF

SEQ ID NO: 28199 - protein, 160 aa, Brassica napus
  misc_feature (16)..(16): Xaa can be any naturally occurring amino acid
  misc_feature (51)..(51): Xaa can be any naturally occurring amino acid
  unsure (1)..(160): unsure at all Xaa locations
AIIPSLIVALIGGSAXAGKLIIIASMILSFELPFALVPLLKFTSCKTKMGXSHVNHMAITTLTGVIGALIMGINIYYIVSSFTKLLIHSHMKLALVIFCGILGFSGIAIYLASIAYLVFRKNRKASPLLASTNSQTVETLPRQDIVDMQLHGKAAASDLD

SEQ ID NO: 28200 - protein, 515 aa, Burkholderia pseudomallei K96243
MNLIAALERAARATPDKPFLRDDGATLTYRQMQQRSRRAAEVLASLGVAPGERVAAMCLNTPAFFDLLLGAWRIGAVVVPVNHKLQAPEVDHILRHSASRAVLFDAALAPVLANVEHDALRLATEGEAAGAAPFDRLVADAAGIAPATPDDAALAEILYTSGTTGRPKGCMHSHRTVALAAATSALALSMTERERTLMAMPVWHASPLNNWFGGTLYVGGTVVLMREYQPLRFLQTVEAEQVTLYFGAPVSYTLPLDTIADFASFDLTSVRAWLYGGGPIGATLARRLMRAYRSEAFYQVYGMTETGPAGTVLHPFEQAMKPGSIGCQGTPGVDVRVVTAAGGLARPGEIGEIRLRADSMMLGYLDDPGATRAAFDDDGWYRSGDVARVDDDGYLFVVDRIKDMIVTGGENVYSKEVEDVLNAHPAVAEAAVVGRAHPEWGETVIAHVVLREAAGAARAGQAESAAGVDADALRAFCATRLAAYKIPREYVFAERLPRTPTGKLQKYLLRARGGA

SEQ ID NO: 28201 - protein, 281 aa, Methylobacillus flagellatus KT
MSHRYHDCRPIVNELHVSRENFIIPGPEGTIPVRLYRRAQAGGDVPLVLYFHGGGFNAGCLDDADFPAGFIAYHCPAVVLSVGYALAPQHPFPAAPEDAYAATRWAARNTCRLNVTAKLLVVAGDDAGGSIAAGLSMMARDRGEFSIAAQVLIAPMLDPSMTLLGDAAGLKSELTAAQCAQRYRQYLPKCTQRMHPYAAPLESLRLAGLPAAMIATAECDVLHIEAEKYANVLIQAGVPTQVSRFSGVQHAELLAHQPMLREVVEFLRRQAMHAGLPIDSG

SEQ ID NO: 28202 - protein, 218 aa, Prochlorococcus marinus str. NATL2A
MLGFLEKVADYTKEAVSAAKYLVDGLGVTFDHMRRRPVTVQYPYEKLIPSERYRGRIHYEFDKCIACEVCVRVCPINLPVVDWVMNKETKKKELRNYSIDFGACIFCGNCVEYCPTNCLSMTEEYELSAFDRHSLNYDNVALGRLPTSVTSDPSVRPLRELPYLPKGIMDPHELPANQLRAGKLPSQIIKELQADKSEEEGKNNSSDMVPNKLNSTNK

SEQ ID NO: 28203 - protein, 1309 aa, Burkholderia pseudomallei K96243
MASTTLGVKVDDLLRARLKDAASRLERTPHWLIKQAIFAYLERIEHGQLPPELSGHTGVADLSDSHADGDDDGAPHPFLEFAQSVQPQSVLRAAITAAYRRPEPECVPFLIGEARLPASLASDVQAMAAGLVEALREKSSGGGVEGLIHEFSLSSQEGVALMCLAEALLRIPDRATRDALIRDKISKGDWRSHVGHAPSLFVNAATWGLMITGKLVTTNSEAGLSSALTRLIGKGGEPLIRKGVDMAMRLMGEQFVTGETISEALANSRKYEARGFRYSYDMLGEAATTEEDALRYYASYEQAIHAIGKAAGGRGIYEGPGISIKLSALHARYSRSQQERTMNELLPRVRSLALLARRYDIGLNIDAEEADRLELSLDLLEALCFDPELAGWNGIGFVVQAYQKRCPFVIDYLVDLARRSRHRLMIRLVKGAYWDSEIKRAQVDGLEGYPVYTRKIYTDVSYLACAKKLLAAPDAVYPQFATHNAYTLAAIYHLAGQNYYPGQYEFQCLHGMGEPLYEEVTGRDKLNRPCRVYAPVGTHETLLAYLVRRLLENGANTSFVNRIADKTVSVKELVADPVEDALKVVPLGAPHAKIALPRELYGASRVNSMGLDLSNEHRLASLSSALLASAHHPWRAAPMLADDALAHAAPRDVRNPADLRDVVGTVSEATPDEVSAALAHAVAAAPIWQATPVDARADCLARAADLLEAQMHTLMGLIVREAGKSLPNAIAEIREAVDFLRYYSAQIRDEFSNDTHRPLGPVVCISPWNFPLAIFMGQVAAALAAGNTVLAKPAEQTPLIAAQAVRLLRDAGVPAGAVQLLPGNGETVGAALVADPRTRAVMFTGSTEVARLINKTLSSRLDPDGRPIPLIAETGGQNAMIVDSSALAEQVVADVLQSSFDSAGQRCSALRVLCLQDDVADRTLTMLKGAMRELALGNPDRLSVDVGPVIDADAKRTIDTHIAAMKDKGHAVTQLEMPDACAQGTFVPPTIIEIGNVDELKREVFGPVLHVVRYRRSGLDKLLEQIRATGYGLTLGIHTRIDETIAHVISRAHVGNIYVNRNVIGAVVGVQPFGGEGLSGTGPKAGGALYLQRLLATRPAGLPRSLEAALVADAPQEGETRDNPSAALTALRDWLIEQREPALAARCDGYLSHVLAGATAVLSGPTGERNTYTLGARGTVLCIAATASGARAQFAAALATGNRALFAGAAGEALAAALPAQLKAHAGVRKQADAAFDAVLFEGDSDELLALVKEVAQRPGPIVSVQGVAAGAFENGGDEDYALERLLTERSVSVNTAAAGGNANLMTIG

SEQ ID NO: 28204 - protein, 1131 aa, Glycine max
  misc_feature (1095)..(1095): Xaa can be any naturally occurring amino acid
  unsure (1)..(1131): unsure at all Xaa locations
MSTSRPSQSSSNSRRSRHSARMAQATVDAKIHATFEESGSSFDYSSSVRVSGTADGVNQPRSDKVTTAYLRGKMIQPFGCLLAIDEKNHMQTCKVIAYSENEPEMLTMVSHAVPSVGDHPALGIGTDIKTLFTAPSVSGLQKALGCADVSLLNPILVHCKTSGKPFYAIVHRVTGSLIVDFEPVKPYEVPMTAAGALQSYKLAAKAITRLQSLPSGNMERLCDTMVQEVFELTGYDRVMAYKFHEDDHGEVIREITKPCLEPYLGLHYPATDIPQASRFLFRKNKVRMIVDCHAKHVRVLQDEKLQFDLILCGSTLRAPHSCHAQYMANMDSIASLVLAVVVNDNEEDGDTDAVQPQKTERLWGLVVCHNTTPRFVPFPLRYAREFLPQVFADHVHKEIELEYQIIEKNILHHPGHLLCMLMRDAPLGIASESPNIMDLVKCDGAALIYRNKVWRLGVTPSEPQIREIALWLSEYHMDSTSFSTDSLFDAGFPSALSLGDVVCGMASVRVTAKDMVFWFRSHTAAEIRWGGAKHEAGEKDDSRRMHPRSSFKAFLEVVKARSLPWKEYEMDAIHSLQIILRNAFKEDTESLDLNAKAINTRLRDLKIEGINDLKIERMQELEAVTSEIVRLDYTATVPILAVDVDGLVNGWNIKIAELTGLPIGEATGKHLLTLVEDSSTDRVKKMLNLALLGEEEKNVQFEIKTLGSKMDSGPISLVVNRCASRDLRDNVVGVCFVAHDITAQKNVMDKFIRIEGDYKAIVQNRNPLIPPIFGTDEFGWCCEWNPAMMKLTGWKREEVMDKMLLGEIFGTQMAACRLKNQEAFVNLGVVLNKAMTGSETEKVPFGFFARNGKYVECLLSVSKKLDVEGLVTGVFCFLQLASPELQQALHIQRLSEQTASKRLNALSYMKRQIRNPLCGIVFSRKMLEGTDLGTEQKQLLRTSAQCQQQLSKILDDSDLDTIIDGYLDLEMAEFTLHEVLVTSLSQVMEKSNGKSIRIVNDVAGHIMMETLYGDSLRLQQVLADFLLISINFTPNGGQVVVAGSLTKEQLGKSVHLVKLELSITHGGSGVPEVLLNQMFGNNGLESEEGISLLIXAKLLKLMNGDVRYLREAGKSAFILSAELAAAHNLKA

SEQ ID NO: 28205 - protein, 148 aa, Hordeum vulgare
  misc_feature (5)..(5): Xaa can be any naturally occurring amino acid
  misc_feature (139)..(139): Xaa can be any naturally occurring amino acid
  unsure (1)..(148): unsure at all Xaa locations
MASKXILKEFKDLQKDPPTSCSAGPSGEDMFHWQATIMGPHDSPYAGGVFLVNIHFPPDYPFKPPKVSFKTKVFHPNINSNGSICLDILKEQWSPALTISKVLLSICSLLTDPNPDDPLVPEIAHMYKTDRSKYETTAXSWTQKYAMG

SEQ ID NO: 28206 - protein, 194 aa, Triticum aestivum
  misc_feature (78)..(78): Xaa can be any naturally occurring amino acid
  misc_feature (92)..(92): Xaa can be any naturally occurring amino acid
  misc_feature (103)..(103): Xaa can be any naturally occurring amino acid
  misc_feature (119)..(119): Xaa can be any naturally occurring amino acid
  misc_feature (129)..(129): Xaa can be any naturally occurring amino acid
  misc_feature (138)..(138): Xaa can be any naturally occurring amino acid
  misc_feature (142)..(142): Xaa can be any naturally occurring amino acid
  unsure (1)..(194): unsure at all Xaa locations
MAPTVMASSATSVAPFQGLKSTAGLPVSRRSNGASLGSVSNGGRIRCMQVWPIEGIKKFETLSYLPPLSTEASSKQVXDYLIRPKWVPCLRXSSKVGVIFREXNASPGYYDGRYWTMWXLPISGCTDAXQVINEVEEXKKGXLTVLRRVRQHRKCMRSCLKQRAARSGRLKVIQRAIMHAVPELLVPPLLLVSK

SEQ ID NO: 28207 - protein, 375 aa, Prochlorococcus marinus str. NATL2A
MVLKPGLEGVPVTNSGICEINGTEGRLSYRGYPISELAQKSSFLETAFLLIWGELPTENELEKFEKDVQMHRRVSFRIRDMLKCFPESGHPMDALQASAASLGLFYSRRAIDDPKYIYDAVVRLIAKIPTMVAAFEQIRKGDDPIQPQDDLPYSSNFLYMLTEREPNPLAARVFDRCLILHAEHSLNASTFSARVTASTLTDPYAVVASAVGTLAGPLHGGANEDVIAMLEEIGRPDEVSSFLNDAIAKKRKIMGFGHREYRVKDPRATILQAFAEELFSEFGKDEMYEVAKALEEEAISKLGPKGIFPNVDFYSGLVYRKLGIPRDLFTPVFAISRVAGWLAHWREQLGANRIFRPSQIYEGAKMRNWKPLESR

SEQ ID NO: 28208 - protein, 228 aa, Synechococcus sp. WH 8008
HEVAGAGQHELGMKFAELIQAADNTMTYKYVVRNVAKKYGKTATFMPKPVFNDNGSGMHVHQSLWKGGQPLFFGEGTEANLSQTARWYIGGILKHAPSFLAFTNPTTNSYKRLVPGFEAPVNLVYSEGNRSAAVRIPLTGPNPKAKRLEFRSGDALANPYLAFAAMMMAGIDGIKNQIDPGAPTNVDLFELSAERLSEIDTVPASLNGALEALNADHHYLMEGGVFTK

SEQ ID NO: 28209 - protein, 376 aa, Saccharina japonica
MADEDVQALVVDNGSGMCKAGFAGDDAPRAVFPSIVGRPKHPGIMVGMDQKDAYVGDEAQSKRGVLTLKYPIEHGIVTNWDDMEKIWHHTFYNELRVAPEEHPVLLTEAPLNPKANKERMTQIMFETFNVPAMYVNIQAVLSLYASGRTTGCVLDSGDGVSHTVPIYEGYALPHAINRLDLAGRDLTDNLMKVLTERGYSFTTTAEREIVRDIKEKLTYVALDFDQEMKTAAESSQLEKSYELPDGNVIVIGNERFRCPEVLFQPSFIGMESSGIHDCTFKTIMKCDVDIRKDLYGNIVLSGGTTMFPGIGERMTKELTALAPSTMKIKVVAPPERKYSVWIGGSILASLSTFQQMWISKAEYDESGPSIVHRKCF

SEQ ID NO: 28210 - protein, 335 aa, Pseudomonas syringae pv. phaseolicola 1448A
MTDLSNRQFLLAKRPSGDVRREDFTYQEAPVTALAEGQILVRNKYLSLDPAMRGWMNDGKSYIPAVKLGEVMRALGVGEVLESKNPKFAVGDHLQGALGVQDYFVGEPKGFYKVDTSLAPLPLYLSALGMTGMNAYLALLDVGQPKSGDTVVISGAAGAVGSVAGQIAKLKGCRVVGIAGGAEKCRLLTEELGFDAAIDYKSEDVMDGLKRHCPDGVNVYFDNVGGDILDAALSQLAVGARVVICGAISQYNNTTAIKGPANYMSLLVNRARMEGFIVLDHPERFAEAGQVMAGWIKEGKLKSKEHIVDGLETFPETFQMLFSGENQGKLILKVE

SEQ ID NO: 28211 - protein, 228 aa, Synechococcus sp. WH 8104
HEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMLMAGLDGIKNQIDPGDGEDRDLFELAAEELSKIATVPASLNGALEALNADRGFLTAGGVFSD

SEQ ID NO: 28212 - protein, 411 aa, Pseudomonas syringae pv. syringae B728a
MRALTYHGANSVKVDTVPDPVIEQADDIILRVTATAICGSDLHLYRGKIPTVEHGDIFGHEFMGVVEETGSAVTAVAKGDRVVIPFVIACGSCFFCNLDQFAACETTNTGRGAILNKKSIPPGAALFGFSHLYGGVPGGQAEYVRVPKANVGPFKVPGTLADEKVLFLSDILPTAWQAVLNAGIGQGSTVAIYGAGPVGLMSAACAKMLGAEKIFMVDHHPYRLAYAQKTYGVIPINFDEDDDPADTIIRQTAGMRGVDGVIDAVGFEAKGSTTETILATLKLEGSSGKALRQCIAAVRRGGVVSVPGVYAGFIHGFMFGDAFDKGLTFKMGQTHVHRFMPELLEHIEAGRLEPEAIITHRMSLEDAAKGYKLFDKKEEDCRKVILTPGNNTIVVPDDTTEALVGGGVPAM

SEQ ID NO: 28213 - protein, 361 aa, Oryza sativa (indica cultivar-group)
MEPFKGNFSNLLNQGSSSQATNSDAQNSPSTQFPTSYPQNFRPSFLQNFHPFGPPSNYQPYRHPPIFQGGQRQDYYGQPTPGSLEGFRLQENLVHSSNQAFGFAASRSQFVDPIKGNDKKSEQYWKAVAREFNSNMPSNGNKRNPKQCRTHWDNVKRDVTKFCGFYSKARTTFTSGYSDDMIMEKAREWYKKHNNQKPFTLEYMWKDLKDQPKWRRVLEESSHNKRNKISESGAYTSSSNQDTEEETERKEKRPEGQKAAKQRQKGKGAPSPLGDKPNQNMVLFHEAITTKAAALLKAAEATLIGAEAKKEKAIAKKEKARAEKYQMYLKLMEKDTSTFSEAKLKRHENVLDQLARELAKE

SEQ ID NO: 28214 - protein, 272 aa, marine gamma proteobacterium HTCC2207
MVDKYAVFGNPIGHSRSPQIHSAFAAETDQALSYTKQLVEADGFDAAADEFFATGGKGLNVTVPFKQEAYSYAARLTPRARHAGAVNTLSLQDDGTVLGDTTDGVGLVNDMLQNLGWQIRAKRVLVLGAGGAVRGILEPLMAQQPQHVVIANRTLDKALQLSKGFAEQGYILACGFDMLPGQEFDLVINGTSVGLTGSLPPLPDDLLAPEGACYDMLYAAQPTPFMQWGKRQGAKTADGLGMLVEQAAESFYLWRQVRPKTATIIQAQRELF

SEQ ID NO: 28215 - protein, 227 aa, Symploca atlantica PCC 8002
HEVATGGQNELGFRFGRLIEAADWLMTYKYVIKNVAKKYGKTVTFMPKPVFNDNGSGMHCHQSIWKDGQPLFWGDGYANLSKMALNYIGGILRHAPALLALTNPTTNSYKRLVPGFEAPVNLAYSQGNRSASIRIPLSGTNPKAKRLEFRCPDATCNPYLAFAAMLCAGIDGIKNEIEPGESLDVDIYDLSPAELSKIPSTPGSLEAALESLEKDHSFLTDSGVFTE

SEQ ID NO: 28216 - protein, 323 aa, Oryza sativa (indica cultivar-group)
MAMITLPVAAHAPSPWLPPSILRLRSTSTTTTIPAAAARSSDPHPLPDELHLVADIRSPHNHIRVADVSRTAAGAGHPLAGARLLLLDAPGNIHSLSFPRSLCPLTSTYLDVFATLPPLLPASASSLAVLGFGAGSAARAVLHFFPDISVHGWEIDPAVVSASRDFFGLAELEAEHAARLSIHVGDALEASADAVAVPGGFGGVLVDLFAGGSVLPELQEMDTWRRIGRRMVAPGGRVMVNCGGPCVEAEEEGRGGEAVKDATLRALTAAFGHGMVSVMDVDESWVAMTGPAVSSAPEEAAAWKAKLPPELRRYVDMWRPCLL

SEQ ID NO: 28217 - protein, 434 aa, Dehalococcoides ethenogenes 195
MEPRIQVFPKNTEVKNNRLVIGGADVAGLCAKYGTPLYVFDEATIRQNCRDFKREFSRRYADSSVSYASKAFLHPALLKILAEEGMSLDVVSGGELSIASSAGFPMDMVYFHGNNKSADELRLALRLHVGRIVVDSFDEIKLLSKLADESGHIPDILLRLTPGVDAHTHHHITTGKLDSKFGFPLFQAAEAVGLAMAQASLNLVGFHFHIGSQIFETQPFLDAIDLVLEFAAQVQERYGFDIEELDIGGGYGVQYEVDKPAPQVSVYAEAIGAKIVSKCHSLKLTPPSLNIEPGRAVIAQAGVALYTVGVIKDIPGIRVYASVDGGMGDNIRPALYEAKYEAVVANNVQSSEKQKVTVAGKFCESGDILITDIELPVLKTGDILAVPCCGAYCLPMSSNYNGYQRPAVVMLKNGEDRLIRRRETVEDLSRLDSV

SEQ ID NO: 28218 - protein, 724 aa, Candida glabrata CBS 138
MSSGRGIRTAGGRSGDGPSDASPFIKPDRMRRNFLRNRRNKNIMVKKNDPEDIESREKMMLMGGVEGVKQEEVKPDLSALKDKDNEVYNEFPLRAVSREALENMRTHLLKFQSKKRIQPTENFHLPVRLHRKDTRNLQFQLTRAEIVQRQKEIAEYKKNQDGSNAQNMTKPKTTPAALTDHPTASNAPAAPLVNSSATMPTGATPTGQVVASATPTPQVSLDEKPMGGPVNAVSASATPGPATTNGATPANGTTDPAQPTVPGATILEDAGPAEDPTKVGLVKYDGKEMDSADLAEEPTVDPMADVAPDGGGRAKRGGLRRKTRQLKVLDENAKKLRFEEFYPWVMEDFDGYNTWVGSYEAGNSDSYVLLSVEDDGSFTMIPADKVYKFTARNKYATLTIDEAEKRMDKKSGEVPRWLMKHLDNIGTTTTRYDRTRRKLKAVADQRTADDEYNHSDNSENELDYDEEFADDEEAPIIDGNEQENKESEQRIKKEMLQANAMGLRDDEQVSEAEDTELFGEKKIDEEGERIKKALQKTELAALYSSDEDEINPYLSESDLEKEDEAEKEESEDSQSKKGSPKKQEGKSRQGTPSAHTVREQNIRVKSIKDCVIVLKGKPSLLTSFPAGAWNPNAVSLKRTADEVSIKKEPGSESPNKKIKVENGEIPLITEQDIINAMSGGKVNVKEFGKKIRKMFPGPENKKLMFVLVKKLCRKVDDEHMELKA

SEQ ID NO: 28219 - protein, 430 aa, Oryza sativa (indica cultivar-group)
MEPFKGNFSNLLNQGSSSQATNSDAQNSPSTQFPTSYPQNFRPSFLQNFHPFGPPSNYQPYRHPPIFQGAQQQDYYGQPTPGSLEGFQLQENLVHSSNQAFGFAANRSQFGTQYSTSIGAAANTSSSWISFSMYTRHNEKEVVKVEEASDSSEEGRRGTRINWTEDDNIRLMSSWLNNSVDPIKGNDKKSEQYWKAVAREFNSNMPSNGNKRNPKQCRTHWDNVKRDVTKFCGFYSKARTTFTSGYSDDMIMEKAREWYKKHNNQKPFTLEYMWKDLKDQPKWRRVLEESSHNKRNKISESGAYTSSSNQDTEEETERKEKRPEGQKAAKQRQKGKGAPSPLGDKPSQNMVLFHEAITTKAAALLKAAEATLIGAEAKKEKAIAKKEKARAEKYQMYLKLMEKDTSTFSEAKLKRHENVLDQLARELAEE

SEQ ID NO: 28220 - protein, 141 aa, Oryza sativa
  misc_feature (52)..(52): Xaa can be any naturally occurring amino acid
  misc_feature (85)..(85): Xaa can be any naturally occurring amino acid
  misc_feature (99)..(99): Xaa can be any naturally occurring amino acid
  unsure (1)..(141): unsure at all Xaa locations
LARSAGSDEIAHEPTDSGRAYLSTGAPSPPSRSAAEAADSRSPNRCFRRGAXDGHLYCEGVRVEDAMGAGDRTPFYLYSKPQVAXSERDYRDEPKGLRXIGRDTIQANTDRRGLDLLRELGCSAVLKRGNELRLAQQTGPQ

SEQ ID NO: 28221 - protein, 402 aa, Pseudomonas putida KT2440
MANPGSPRRFARIDRLPPYVFNITAELKMAARRRGEDIIDLSMGNPDGATPPHIVEKLVQVAQREDTHGYSTSRGIPRLRRAISNWYKDRYEVDIDPESEAIVTIGSKEGLAHLMLATLDQGDTVLVPNPSYPIHIYGAVIAGAQVRSVPLVPGVDFFNELERAIRESIPKPKMMILGFPSNPTAQCVELDFFERVVALAKQYNVLVVHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNLLVKGLHELGWMVENPKASMYVWAKIPPEYAHLGSLEFSKKLLAETKVCVSPGIGFGDYGDDHVRFALIENQDRIRQAIRGIRQMFRADGLARK

SEQ ID NO: 28222 - protein, 522 aa, Oryza sativa (indica cultivar-group)
MASAAAPEIQELIHHPYDGRVTSFVVLSCVTACLGGIIFGYDIGVTGGVTSMDAFLERFFPEVYRRMHGGGERVSNYCRFDSQLLTAFTSSLYVAGLATTFLASHVTARRGRRASMLVAGAAIAAGATVGASAAGLATVILGRVLLGVGVGFGNQAVPLYLSEMAPPSRRGAFSNGFQLCVSVGAFVAQLINFGAEKIAGGWGWRVSLAVAAVPATFLAVGAVFLPETPNSLVQQGEDHGKVRALLSKIRGSDGTGVDDELDDIVAADRCKVTARRGLTLMLTRRRYRPQLVMAVMIPFFQQMTGINAIAFYAPVLLRTVGMGESAALLAVVIKQVVGVGATLASMLAVDRFGRRTLFLAGGAQMVVSQLLIGAIMAAQLGDDGELSQASALLLIALVAVYVAGFAWSWGPLGWLVPSEIFPLEVRSAGQSIAVAVNFLLTTAVAQSFLAMLCHMKAGIFFFFAAWLVAMTAFVYLLLPETKGLPIEQVGKLWARHWFWRRFVVPDSGDGEEEGAAIDVDKL

SEQ ID NO: 28223 - protein, 458 aa, Capsella rubella
MEFTEPYKQTGPCCFSPNSRYLAVANDYRLVIRDTFSFQVVQLFSCLDKISYIEWALDSEYILCGLYKKPMIQAWSLTQPEWTCKIDEGPAGISYARWSPDSRHILTTSEFQLRLTVWSLLNTACVHVQWPRHGSKGVSFNQDGKFAAICTRRDCKDYVNLLSCQSWEIMGSFAVDTLDLADLEWSPDDSSIVVWDSPLEYKVLIYSPDGRCLFKYQAYECGLGVKTVSWSPCGQFLAIGSYDQMLRVLNHLTWKTFAEFLHLSTVRAPCSAAIFKEIDEPLQLDMSELSLDENFMPSNYDASEGYISVRYEVMELPVAFPFQKPPADKPNPKQGVGLLAWSKDSQYICTRNDSMPTALWIWDMRHLEVAAILVQKEPIRAAVWDPTCTRLLLCTGSSHLYMWTPSGAFCVCNPLPGFSISDLKWNIDGSCLLLKDKDAFCCATVPSLPESSDYSSDD

SEQ ID NO: 28224 - protein, 333 aa, Xylella fastidiosa Ann-1
MSIATTPLHTALSLPQIQSFAASDMAAIDTLIHDRLTSDIVLINQIADHIICSGGKRLRPMLTMLAGHAIGHTGPHHHQLAAIIEFIHTATLLHDDVVDGSELRRSSSTANALWGNAPSVLVGDFLYSRSFQLMTELANLEVMQILAETTNRISEGEVLQLLHVHNPDTDETTYLSVIERKTAILFAAAAQLGALASHADTQTQTRMYEYGMQLGYAFQITDDVLDYTANNSQLGKNLGDDLAEGKATLPVIHAMTHSDAATCERLRMIISKGDSDAMPEVLNAIRTTGSLDYSRQRASAYAATAERALEGLPETEAVAALRGLARYAVQRTY

SEQ ID NO: 28225 - protein, 145 aa, Zea mays
MAKLTAVVVLLMVLAAATAGAVVTNADGATATVPGRRHHQQTRRSSRFLLANSSPPSPYYACSKKSAAAVCFAPGSPGATCCGGRCVDTAASADHCGGCSKVCKHDRSTCCGGRCVDLLSDKGNCGACGNLCDKRCSNGFCDYAL

SEQ ID NO: 28226 - protein, 215 aa, Karenia brevis
MIALLLASFVFAGHGRRVQPDLEHFSQLLQGSKPEAGWHSAAPLTSAGRHHNPAAMPAIKRAAQSASMQTTKSMQEIDTHGSVMTLSRYMIEQVRGNPDMQEMEGLMTSIQMACKQIASLVARSGIQDLTGLESGGGSVNVQGEEQKKLDVISNTVMKNALRFSGRVRVVGSQEDDNPVLIEEAYSGTYAAVFDPLDGSSNIDAAISTGTIFGIF

SEQ ID NO: 28227 - protein, 194 aa, Karenia brevis
  misc_feature (29)..(29): Xaa can be any naturally occurring amino acid
  misc_feature (70)..(70): Xaa can be any naturally occurring amino acid
  unsure (1)..(194): unsure at all Xaa locations
SLVQTLQPGKSLVAAGYCMYSSSTVMVMXPANGVNGFTLDPKFGEFVLTHPDIKIPKRGKIYSINEANYXDWDPALQTYISNLKAGKGESGQKYSARYIGSMVGDVHRTLLYGGLFGYPGDAKNPNGKLRLLYEGGPMSFLLEQAGGKSTTGSQRVMDITPASVHQRVPVFLGSPDDVDEVTKVYKEAGIEKNY

SEQ ID NO: 28228 - protein, 590 aa, Xylella fastidiosa Ann-1
MPHSAHRPTPTLHTQMNVRLQGHGAARGTALGRAWVRQMNIIEIQDKYITDTNAELHSLYQAMSAARQEIQVLRERMHGTLSHEVGEFLDLYTLLIDDPELLRSLNELILTHNYSAEYALKIQRDRLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGELLLQKITNGDMLIIDGNSGEIIVNPSPQDLRHYHSRLRERAKEQRELEQLRSKHSRTRDNVDIVVQANAESPDDVSQAYALGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDAHYVPMLLALGLTEFSLHPATLLEVRRVIRNSDLGTLKTSVTTLLRARDRKSIEEWMAAHANTTPT

SEQ ID NO: 28229 - protein, 356 aa, Olimarabidopsis pumila
MEKGEDSSTFKMGNSAQERSLPYVPDCYVVPPSCEPCDSNSDVVPTIDVSRLKGVDDDRREVIRELSLACQRLGFFQIVNHGINQNILDDALEVAKGFFELPAKEKKKFMSNDVYAPIRYSTSLKDGLDKIQYWRIFLKHYAHPLHRWIHLWPENPPEYREKMGKFCEEVRKLSIEIMGAITESLGLGRNYMSSRMDENGMQVMAVNCYPPCPDPETALGLPPHSDYSCITILLQNLAGLKIFNPMAHGGSGGWVVVPQVTGALKVHIGDHVEVLSNGLYKSVVHKVTLNEENMRISLASLHSLGMDDKMSVPCELVNHENPVRYRESSFNDFLDFLVKNDISQGDRFIDTLRIKD

SEQ ID NO: 28230 - protein, 112 aa, Vibrio angustum S14
METIDKIKQQIAENPILLYMKGSPKLPSCGFSSQASQALMGCGEKFAYVDILQNPDIRAELPVYAQWPTFPQLWIEGELIGGCDIILEMFQKGELQSLIKDAAARRDAASAE

SEQ ID NO: 28231 - protein, 227 aa, Tolypothrix sp. PCC 7101
HEVATGGQCELGFRFGKLIEAADWLMTYKYVIKNVAKKYGRTVTFMPKPIFGDNGSGMHCHQSIWKDGKPLFGGDKYAGLSDMALYYIGGILKHAPALLGITNPTTNSYKRLVPGYEAPVNLAYSQGNRSASVRIPLSGSNPKAKRLEFRCPDATSNPYLAFAAMLCVGIDGIKNKIHPGEPLDRNIYELSPEELAKVPSTPGSLELALEALENDHAFLTESGVFTE

SEQ ID NO: 28232 - protein, 1448 aa, Aspergillus oryzae
MSSKFEVAPDVDPGTQIDTYPDHEDDTLSDTSSSVSSDEKQERQSLSRIASSRLGQVLSATHAKNEPQLDPNSPEFDHRRWAQFVLRRMHECGIEPPQQGVVFKDLQVSGSGSALQYQETVLSTFAIPFRTAARAIAGQKRMPRRQILRGFDGLLEGGELLLVLGRPGSGCSTLLKTICGRMGGLTLEPESTIHYNGVGYEDMIKHHRGEIAYNKEVDEHFPHLTVGQTLSFAAHARAPRRRIEGVTRTEFADTMTKVVMSVYGLSHTVNTKVGDNFIRGVSGGERKRVSIAEMFLSNCRIGAWDNSTRGLDAASALKFVRALRLSADMSNSCHAVAAYQASQSMYDLFEKVVVLYEGYEIYFGRCDAAVEYFQRMGWERPEKQVSPDFLTAITNPLERRARPGMEDKVPRSAKEFSEYWKRSVEYQNLRTEIGRYVQEHAPNSEAAQILRQVHEEKQARHTRTNSPYLLSIPMQIRLCVRRANQRLRNDLPTAMSTVVVQTILSLIIGSVFYNSPNSSNAFFQKGAVLYFSVLMNALITIGEIMQLYAQRPIVEKQAAYAFVHPFTEALASALVDLPIKILRCSVFSIILYFLANLRREPSQFFIFYLLLICTILTMSGMFRSLASLTQTVGQAMALAGILVLCIVVYTGFTLPQPYMHPWLSWIRWINPVYYAFEALVSNEFHGRNFECTSYIPSYGTETSFICSVVGAVAGERFVSGDAFIQQNYQYSYSHLWRNFGILIAFLIFFHVLYLTATEFISADKSTAEALVFRPGHAPSHLQDGDGIEAEKTNPTTEVRADADSIRLPEQKDILSWKSVCYDIPVKDGTRRLLDNVNGWVKPGTLTALMGVSGAGKTTLLDVLAQRVSIGVVTGDIFVNGKGLAANFPRRTGYVQQQDLHLETTTVREALRFSAMLRQPRSVSQQEKYDYVEQVIQVLGMEDYAEAVVGRLGEGLNVEQRKLLSIGVELAAKPTLLVFLDEPTSGLDSQSSWTICAFLKKLTNQGQAVLATIHQPSAMLFQTFDRLLFLAKGGKTVYFGDIGKDSRTLLDYFERNGGRICKEHENPAEYILETVSGDVDNNTPDWVKVWDESPEHKDVLAELDRLHSSRENDSASSNENAESKDEFAMPLHSQLYHVLRRVFQQYLRQPEYIFSKFILGIVSGLFIGFSFWKTDNTQQGFQNSLFSIFLLCTIFNTLVNQIMPKFVAQRALYEVRERPSRVYSWKVFILSQMIVEIPFQFGLGVCSWASFYWSVFGANQDSERRALIMLFIVQFFIYSASMAQFVVCAVGEPALASMIATLMFGLSFVFSGVMQPPPALPGFWIFMYRVSPFTYYIGGIGSTALHGRPVQCSSTELSVFDPPDGQTCGEYMAKYLNSAGGQLYNMNATFGCEYCAMDSADQYLAQRWIYWEDRWRNYGIFWAYFVFNIVGAITLYYLFRVRKISLKKS

SEQ ID NO: 28233 - protein, 333 aa, Mycoplasma gallisepticum R
MMAIQTQRIAILTSGGDSPGMNPAIYGLVQQAIINNIQPYLVYEGYKGLVEDQIVLANQQEVIDHFFDSGTFIYSARLVEFKDLEVRKKAVSNLKAKKIDTLVVIGGDGSYQGAKLLSEMGINVIVMPGTIDNDVSSSDYTIGFYSALEHITRTIQEIISTSVSHNRVSISEVMGRHCGDLAVYAALATKADLVITSENIKTTQEIVDLAAKRMLQDHKRTFTVIVCEHIYGEDGRDSLKTIAQQINDQLGIKTNLNILTYGQRGQVPTPMERILAMKFAIKAFECINEQRYGVVLGLSGDEIVAYNFQEALNKRNPSRIKLINLSNRINGGF

SEQ ID NO: 28234 - protein, 133 aa, Zea mays
  misc_feature (53)..(53): Xaa can be any naturally occurring amino acid
  misc_feature (67)..(67): Xaa can be any naturally occurring amino acid
  misc_feature (98)..(98): Xaa can be any naturally occurring amino acid
  misc_feature (105)..(105): Xaa can be any naturally occurring amino acid
  unsure (1)..(133): unsure at all Xaa locations
ARDIRSLDGSSISGMKLADCRSAALSILGPRANDVKINYLDHNDYFDITPHPXTTEQWDLYGSDTPXPYNPLQSKFFKTFAGPITKRGLMLKLLLMDXTSLLIYXSTSASPDLLTIKTRPQETLACRSLRMNI

SEQ ID NO: 28235 - protein, 239 aa, Triticum aestivum
NKFVQKSRLVPVRNSRDIVDPRVRLYGTRIAVLAGDFMFAQSSWFLANLENIEVIKLISQVIKDFASGEIKQQSTLFDCDVTLDDYLLKSYYKTASLLASSTRSAAIFSGVSTAVCEQMYEYGRNLGLSFQVVDDILDFTQSAEQLGKPAGSDLAKGNLTAPVIFALQESPELREIIDSEFCDTGSLSAAMELVHRKRGDSAGAKDLAQEKGRPGASRNLQWPPPGAILKDGPPKKLVK

SEQ ID NO: 28236 - protein, 555 aa, Catharanthus roseus
MGSKDDQSLVVAISPAAEPNGNHSVPIPFAYPSIPIQPRKHNKPIVHRRDFPSDFILGAGGSAYQCEGAYNEGNRGPSIWDTFTNRYPAKIADGSNGNQAINSYNLYKEDIKIMKQTGLESYRFSISWSRVLPGGNLSGGVNKDGVKFYHDFIDELLANGIKPFATLFHWDLPQALEDEYGGFLSDRIVEDFTEYAEFCFWEFGDKVKFWTTFNEPHTYVASGYATGEFAPGRGGADGKGEPGKEPYIATHNLLLSHKAAVEVYRKNFQKCQGGEIGIVLNSMWMEPLNETKEDIDARERGLDFMLGWFIEPLTTGEYPKSMRALVGSRLPEFSTEVSEKLTGCYDFIGMNYYTTTYVSNADKIPDTPGYETDARINKNIFVKKVDGKEVRIGEPCYGGWQHVVPSGLYNLLVYTKEKYHVPVIYVSECGVVEENRTNILLTEGKTNILLTEARHDKLRVDFLQSHLASVRDAIDDGVNVKGFFVWSFFDNFEWNLGYICRYGIIHVDYKTFQRYPKDSAIWYKNFISEGFVTNTAKKRFREEDKLVELVKKQKY

SEQ ID NO: 28237 - protein, 227 aa, Nostoc sp. PCC 7906
HEVATGGQCELGFRFGKLIEAADWLMIYKYVIKNVAKKHGKTVTFMPKPIFGDNGSGMHCHQSIWKDGKPLFAGDQYAGLSQMALYYIGGLLKHAPALLAITNPSTNSYKRLVPGYEAPVNLAYSQGNRSASIRIPLSGTNPKAKRLEFRCPDATSNPYLAFAAMLCAGIDGIKNKIDPGSPLDKNIYELSPEELAKVPSTPGSLELALEALENDHAFLTESGVFTE

SEQ ID NO: 28238 - protein, 394 aa, Prochlorococcus marinus str. NATL2A
MTQLETRTEPMVVNFGPHHPSMHGVLRLVVTLDGEDVVDCEPVIGYLHRGMEKIAENRTNVMFVPYVSRMDYAAGMFYEAIVVNAPERLANIKVPKRASYIRAIMLELNRIANHLLWLGPFLADVGAQTPFFYIFREREMIYDLWEAATGQRLINNNYFRIGGVACDLPWGWLEKCKDFCDWFGPKIDEYEKLITNNPIFRRRIEGLGVIGKEQAINWSLSGPMLRAAGVPWDLRKVDHYECYDDFEWDIAWEKEGDCYARYRVRIEEMRQSLKILRQACEMIPGGPTENLEAQRTVEGKKGDLSGFDYQYVAKKVAPTFKIPNGELYTRLESGKGEIGVFIQGNNDVTPWRFKIRAADSNNLQILPHILKGAKVADIMAILGSIDVIMGSVDR

SEQ ID NO: 28239 - protein, 416 aa, Glycine max
MASENVSTDTVSKAVDALLKWRRSQSETLKPKLFDEDEEYVYLILTLKKIPSKSRVNPHKIPLPHSLFSPFSEQCLILDDRPNKARVTKAQAQARIQSESIPVNKILKLSKLASDYRPFEAKRKLCDSYDLFFAEKSIVPLLPRLLGKSFFKKRKIPVPVDLKKGSWKEQVERACSSAMLFMRTGTCSVVRVAKVRMERDEIVENVVAAIEGIVEVVPKKWGNVRSLHLKLLESVALPVYQTVPDVKLKIEGFKVEEKKNEKERDGEVSDSIEGGTEKKKKKKGRIHEVRYMDENVVEAGMEDELASDDDDSEDEMVSKKRKKGVSSELSGVEQLKKLVFNELSANGKKKSKKGCLSVGKGVKGGLIEGSGSELVVKDEESGVKKKKKKREEVKAKATKSVKATKGVKAKKIKKAA

SEQ ID NO: 28240 - protein, 227 aa, Lyngbya aestuarii PCC 7419
HEVATGGQNELGFRFGTLIEAADNLMIYKYVIKNVAKKYGKTVTFMPKPLFNDNGSGMHCHQSIWKDGQPLFGGDKYAGFSEMDLHYIGGILRHAPALLALTNPTTNSYKRLVPGFEAPVNLAYSQGNRSASVRIPLSGDNPKAKRLEFRCPDATANPYLAFAAMLCAGIDGIKNKIDPGEPLDVDIYDLSPEELGKIPSTPGSLELALEALENDHAFLTESGVFSE

SEQ ID NO: 28241 - protein, 332 aa, Mycoplasma gallisepticum R
MNWRIYTMSDKIIVNNIEALNNALDIALSKDKSVVLYGQDAGFEGGVFRATKGLQQKHGADRVWDTPISEAAMTGAAIGASYAGLKPIVEIQFSGFSYPAMQQLFCHAARIRNRSRGKLNAPIVIRMPMGGGIKALEHHSESLEAIYAHIPGVKVVMPCNPYDTKGLMLAAINDPDPVVFFEPKKLYRSFKQEIPAGEYVVEIGKANVLTQGSKLTIVTYGANVIDTLEIVNQYPAGDLELIDLRTISPIDWNTVLGSVQKTGRLLVVHEAVKSFSVSAEIMARVSETLHSSLKKAPVRVTGFDITVPLAKGEAIQFDLKKRTVDAINELLA

SEQ ID NO: 28242 - protein, 509 aa, Arabidopsis thaliana
MIGARNFKGFVLTAQYSQTQDLFTSRLQSQIEKLPKLVEDIVQTSINTGPRGVTRLVQGVQAFVGVGGEWLNDLSKSTSASGGLPSELQLGLLSPLYLRKLFERMGATYIKLGQFIASAPTLFPPEYVKEFQNCFDKAPPVPFEEIRKILQEELGRPIESVYEYVDPTPIASASIAQVHGARLRGSQEDVVIKVLKPGIEDFLVADLNFIYVVSRIFEFLSPEFSRTSLVGIVKDIRESMLEEVDFNKEAQNIESFKRYLETMGLTGQATAPRVYKYCSSRRVLTMERLYGVPLTDLDSIRSLVSSPENSLITALNVWFGSLLACESFHADVHAGNLWLLRDGRIGFLDFGIVGRISPKTWAAMEVFLASIATEEYESMASALIQMGATNRDVDGKAFAKDLEKMFSSIQELDTEIVVATARGTNSDTTAVAANVVMDERQMNALFLDLVRVSESYGLKFPREFALLLKQLLYFDRYTRLLAPNLNMLQDQRISIASNKRTNGYKDSFN

SEQ ID NO: 28243 - protein, 359 aa, Mycoplasma gallisepticum R
MAIIVKNKIPELLHRVIDNEGRVIDPSYVQKLSDERVIEAYYYMNLSRELDKKMLTWQRSGKMLTLAPNIGEEALQLGTSLAMTKKDWLVPAFRSGALMLHRGVKPYQLMLYWNGNEKGNVFDEGVRVIPINITIGAQYSQAAGIGYALKQNKERAAAVTFIGDGGTAEGEFYEAMNLASIHKWQTVFCVNNNQYAISTRTNLESAVSDLSTKAIAVNMPRVRVDGNDLLACYDAMLEAIEYSRSGMGPIFVEFVTYRQGPHTTSDDPSVYRTKQEEEEAKKSDPIARIKKFLTAKGLWDEAKEKTMFEQIEAKISEEYDVMLQHIQTTVDDVFDHTYATLPQNLVEQKAVAKKYFGDK

SEQ ID NO: 28244 - protein, 227 aa, Anabaena cylindrica PCC 7122
HEVATGGQCELGFKFGKLIQAADWLMTYKYVIKNVAKKYGRTVTFMPKPVFGDNGSGMHCHQSIWKDGQPLFAGDKYAGLSETALHYIGGLLKHAPAVLAITNPTTNSYKRLVPGYEAPVNLAYSQGNRSASIRIPLSGTNPKAKRLEFRCPDATSNPYLAFAAMLCAGLDGIKNKIDPGEPLDKNIYELSPEELAKVPSTPGSLDAALEALEKDHAFLTEGGVFSE

SEQ ID NO: 28245 - protein, 432 aa, Candidatus Protochlamydia amoebophila UWE25
MISRPISQQIYSNLNRVIPGGVNSPVRACANMGQIPMIIDHAYRDTLVDVDGKTYVDYCGSWGALIHGHAHPSILEAVQQRMKKGTSFGITTSIEGELAQEVIKLIDSVEKIRFVSSGTEATMSAVRLARGYTNKEFIVKFNGNYHGHADFFLVQAGSGVLEVSPSASSAGIPADIVKQTLCLPYNDIEACRQIFHHSDYRHKIAAIILEPIAGNMGVIPASQEFMQFLRKETLAMGALLIFDEVMTGFRVALKGAQDIYPVEPDLTCFGKIIGGGFPAAAFGGREEIMNLLAPLGSVYQAGTLSGNPIAMEAGLQSLRLIQQPGFYEELHRKTDLLLNPIKETIKKNNWPICIQQAGSMFTLFFCKNRVRNLEDALKANTTIFANFFRKLFDQGIYIPPSQHEAWFISQAHEESNLIKTQSAILTFLEENF

SEQ ID NO: 28246 - protein, 55 aa, Cucumis sativus
GGGLRPLLEEAENERMHLMTMIELVQPKWHERLLVITVQGVFFNAFFVLYLTVPQ

SEQ ID NO: 28247 - protein, 250 aa, Oryza sativa
LHLLRPMPSFVDGPTLRSLLRPSTNGRRTKASDGGGGGGGGGIFKMFKLMPMLTSGCKMVALLGRHNRALLADHATTVTLFGHRRGRVSLAIHEDTRAPPVFLIELPMLTSALHKEISSGVVKLALESDTRSARRRLVEEYVWAVYCNGRKAGYSIRRKEASDDERHVLRLLRGVSMGAGVLPAAPEKEGGVPAGPDGELTYVRARVERVVGSKDSEAFYMINPNEGGVGGDSAGDGSAPELSIFLVRMK

SEQ ID NO: 28248 - protein, 356 aa, Schizosaccharomyces pombe 972h-
MSELIELVGFLHDQNPQVRMLAVQHLLPYTARNHPQFSIWFHNDFEPVKDLKALLKDKPQIASQAVTALVNVSQNEKVRKVLMDDEFLQLIFSIVTNPLHGLADLSCMLLCNLAKEEDFARILDMQVPLREFSLSKNIIDQLMDLFVKGTDHGINEYANFDFLANVFADMTRFERGRKYFTTLQEYDHVIPASKLVVFTEHKSLLRRTGVAAIIKNISFDIPFQKVLMDEEGINVLPYLLLPLAGPEELSEEDMDGMFDELQLLPDDKKREPDHFIMKTLVETLVLLTATREGREHMRRRKVYPIIRELHLNVDDEEIREVCDQLVQMLVRDEAPEELEHIQDNPPDEDDVIVEVD

SEQ ID NO: 28249 - protein, 371 aa, Arabidopsis thaliana
MKSSQMSETEFKVLLETFTFPADSAPFKSCHASTIVEVVKDHFLAAYFGGTREGAPDVKIWLQHFKDGQWDSPVIVDEEPGVPMYNPVLFKLPSHELLLFYKIGQEVQKWSGCMKRSYDKGITWTEREQLPPGILGPIKNKVLVALRRLDYSIKTKPFVLPILLEDGTLLCGSSVESWNSWGAWMEVTSDAGRTWRKKGPIYIQGKSLSVIQPVPYQTAAGNLRILLRSFTGIDRICISESLDGGENWSFAVPTVLPNPNSGIDGVKLKDGRLVLAYNTDSRGVLKLGVSLDDGDSWTDILTLEESPGMEYSYPAVIQAGDGNVHVTYTYNRTQIKHVVLKTATDIDSKPYRHGEAGGGHVNLDLYEPNIN

SEQ ID NO: 28250 - protein, 292 aa, Vibrio parahaemolyticus RIMD 2210633
MFSGSIVALITPFKADGEVDFDGLQKLVEYHIEAGTDGIVAVGTTGESATLTIEEHVKVVNKTVEFANGRIPVIAGTGANATHEAVTFSKLLADSGIAGFLSVTPYYNKPTQEGLFQHYKAIAEASDVPLILYNVPGRTAVDLQPETVARLSKLDNIVALKDATGDLSRIALHRELCGKDFILLSGDDATGLEFVKLGGNGVISVTNNIAAKDMADMFHLASEGKFEEAEIINQRLMTLHKNLFVESSPIPVKWAAHKLGLIEEGGLRLPLTALSEKSQPIVEQALTDAGIY

SEQ ID NO: 28251 - protein, 462 aa, Oryza sativa (indica cultivar-group)
MDPCPFVRVLVGNLSLKMPVAPRPAGAGAGVHPSTSPCYCKIRLNKLPYQTADAPLLLPPSPEASAAPAPAPATGALAAAFHLSKADLDRLTAKPSLFGSRTARLKIVVYAGRRGTTCGVGGGSGRLLGKVVIPLDLKGASAKPVVYHSSWICIGKRGRKPSSVSAANAQLNITVRAEPDPRFVFEFDGEPECSPQVLQVQGSMKQPMFTCKFSCRSNSDLRSRSMPADMGSGGRNWLTAFGSDRERAGKERKGWSVTVHDLSGSPVALASMVTPFVASPGTDRVSKSNPGAWLVLRPGDGTWKPWGRLECWRERGAGAAAGDSLGYRFELVLPDPTGMGVGVSVAESTIPASKGGRFAIDLTATQQFGRSGSPACSPCGSGDYGMWPFGSCRGFVMSPAVQGEGKCSRPAVEVGVQNVGCAEDAAAFVALAAAVDLSMDACRLFSHRLRRELSASRSDLLR

SEQ ID NO: 28252 - protein, 195 aa, Photobacterium profundum SS9
MTEKHVAVLLADGFEEGEAVVFIDIMRRLDIKVTVLSCMETTALNTYFETRITADDILKNCYDTMYDAVMMPGGPKGTDNLSANPMVIDFLKRHINEDKYICALCSSGAKVLAAHQLLGLHYYTTGAGLDKKFDDGQFLDQKVVVDGQFISGKGLGVSFEFAFTVAKYLLVDNQEKVDWQASHIYFDHWPLLSET

SEQ ID NO: 28253 - protein, 475 aa, Erwinia carotovora subsp. atroseptica SCRI1043
MMSTEIKAQVVVLGAGPAGYSAAFRAADLGLETVLVERYSTLGGVCLNVGCIPSKALLHVAKVIEEAKALAEHGIVFGEPKTDIDKIRLWKEKVINQLTGGLAGMAKGRKVKVVNGLGKFTGANTLEVDGENGKTTINFDNAIIAAGSRPIQLPFIPHDDPRVWDSTDALELKSVPERLLVMGGGIIGLEMGTVYHALGSQIDVVEMFDQVIPAADKDVVKVFTKRISKQFNLMLETKVTAVEAKEDGIYVTMEGKKAPAEPQRYDAVLVAIGRVPNGKNLDAGKAGVEVDDRGFIHVDKQMRTNVPHIYAIGDIVGQPMLAHKGVHEGHVAAEVISGKKHYFDPKVIPSIAYTEPEVAWVGLTEKEAKEKGISYETAIFPWAASGRAIASDCAEGMTKLIFDKETHRVIGGAIVGTNGGELLGEIGLAIEMGCDAEDIALTIHAHPTLHESVGLAAEIFEGSITDLPNPKAKKK

SEQ ID NO: 28254 - protein, 411 aa, Oryza sativa (japonica cultivar-group)
MAQQLSAPFRAAAAAGSRASAAAADPAKVLRLRSAGSAQFTSIAASSSFARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYSNRVLDLIAHMALVNAKH

SEQ ID NO: 28255 - protein, 1269 aa, Olimarabidopsis pumila
MLFGKKKRKKERSPKPTIKGVLTAFFATTAALFLLLLAGLSLAGTVVAFAAFMPLFIVFSPVLVPAGITATVLASGFIVGGTSGVTVLPILMWLHKKITGKDPPKIPGLILNGDAPSGGIPDGALPSRDASSGVAPVENTSDGYAPRGNTSSAGIPVENASEGVASVGEASDRAVSAEIASTGTSPVGAASVGDTSGETASVGDASGGAAPAGDASGGAAPIGDASGGAAPVRDASGGAAPIGDVSGGAAPVGDISSGGAPIGDASGGAAPTADPSGGAAPTAYPSRGAAPVGDVSSEGAPIGDASGGGTQVGDASGGGAQVGDASGGGASVTDASRGGLPFGIGSGGGFPFKIRSGRGWPFKIGSGKGLPFKIGLGGNLPFKIGSRRGFPFKIGSWGGLPFKIGSRGGGQMGDASGGAQPVGDSSGGAAPIGDASGGAAPTGGAFGGAAPTGDASGGAAPVGDVSSGGTAIGDASGGGAPVGDASGGGGPVSDASGGGFPFKIRSGGGWPFKIRSWRGWPFKIGSGGGLPFNIGSREGFPFRIRSWGGLPFKIGSGGGLPFKIGSGGGEPMGDASGGAVSVGDASGGGGTMGDASGGAAPVGDVSSGGAPIGDASGGGAPIGDALGGGGPVGDTSGGGFPFKIRSGGGWPFKIRSGRSWPFKIGSGGGLPFNIGSRGGFPFRIRSWGGLPFKIGSGGGGTMGDASGGAAPVGDASGGGAPVGDASGGAAPVGDASGGAAPIGDATAGAAPVGDASGGAPPVGDASGGGLPFGIGSGGGFPFGIGSGRGLPFKIGSRRGLPFGIGSRGGWPFRIGSGRGLPFKIGSGGGFPFGIGSGGAASGGGSSSDGDASGGAAPVGDVSGGAAPIRDTSTKSTDKSSPTKSKAKPTSKPPSKQPLKPAPKSKANKPKKPETKTTKKPTTKPVTKPTTKPTTKPTTKQTTKPVTKPKPYPVGKPSAKPVPKPTIKSAGKTSAKPTATPATKSTVKPTTKPATKPTAKPATKPTAKPATKPTVKPTTKTTAKPTVKPVAKTTAKSATKSTVKPAPKPPVKTVAKTAAKPIVKPADKPTEKPATKPIVKPAAKPTIKSAAKTAVKPAAKTTAKPTVKPVVKPAAKPTVKPASKPIVKSTAKTLVKPTVKPTAKPAAKPAAKPTVKPAAKPLVKPAAKTVAKPTAKTTTKPTLKAAAKPIKPATAKPIKPTTAKPLVKPAAKTTAKMVTKPTIKPATKSPTKPAGKSKVKPAAKPTSKPATKVAAKPVAKPAKPVTKPKK

SEQ ID NO: 28256 - protein, 544 aa, Nostoc punctiforme PCC 73102
MIDIGQLAAQILTRVSLMTDTTTTTTSLNKFEKFKAQKDGLAIRDEIEKFAALGWEAMDETDRDHRLKWVGVFFRPVTPGKFMMRLRMPNGILTSSQMSVLAQVVQRYGDDGCADITTRQNIQLRGIRIEDLPDIFNRFHAVGLTTIQSGMDNIRNITGDPVAGLDADELYDTRELIQQIQDMLTNKGEGNPEFSNLPRKFNIAIAGGRDNSVHAEINDLAFVPAFKEANGQEFSKPPIFGFNILVGGFFSAKRCEAAIPLNAWVAPEDVVAVCRAVLEVFRDHGPRANRQKSRLMWLIDEWGLEKFRAEVDTRLGKSLLPAAAKDEIDWEKRDHIGVYKQKQPGLNYAGLNIPVGRLYAEDMFEIARLAEVFGSGEIRFTVEQNIVIPNISDSRLATFFTEPLLERFSINPGLLARSLVSCTGAQFCNFALIETKNRALEMIKALEEDLIFTNPVRIHWTGCPNSCGQPQVADIGLMGTKTRKNGKTLEGVDIYMGGKVGKDAHLGTCVTKGVPCEDLQPLLQDLLIKNFGAKLKQEALVISG

SEQ ID NO: 28257 - protein, 183 aa, Photobacterium profundum SS9
MNTKQQQIAIVTGANGGIGKNYTRMMLDDGFRVVMAVRNEVAGSLVRDELLQSHPDAAIDILKVDMSSLSSIKAFSKQVKEKYSRIDVLAHNAGVYFFDNERRESTDGIELNLAVHVVGPYALTIQLLPLLKETQGSRVITMSSSEHHGAKIDLRDIQIKERFEEQGNMIAYSRSKWAGLGWH

SEQ ID NO: 28258 - protein, 394 aa, Arabidopsis thaliana
  misc_feature (317)..(317): Xaa can be any naturally occurring amino acid
  unsure (1)..(394): unsure at all Xaa locations
MAIMSDLPRDLLAEILSRVPLASLRSVRFTCKKWNDLSKDRSFLKKQIVEAKKKQLKSKEFEVIMMRNFRVYLTSVDLHNDVNPSFTPKGTLTSFSDDANQHQVDNVSSVFHCDGLLLCITKDLNFRLVVWNPYFGQTRWIQPRNSYHIKDIYAIGYDENKNHKILRLKDQYYDYDSHPRARICEFELYSFESNSWKVVLDVSPDWYIHSYHRGLSVKGNTYWYATEKHGYVNFLICFDFTTEKFGPRLPLPFNATESFTYDDVVTLSSVGEEQLALLFQSDATLMMEIWVTSKVDPTEVLWNKLFLAVDHDMIEFXYELKFVADAGSFFIDQKKNVVVVFDKDMNEHTHRGMAYIVGKNGYFKRVDIGEEAYTSCFPLVCSYVPSSVQIRQLT

SEQ ID NO: 28259 - protein, 249 aa, Pseudomonas syringae pv. syringae B728a
MKLEGKIAVVTGASKGIGAGIAKALGAEGARVIVNYATGKADADAVVAWIAEHGGSAFAVQADMSQSADVIRLFETVGTKYGALDILVNNAGVAVFQMIDDLTEEAFHTQFNLNVLGYLLAVREAVKLLGPTGSIINISSILSTDPYLASSVYAATKGAVDTLTFALARELGARGIRVNSILPGHTNTPATHGHFAGELGEKILAGTPLGRFGEPEDIAPLAVFLASQDSHWVTGESIRASGGVRGVGY

SEQ ID NO: 28260 - protein, 977 aa, Desulfovibrio gigas
  misc_feature (158)..(158): Xaa can be any naturally occurring amino acid
  unsure (1)..(977): unsure at all Xaa locations
ATMALKTVDAKQTTSVCCYCSVGCGLIVHTDKKTNRAINVEGDPDHPINEGSLCAKGASTWQLAENERRPANPLYRAPGSDQWEEKSWDWMLDTIAERVAKTREATFVTKNAKGQVVNRCDGIASVGSAAMDNEECWIYQAWLRSLGLFYIEHQARIXHSATVAALAESYGRGAMTNHWIDLKNSDVILMMGSNPAENHPISFKWVMRAKDKGATLIHVDPRYTRTSTKCDLYAPLRSGSDIAFLNGMTKYILEKELYFKDYVVNYTNASFIVGEGFAFEEGLFAGYNKETRKYDKSKWGFERDENGNPKRDETLKHPRCVFQIMKKHYERYDLDKISAICGTPKELILKVYDAYCATGKPDKAGTIMYAMGWTQHTVGVQNIRAMSINQLLLGNIGVAGGGVNALRGEANVQGSTDHGLLMHIYPGYLGTARASIPTYEEYTKKFTPVSKDPQSANWWSNFPKYSASYIKSMWPDADLNEAYGYLPKGEDGKDYSWLTLFDDMFQGKIKGFFAWGQNPACSGANSNKTREALTKLDWMVNVNIFDNETGSFWRGPDMDPKKIKTEVFFLPCAVAIEKEGSISNSGRWMQWRYVGPEPRKNAIPDGDLIVELAKRVQKLLAKTPGKLAAPVTKLKTDYWVNDHGHFDPHKIAKLINGFALKDFKVGDVEYKAGQQIATFGHLQADGSTTSGCWIYTGSYTEKGNMAARRDKTQTDMQAKIGLYPGWTWAWPVNRRIIYNRASVDLNGKPYAPEKAVVEWNAAEKKWVGDVPDGPWPPQADKEKGKRAFIMKPEGYAYLYGPGREDGPLPEYYEPMECPVIEHPFSKTLHNPTALHFATEEKAVCDPRYPFICSTYRVTEHWQTGLMTRNTPWLLEAEPQMFCEMSEELATLRGIKNGDKVILESVRGKLWAKAIITKRIKPFAIQGQQVHMVGIPWHYGWSFPKNGGDAANILTPSVGNPNTGIPETKAFMVNVTKA

SEQ ID NO: 28261 - protein, 236 aa, marine gamma proteobacterium HTCC2207
MSAKAGALYTNMRQLLQRDNDPIFMDSNHIDYQRVTFLTSAPSIKQCPEDSGCEVAFAGRSNAGKSSAINTLTRIRGLARTSKTPGRTQLINFFDLGNDKRLVDLPGYGYAKVPIEMKREWDRDLAEYLQLRQSLAGLVLLMDIRHPLQEFDLQMLNWAAQAGLPVHILLTKSDKLKRGPGQNALLMVERHLRDMDPGCTLLSVQTFSSLKKQGLPELESVLAHWLNSDFVDPATV

SEQ ID NO: 28262 - protein, 111 aa, Synechococcus elongatus PCC 6301
MKRILGTAIAALVVLLAFIAPAQAADLAHGGQVFSANCAACHLGGRNVVNPAKTLQKADLDQYGMASIEAITTQVTNGKGAMPAFGSKLSADDIADVASYVLDQSEKGWQG

SEQ ID NO: 28263 - protein, 357 aa, Bradyrhizobium sp. BTAi1
MSKKPYRIAVIPGDGIGKEVMPEGLRVIEAAAKKHGVAVQFDHFDFSSYDYYEKHGQMMPDDWKAQIGSHDAIYFGAVGWPAKIADHVSLWGSLIKFRREFDQYVNLRPVRLMPGVPSPLAGRKPGDIDFWVVRENTEGEYSSVGGRMFPDTDREFVTQQTVMTRTGVDRILKFAFELAQSRPKKHLTSATKSNGISITMPYWDERVEAMAKNYPGVKWDKYHIDILTANFVLHPDWFDVVVGSNLFGDILSDLGPACTGTIGIAPSGNINPERNFPSVFEPVHGSAPDIAGQGIANPIGMIWSGAMMLEHLGEKTAAQAIVGAIERTLAERTLRTRDLGGNADTEACGKAVAEMVD

SEQ ID NO: 28264 - protein, 281 aa, Archaeoglobus fulgidus DSM 4304
MVKEVFESIEDYEKSLEERIQSGSMGYRKMFDLTGKVAIVTGATGGLGGPIALGLADFGCDVVVVGRRLEVLEKLKESIEKLGQRALAVKCDITSEEDVANLVNRTVEEFGRIDILVNCAGINIPKPAEEYPLEDWNKVMDANVTGVFLVCREVGKVMVKQNGGKIINVSSVRSSYGMPKNYIAYCSSKAAVNMITKQLACEWAKYNILVNAIAPTVIATPLTAHIMKDPELSKTMKSRILLGRWGYPDDLIGAVVFFASDASNFVTGQILYIDGGVTSWA

SEQ ID NO: 28265 - protein, 543 aa, Ustilago maydis 521
MAFLKRVEDRPTPASVYNWRVWMLSFIASFASIMIGYDSAFIGGTLALPSFTKSFGKLNANTSGNLVSTYQAGAFFGAFLGHPIGHFFGRKRGLLITSIVFTIGAAIMTAASPATHLTPIYVGRAIAGLAIGAASNLTPMYISEIAPAPARGQAIGVYEIGWQIGGIVGFFINYGVIQTLPPSVKQWRIPFAVQLIPGGMLMIGSLFLVESPRWLLSRGRVDEAQQKLAYIRQLPTDHPYFIEEFNQMSHSIEENKRVAGGDSYFAPFRYVFRQKHLLRRLAFGSSLFIFQNGTGINAINYYSPTVFKSLGIVGTSTGLLGTGCFGVIKTIGSFVFILFLVETVGRRRLLMISSTGGAAAMYYIAAYIAIAKPTLHKKSSIDGPGASALAFFYIWTCFYSFGWNPLPWVYGAESFDNTARPVAQIFMAASNWLYNFVISQATPHMFQRMGWGVYAFFASCMVVSVFWIYFLMPETKGIPIEEMDNLHEKRPARHAHRMVMEELRTKAAEQRGEAVLANDGYQPSDTASSNEKEDNNQVKINTA

SEQ ID NO: 28266 - protein, 507 aa, Oryza sativa
  misc_feature (34)..(34): Xaa can be any naturally occurring amino acid
  misc_feature (270)..(270): Xaa can be any naturally occurring amino acid
  misc_feature (316)..(316): Xaa can be any naturally occurring amino acid
  unsure (1)..(507): unsure at all Xaa locations
AVLLLLCLQLQLGISGGGGGGHGARRGVRPAARXDPCQEVIIIFAAAAAAAAEQAGRQQGRMAVDVVDAVEPVRTPDAAAAAAAAQGLAAMARHAAASSAAVAEHAAPPRRGEEHARPRSIALPPASSSGDAGETSRPEVTDGSATRRGGGGGKTNYVLVAAAGASVLLAASAAAFAACYRSSKVVRSVRPWATGLSGQLQRAFVTGVPALRRAELEAACEDFSNVIGSLPEYTMYKGTLSSGVEIAVVSTTKTSPKDWSKKCEAHFRKXDNEPVVGEPQELCEPSWLLRGGAAVHEDDGVRVRPKRHTIRASPRXRDEGHLDWPTRLRVAVGVAYCLEHMHQLAPPEIVRTLDASTVYLTDDFAAKISDVGFCEEEMAAAAAAPAMADRESVVHGYGMLLLEMMAGRLAASEGGLVQGWAAALLRGERRLRDVMDPALRGAFHAETVDRLDAVVRSCADRDPRRRPSMADVAARLREITAMPPDAATPKVSPLWWAELEIISTEAA

SEQ ID NO: 28267 - protein, 384 aa, Xanthomonas campestris pv. vesicatoria str. 85-10
MNDTATAGFKPKKSVALSGTAAGNTALCTVGRSGNDLHYRGYDILDLATTSEFEEIAYLLVHGKLPNSGELRGYKAKLRSLRGVPAAVKTALEQLPPSAHPMDVMRTGVSVLGCLQPEKDDHNHPGARDIADKLMASLGSMLLYWYHYSHNGKRIEVETDDDSIGGHFLHLLHGFAPKDSWVRAMHTSLILYAEHEFNASTFASRVIAGTGSDMYSAIAGGIGALRGPKHGGANEVAFEVQKRYDAPDEAEADIKARVERKEVVIGFGHPVYTVSDPRNKVIKEVARELSDEQGSRKMYDIAERLESVMWDIKKMFPNLDWFSAVSYHMMGVPTAMFTPLFVLARTAGWSAHIIEQRMDGKIIRPSANYTGPEDQVFVPLDQRS

SEQ ID NO: 28268 - protein, 160 aa, Zea mays
  misc_feature (81)..(81): Xaa can be any naturally occurring amino acid
  unsure (1)..(160): unsure at all Xaa locations
MAAAAAMMVSGGRAALAVAGVLCAVAAMAAAQQASNVRATYHLYNPAQNGWDLNRVSAYCATWDADKPLSWRQKHGWTALXAGPAGQKGQAACGKCIRAIVGLLQVKNRATGASIVARIVDQCSNGGLDLDYETVFKKIDTNGQGYQMGHLNVDYQFVAC

SEQ ID NO: 28269 - protein, 887 aa, Erwinia carotovora subsp. atroseptica SCRI1043
MSDRLNNDVDPIETRDWLQAIESVIREEGVERAQFLIDQVLSEARKGGVSVAAGLAARQYVNTIAVEDEPEYPGDLDLESRIRSAIRWNAIMTVSRASKKDLDLGGHMASFQSSATFYEVCFNHFFRARNAQDGGDLVYFQGHISPGVYARAFLEGRLTEDQMNNFRQEVHGKGLSSYPHPKLMPEFWQFPTVSMGLGPIGSIYQAKFLKYLEHRGLKDTSKQTVYAFLGDGEMDEPESKGAITIATREKLDNLVFVINCNLQRLDGPVTGNGKIINELEGIFSGAGWDVIKVIWGGRWDELLRKDTSGKLIQLMNETVDGDYQTFKSKNGAYVREHFFGKYPETAALVKDWTDDQIWALNRGGHDPKKVYAALKKAQATKGKPTVILAHTIKGYGMGDAAEGKNIAHQVKKINMEGVRYFRDRFNVPVSDENIEKLPYITFDKDSAEYKYLHERRQALEGYLPTRQPNFSEKLELPTLEDFRTLLEEQNKEISTTIAFVRALNVMLKNPSIKDRLVPIIADEARTFGMEGLFRQIGIYSPNGQQYTPQDREQVAYYKEDEKGQILQEGINELGAGSSWLAAATSYSTNDLPMIPFYIYYSMFGFQRIGDLCWAAGDQQARGFLIGGTSGRTTLNGEGLQHEDGHSHIQSLTIPNCISYDPSYAYEVAVIMHDGLNRMYGEAQENIYYYITTLNENYHMPAMPQGAEEGIRKGIYKLETVEGSKGKVQLLGSGSILRHVREAAQILAKDYGIGSDVFSVTSFTELAREGQDCERWNMLHPTETPRVPYVAQVLSDAPAVASTDYMKLFAEQIRNFIPASDYRVLGTDGFGRSDSRENLRHHFEVDASYVVVAALGELAKRGEIDKKVVADAITKFNIDADKVNPRLA

SEQ ID NO: 28270 - protein, 339 aa, Oceanobacillus iheyensis HTE831
MSEQNQQIKLTKRPEGTPTNEHFEIVDIPINNPNDGEVLIKTIYLSVDPYMRGRMSAGKSYVKPFEVDKPMNGTIVGEVVTSESESFSKGDLVRGMLPWQRYNVVSASYVEKIDPSVAPLTAYLSVLGLTGLTAYFGLLDIGQPKEGETVVVSAAAGAVGSSVGQIAKIKGAHVVGIAGTDEKIDYLENQLGFDKAVNYKDADFKQQLKEACPNGVDVYFDNVGGEVTDNVISLLNDFARIPLCGAISTYNLKPGEDHGPSILPKILKTRTTMKGFIVSDYQEQFPEAIKDLAKWVAEDKLSYEVTTVDGFENTPTAFLDLFEGKNKGKQLVKVSEISS

SEQ ID NO: 28271 - protein, 352 aa, Cochliobolus heterostrophus
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAIFPKTNDLALDLLERLLAFNPVKRISVEDALKHPYLEPYHDPDDEPGADPIPEEFFDFDKNKDNLTKEQLKLLIYQEIMR

SEQ ID NO: 28272 - protein, 345 aa, Xylella fastidiosa Ann-1
MEVHFTPVLNTCMAVSLLQHNHLSDTALIASARRVIEIEREALTLLNERIGAPFVAACRLILNSHGRVISTGMGKSGHIARKIAATLASTGTPGFFVHPGEAGHGDLGMITDSDVILALSYSGESDEVRMLLPVLKRQGNPIIAMTGRPQSTLAQAADVHLDVSVTTEACPLDLAPTSSTTTSLVIGDALAVALLDARGFTAEDFARSHPAGHLGRRLLLHITDVMHSGDDLPAVHEEATLSEALLEMTRKRLGMTAIVDNEGRLQGVFTDGDLRRALDSNIDVRNARINEVMTRHPKTINADQLAAEAARLMEANKINGLIVVDPQQRAVGALNIHDLLHAKIV

SEQ ID NO: 28273 - protein, 148 aa, Nostoc punctiforme PCC 73102
MRQILGATKDENFMHIIENIEVLVSKVLSIFMVVVILVAIGDLAVFIFRELLTAPYAKFNTTLYKIFGLFLNILIALEILENITAYLRKHVFQVELVIVTSLIAVARKIIILDLEKVGGVDIIGLGIAILALSISYLIIRLSNDRNTR

SEQ ID NO: 28274 - protein, 452 aa, Erwinia carotovora subsp. atroseptica SCRI1043
MDNQQTDGTLKRGLKNRHIQLIALGGAVGTGLFLGIAQTIKMAGPSVLLGYAIGGLIAFLIMRQLGEMVVEEPVAGSFSHFAYKYWGDFAGFASGWNYWVLYVLVAMAELSAVGIYVQYWWPDIPTWVSAAVFFLLINAINLANVKVYGEMEFWFAIIKVAAIIGMIAFGGWLLISGTGGPEATVTNLWAQGGFFPNGGLGLVMAMAVIMFSFGGLELVGITAAEADDPEKSIPRATNQVIYRILIFYIGSLAILLSLYPWGKVVEGGSPFVMIFHELNSNVVATILNVVVLTAALSVYNSCVYCNSRMLFGLAKQGNGPKVLETIDSRGVPVVAIGISALATALCVLINYLIPGKAFELLMALVVSALVINWAMISLAHLKFRAQKDKEGTVTKFKALLYPLGNYICLLFLAGILVIMFLTPGIQISVMLIPVWLIILGVGYFIKKKNQAK

SEQ ID NO: 28275 - protein, 366 aa, Arabidopsis arenosa
MEKGEDSSTFKMGNSAPGPAQKIIGPCAMSLPYVPDCYVVPPSCEPCDSNSEIVPTIDVSRLKGGDDERRGVIRELSLACQHLGFFQIVNHGINQNILDDALEVARRFFELPAKEKKKFMSNDVYAPVRYSTSLKDGLDKIQFWRIFLKHYAHPLHRWIHLWPENPPGYREKMGKFCEEVKELSIEIMGAITESLGLGRDYLSSRMDENGMQVMTVNCYPPCPDPETALGLPPHSDYSCITILLQNLAGLKIFDPMAHGGSGRWVAVPEVTGVLKVHIGDHVEVLSNGLYKSIVHKVTLNEENTRISLASLHSLGMDDKMSVPCELVTDENPVRYKESSFKDFLDFLVKNDISQGDRFIDTLRIKD

SEQ ID NO: 28276 - protein, 379 aa, Oryza sativa
  misc_feature (336)..(336): Xaa can be any naturally occurring amino acid
  unsure (1)..(379): unsure at all Xaa locations
LLFFFSVLIPVAVSLLFPCAYVLIWHRKGQILCYLLCNKTRSRNESNIQKLIVSYGSLAPKRYKYSEVAKITSFLSNKLGEGGYGVVFKGKLQDGRLVAVKFLHDSKGNGEEFVNEVMSIGRTSHVNIVSLFGFCLEGSKRALIYDYMPNSSLDNYIYSEKPKETLGWEKLYDIAIGIARGLEYLHHGCNTRIVHFDIKPQNILLDQDFCPKIADFGLAKLCCTKESKLSMTGARGTIGFIAPEVLYRSFGVVSIKSDVYSYGMMLLEMIGGRKNVKSMVQNSSEKYFPDWIYDHFYQGDGLQACEVTSEVEGIAKKMTLIGLWCVQVLPMHRPTXQVLDMFEKALDELDMPPKQSFCETVRHLIIFPLFCAVWYKHSP

SEQ ID NO: 28277 - protein, 292 aa, Xanthomonas axonopodis pv. citri str. 306
MSEDDSSQSLETPEKRRSWLERLSAAFSGEPHTRDELVALLRTAEQDGLIAADTLRMMEGAISVSELTVGDVMISRSQMVSLPVEARFIDLMKQVVESGHSRFPVHGENKDEVLGILLAKDLLRGVVADNGPGNVRELLRPAVLIPESKKLNVLLKEFRLSRNHMAIVVDEYGGVAGLVTIEDVLEQIVGEIDDEHDDAEEENSLIAIQADGRYVVDALTPIEDFNERFGAEFPDDEYDTVGGLVTDAIGHLPETGEELTLGRFAFRVAKADARRVHAFHVTILPPDPQDDA

SEQ ID NO: 28278 - protein, 277 aa, Triticum aestivum
  misc_feature (64)..(64): Xaa can be any naturally occurring amino acid
  misc_feature (72)..(72): Xaa can be any naturally occurring amino acid
  misc_feature (232)..(232): Xaa can be any naturally occurring amino acid
  unsure (1)..(277): unsure at all Xaa locations
HYRTSLYKKAGWYRSGIPGISSTHASAAVSVLLGFAPPAMLPAPSSAKVNKLLLPNPFDRPRSXARMQLDSXGSHHYVDCFISDAGSIYKTKIDGAKSAAIELTDKDELIVIRSDESSGLDVLDNELANLATWLAGSYQKADSKLNIPLKSGNSLTLFLTKEADVEFASSLISLLKTIKRGIQGHEDFSGGIVSHAELLVCHFTGIKALEDEYGPAEIAKQGAEVVQTALTXAFDQLQGAYNGKIVGLVISAKEASTYLASIIDAPSSLHISRRLAE

SEQ ID NO: 28279 - protein, 393 aa, Oryza sativa (japonica cultivar-group)
MTPLHAAPHHAAAAAAVVSSPSSAPLLLRAKPYHPKAAACSFTVTATTPSRKAFLSCPDHGQAAAGAAPPRSAPASSPALISSVQDLYDFICSGPLVDRIGYTKEKIAGSIDRWLRCGVQVARLFRLNELHLSEAEKARIYHFYIPVFLWCEDQVTEHRAKYKDGDEIPPLVIGVSAPQGSGKTTLVFALDYLFRVAGRNAATLSIDDFYLTAAEQGKLRERNPGNALLELRGNAGSHDLPFSVETLESLLKLTKEGLKMKLPRYDKSAFGGRGDRADPSTWPEVEGPLELEVVNKNLEAYYDAWDRFIGSWMVIKIKEPSCVYQWRLQAEIAMRADGKPGMSDEEVMDFVSRYLPAYHAYLPTLYKEGPNGSNPDHLLVVDIDEKRNPMWGR

SEQ ID NO: 28280 - protein, 231 aa, Arabidopsis thaliana
MGETATDSEHRMMIGLSDPMKIDPRRDRFPCCIVWTPLPFISWLVPFIGHVGICREDGVILDFAGPNFVCVDNFAFGAVSRYIQINKEMESSRSSSSGMFNGERRYEQEEDSHEKEPTWDDALRKSTQEYQHHSYNILTCNCHSFVANNLNRLSIKSGGWNVVNLATLVLFKGRWVNKTAIVKSLLPPLIVYTIGILLGGWTFIASCSILVVLLTGWFIIGTYCFKKLIQL

SEQ ID NO: 28281 - protein, 181 aa, Zea mays
MAYSMLSSAAVVTSPAQATMVAPFTGLKSSSAFPVTRKANNDITSIVSNGGRVSCMQVWPPIGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 28282 - protein, 401 aa, Prochlorococcus marinus str. NATL2A
MSKRSLSSLGAEDLCGKRVLVRVDFNVPLGDEGLITDDTRIRAALPTINDLLDKSARVILSAHFGRPKGQVNETMRLTAVAQRLSELLGKTVVKTESCIGAEAKSKVDAMSNGDVVLLENVRFISGEEKNDTEFAKELASLAEVYVNDAFGAAHRAHASTEGVTKFLSPCVAGYLMEKELKYLQGAIDQPQSPLAAIVGGSKVSSKIGVLESLIDKCDKIIVGGGMIFTFYKARGLSVGNSLVEEDKLELASALEKKAQEKGVEFLLPTDVVLADNFSPDANSKLSKVDAISEGWMGLDIGSESVELFQNALKDCKTVIWNGPMGVFEFEKFANGTNAIANTLAELSAQGCCTIIGGGDSVAAVEKAGLAKKMSHISTGGGASLELLEGKVLPGVSALDDA

SEQ ID NO: 28283 - protein, 337 aa, Oryza sativa (japonica cultivar-group)
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKAAAHLKGGAKKVVISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIFDAKAGIALNDNFVKLVAWYDNEWGYSNRVIDLIRHMAKTQ

SEQ ID NO: 28284 - protein, 664 aa, marine gamma proteobacterium HTCC2207
MASRRELANAVRALSMDAVQQANSGHPGAPMGMADIAEVLWNDHLSHNPADPTWVNRDRFVLSNGHGSMLLYSLLHLSGYDLPIEEIKNFRQLHSKTPGHPEYGYAPGVETTTGPLGQGISNAAGMALAEKVLAAQFNRPGHDIVDHQTYTFLGDGCLMEGISHEVCSLAGTLKLGKLTAFYDDNGISIDGEVEGWFSDDTPARFESYGWHVIPNVDGHDSDAIKAAIEEAHAETGKPTLICCKTIIGFGSPNKQGKEDCHGAALGVDEVALTREALGWTHGPFEIPDEHYAGWNGVAKGTAAQTTWASQLEEYRAEFPELAAEFERRTRGDLPEDFNAQADAYIQQCQDKMEKVASRKASQNCLNTYGPMLPELLGGSADLAGSNLTIWSGSKDISGDNADGNYIYYGVREFGMSAMMNGIALHGGFVNYGATFLMFMEYARNAVRMSALMGLQSIFVYTHDSIGLGEDGPTHQPVEQLSALRSTPNLHTWRPCDTVESAVCWKSAIVRGDGPSALVFSRQGLAPMPRSTQQVADIARGGYILRDCDAPQAIVIATGSEVELAMVAAEQLAEQGTQVRVVSMPCAEIFSAQDADYREAVLPAAVRARVAVEALHADYWYKFVGLDGRVVGMTSFGESAPGGELMKEFGFTVENVVNNIVEAIG

SEQ ID NO: 28285 - protein, 261 aa, Arabidopsis thaliana
MKLPFLNKNHSTSSYSSNSSSSSWPWPSCNQNPKTLSFRATITFTNPIHDQDDGELDLLDPPEITDSVENVIKGLRSSERLIFESKGETNSILEEATSKREEEDEEEGFMLFSLESDDPYSDFKRSMEEMVEAHALHHDWKSLEKLLLQFLKVNAKTSHRYIFAAFVDLLMNLALGTKKAIINNDISKDDGVSASRAAAAGEASTSCCNSMTLGESPSFPLSFYTSCSSSSSSDETSSMSVRFLPLSSLLEMDEKTKEILV

SEQ ID NO: 28286 - protein, 615 aa, Ustilago maydis 521
MTQRLEQQVGAAEAMSKATAAPDTHTHTHTHTHTHTNALKRVLEPEPETAPPTTAACSTGNNGEPAKEASTSKRARFDNAINKDGKNKWERRDRRGTGRAQDNESPSTCEASASTDRLPKRKVAVKFGYCGIGYSGLQINPGVKTIEGDIFDAFCTAGAVSSDNAVNPNKVGLQRAARTDRGVHAAGNLLSLKLILQPQGLKPGETLVDKVNELLPPFIRIWGVTRVQNGFNARQSCDSRMYEYLLPTYVFIPPKPGSTMHDMLVRIRQQELARLSESEAHVSTTCLDEIIDHPFWKSHGTTSEFSVDMAAKKQYRLTPAHLAKIRSIFNRFLGSHNFYNFTVGKEFRDRSCQRFMKKLTISEPKMIQGVEWLSIKFHGQSFMLHQIRKMIGLLVLIGRTGAAERLVDECFGPARVHIPKAPGLGLLLEMPIFDAYNTRIRNNNDKITKLIKKKTRAVNTHPEDASQTGNAACTLSDELRDAITYNDHTSQMQHFKQQWIYDRIIATEQETNEFGKWLNYLDVFQGPDFEFLNPRGVIPSQAIVKVGEFHRHHSIKRRPDSMLHTPPIPDTENPSQSHNHNHNHNDDDDDNHNDNDDEDAEAYAKKGAELDEYEG

SEQ ID NO: 28287 - protein, 387 aa, marine gamma proteobacterium HTCC2207
MTVKLMTELDLASKRVLIREDLNVPIKEGQVTSDARIQAALPTIQQAIQAGAKVILMSHLGRPTEGEYNPDFSMEPVAKHLSGLLGQPVRLEQSWTNGIEMNDGEIVILENVRFNPGEKKNDDTLAKAYAKLCDIFVMDAFGTAHRAQASTHGVSKYAPVACAGPLLENELNALEKALAAPTPPVAAIVGGSKVSTKLMVLETLSDRVDQLIVGGGIANTFLAAAGKPVGKSLFELDLIPAAQALMKKVNIPLPTDVVVGKAFSETTEATIKSVDDVEEDDMIFDIGPDSSAKLAELLQLMGTIIWNGPVGVFEFDQFGEGTKTLSLAIAKSSAFSIAGGGDTLAAVDKYDIADQVSYISTGGGAFLEYVEGKELPAVTILQQRAKD

SEQ ID NO: 28288 - protein, 274 aa, Kluyveromyces lactis NRRL Y-1140
MYRVFDKLASRPFVSLPGIQLIAKMPLSDLNKLPPLADQLEQAKRIAAYRAVDENFDAKTHKVVGVGSGTTVVYVAERLGEYMDEKTNFVCIPTGFQSKQLILSNKLQLGVIEQFPEVDIAFDGADEVDAGLQLIKGGGACLFQEKLVSTSAKKFIVVADSRKKSPKYLGTNWKKGVPIEVVPSSYVRVLSDLKNKLNCKSAMVRQGGSAKAGPVVTDNCNFIIDADFGEITDPRKLHQDIKLLVGVVETGLFIDNAEKAYFGYPDGSVDLQEL

SEQ ID NO: 28289 - protein, 141 aa, Pseudomonas putida KT2440
MAVQRTFSIIKPDAVAKNVIGKITTRFEEAGLKIVASKMKQLSKAEAEGFYAEHSERGFFGDLVAFMTSGPVVVQVLEGENAIAKNRELMGATNPKEAAAGTIRADFAESIDANAVHGSDSEAAAAREIAYFFAATEVTTR

SEQ ID NO: 28290 - protein, 381 aa, Pseudomonas putida KT2440
MTTSTGKINLLGLTQPEMEQFFDSIGEKRFRAGQVMKWIHHFGVSDFAAMTNVGKVLREKLEAVAEIRPPEVVSEDISADGTRKWVIRVASGSCVETVYIPTDDRGTLCVSSQAGCALDCSFCSTGKQGFNSNLTAAEVIGQVWLANKSFGTVPAKVDRAITNVVMMGMGEPLLNFDNVIAAMKIMMDDLGYGISKRRVTLSTSGVVPMIDELAKHIDVSLALSLHAPNDELRNKLVPINKKYPLKVLLESCMGYMSTLGGKRVLTVEYTLLKDVNDQPEHAAQMIELLRDVPCKINLIPFNPFPHSGYERPSNNAIRRFQDLLHHGGFNVTTRTTRGDDIDAACGQLVGQVNDRTRRSERYIAVRQLSADVELPDSAASH

SEQ ID NO: 28291 - protein, 492 aa, Oceanospirillum sp. MED92
MVFPYKKQKMMGDRFMHNLQKFYVDGQWVEPQGAEILDVLNPANDQVVSQIRLGNRDDVETAVAAAVNAFPAFSQTTKEERIALLERIIEGYSARLEDLARATTEEMGAPIGFSRQMQVMAGLGHIKVALSILKKTDFTEVMGTTTVVKEPVGVCAMITPWNWPLNQITCKVAPAIAAGCTMVLKPSEVAPRTAHIFAEILHEAGVPKGVFNLVDGDGPTVGAALSEHPQIDMVSFTGSTEAGKKVSIAAAGNLKKVSLELGGKSANIILDDADFAKVIKRSVRGVMTNTGQSCNAQTRLLVPEDRLAETIEIAKASAESVRTGDPMAEDTAMGPVVSKLQWQRVQALIQKGIDEGAELIAGGVGSPEGLETGCFVKPTVFAGVTPEMSIAREEIFGPVVSIMTYKDEDDAVAIANNHIYGLSGGVYSADLERANAVAARMRTGMVHINGAPADAKAPFGGYRQSGTGREWGRYGMEEFMETKSMMGSIPKA

SEQ ID NO: 28292 - protein, 443 aa, Zea mays
  misc_feature (358)..(358): Xaa can be any naturally occurring amino acid
  unsure (1)..(443): unsure at all Xaa locations
MPFPSRHQRLASLTKLLTAHVNAGRHRDALGLFSRMLSTPDLPPLTDPSFAHAFPLALKSATALRVPGVAASFHALAAKCGLLSSPFLASALVASYGARVVGGACGASYELTRRLFDELPARNAIVWSAMISVHVRAGDLAAAAWALDHMDVPPTASCFNTVIAAVAESREHPARAIEVYRHMRRVGVPPSFITLLALVPACTVVGALTSIKEVHGFALRHGMSTRSHIGSSLIEAYGRCGSLAAAQRVFDQVHDRDVVVWSSLVSAYAFHGRAEVAMSLFQHMEDQDDVRPDSIMFLSLMAACAHSGHADDALQYFDVLTRRYGVEACGDHYSCMVDVLGRAGRLHQAYELLRTMPXKVTAKAWGALLAACRKHGDVRLAEVAGRALFEIEPENAGNFVSLANIYSGRGMHEDAERVRREMEQRGVQRLPGSSWMIHHKPSS

SEQ ID NO: 28293 - protein, 458 aa, Arabidopsis arenosa
MEFTEAYKQTGPCCFSPNSRYVAVANDYRLVIRDTFSFQVVQLFSCLDKISYIEWALDSEYILCGLYKKPMIQAWSLTQPEWTCKIDEGPAGISYARWSPDSRHILTTSEFQLRLTVWSLLNTACVHVQWPKHGSKGVSFNQDGKFAAICTRRDCKDYVNLLSCQSWEIMGSFAVDTLDLADLEWSPDDSSIVVWDSPLEYKVLIYSPDGRCLFKYQAYECGLGVKTVSWSPCGQFLAIGSYDQMLRVLNHLTWKTFAEFLHLSTVRAPCSAAIFKEIDEPLQLDMSELSLDENFMPSNYDASEGYISVRYEVMELPVAFPFQKPPADKPNPKQGVGLLAWSKDSQYICTRNDSMPTALWIWDMRRLEVAAILVQKEPIRAAVWDPTCTRLLLCTGSSHLYMWTPSGAFCVCNPLPGFSISDLKWNIDGSCLLLKDKDAFCCATVPSLPESSDYSSDD

SEQ ID NO: 28294 - protein, 565 aa, Vibrio angustum S14
MNNNDRQILIERFGAKAPNHEIIGCESFEVKKEHLIDTLHFLKNEASSQFEMLFDLSAIDECERGGGLSVFYYLLSVKNKAFISIRTHIANDTIEVPTVVGLWPNANWYEREVYDMFGIKFTDHPDLRRILTFDFWKGHPLRKSYPCRATLMDEPFDLEGPDFDDVMKSYDIQGKQDDGSMVLNIGPNHPGTDGVIRLKVKMKGEFIEDLDQEIGFHHRGAEKIAERHTFHNYIPYTDRIDYLGGVAGELPYLLGLEAMTGIEVPERAKTMRIMLCELFRISSHLVWFGSITHNLGGMAPAFYAFTEREKIFDVIELICGGRMHPAFFRIGGVSQDLPDGWEEKVEHACQGIEQLVPDLEKLMTNSMIFKVRTQNIAVYSQSMALDWGLTGPNLRATGINFDMRKDFPYMGYEDYDFDVPVGQDGDAYTRTVLRVQEVVESLKIIRQAAARMPEGPILADNAPNFGFPRKQNALRDIETLIHSFVDTGRGFNFPVAETFYATETAKGVTSYHTISNGTGCPYRVRIRTPSFTHFQSVKAVSKGDLLSNIICLIGSIDYVLADIDR

SEQ ID NO: 28295 - protein, 573 aa, Cryptococcus neoformans var. neoformans B-3501A
MSSSNSTVRVALRGGAILNNPRFNKGSAFTHQERSEFALRGRLPYAVDSLEIQVKRAYEQYKSRETNILKNSFLQSMKAQNWTLFYALLQAHLVEMFPIVYTPTEADAIADYSHLFRRSEGLYLTPPGEKNMEEDFLDACEGRELELIVVSDGEAILGIGDQGSGGIGISGAKAVIYSLIAGVDPAKCLAITLDVGTNNQDLLNDPLYIGYREKRLRDDPYDQFVDKFVGLVKKHQPECLLHFEDFGVTNAERLLRRYRDQHSIFNDDIQGTGAVTLAAVQAAISVTKSSLKDQRIVIYGSGSAGLGIARQLRDAIALDSSGSPSEAAKQFWLIDKHGLIKKSLGKDKIRSEIEDEFIRDEGDWGEGETGLKEVVKKIKPTILVGTSTQAGAFTEEVVKEMSKHVDRPIIFPLSNPTRLCEAQPKDVSEWSKGKALMSTGSPFDPVDISDSGEKYIVAECNNALIYPGLGLGSILAKSSKMTDKMIIAGAQRLGQLAPALVKKNANKSLLPDFGDAQKVNFEVALAVLEQAMEDGVARAKDIPEDKDERRKWAENNRWSPGYPNFKYDPEGLK

SEQ ID NO: 28296 - protein, 631 aa, Oryza sativa
MEVRRRAPLPPPPGRVQAGDALPLPIRHTNLIFSALFAASLAYLMRRWREKIRSSTPLHVVGLAEMLAIFGLVASLIYLLSFFGIAFVQSIVSSSDDEEEDFLVGPARGSSAAAAVAPRAPSSPAQCSLLGSPHDDAARERMPEEDEEIVSSVVAGKVPSYVLETKLGDCRRAAGIRREAVRRITGRQIEGLPLDGFDYASILGQCCELPVGYVQLPVGIAGPLLLDGQRFYVPMATTEGCLVASTNRGCKAIAESGGAVSVVLRDGMTRAPVARLPTARRAAELKAFLEDSVNFNTLSMVFNRSSRFARLQGVQCAMAGRNLYMRFSCCTGDAMGMNMVSKGEQNVLDYLQDDFPDMDVISISGNFCSDKKPAAVNWIEGRGKSVVCEAVIKEDVVKKVLKTNVQSLVELNVIKNLAGSAVAGALGGFNAHASNIVTAIFIATGQDPAQNVESSHCITMLEAVNDGRDLHISVTMPSIEVGTVGGGTQLASQAACLDLLGVKGANRESPGSNARLLATVVAGGVLAGELSLLSALRAGQLVKSHMKYNRSSKDMSKRSRAHQTKVKDSEVYGDIVMAADADTNSSCSEERAALAAASDPYRYVEKRKPIPDPQDTGLIYGKKKDPTKSDN

SEQ ID NO: 28297 - protein, 177 aa, Vibrio angustum S14
MKVIQILQEVTGAFAATIKHVWAPRDTVCYPEVKPDLPERWRGRIVLTRDPDGDERCVACYLCSSVCPANAITIQGAEREDERRYAETFELDFSRCIFCGMCEEACPTLSIQCTTDFEMGKYSRDKLLYEKEDLLIDGTGKHPDFNYYKQAGVAITGKAIGDGENEKPPIDVYSLLP

SEQ ID NO: 28298 - protein, 83 aa, Arabidopsis thaliana
  misc_feature (2)..(2): Xaa can be any naturally occurring amino acid
  misc_feature (21)..(21): Xaa can be any naturally occurring amino acid
  misc_feature (28)..(28): Xaa can be any naturally occurring amino acid
  misc_feature (32)..(32): Xaa can be any naturally occurring amino acid
  misc_feature (55)..(55): Xaa can be any naturally occurring amino acid
  misc_feature (67)..(67): Xaa can be any naturally occurring amino acid
  misc_feature (69)..(69): Xaa can be any naturally occurring amino acid
  misc_feature (76)..(76): Xaa can be any naturally occurring amino acid
  unsure (1)..(83): unsure at all Xaa locations
MXSSMFSSAVVVTSPVQATMXAPFTGLXSSAXFPVTRKTNKDITSIASNGGRVSXMKVWPPIGKKKXEXSILPPLXLSDVRIG

SEQ ID NO: 28299 - protein, 448 aa, Pseudomonas syringae pv. phaseolicola 1448A
MNMFEASDVPVASQLKLDAHWMPYTANRNFQRDPRMVVAAHGSYLTDDKGRKIYDGLSGLWTCGAGHTRKEIQEAVSRQLGILDYSPGFQFGHPLSFQLAEKITELTPGNLNHVFYTNSGSECADTAVKMVRAYWRLKGQATKTKMIGRARGYHGVNVAGTSLGGVNGNRKMFGQLMDVDHLPHTLLASNAYSKGMPEAGGIALADEMLKLIELHDASNIAAVIVEPMAGSAGVIVPPQGYLKRLREICDQHNILLIFDEVITGFGRTGSMFGADSFGVTPDLMCIAKQITNGAIPMGAVIASSEIYQTFMNQPTPEYAVEFPHGYTYSAHPVACAAGLAALELLQRENLIQQAAEIAPHFESVLHGIKGAKNVVDIRNYGLAGAIQIAPRDGDAIVRPFEAGMRLWKAGFYVRFGGDTLQFGPTFNSQAQDLDRLFDAVGETLNLID

SEQ ID NO: 28300 - protein, 320 aa, Glycine max
MVKISLGGYDDGEGPSNRTHKRRREEDDDDEEEEQQQQRSFEMVDPSIGTQEQEDHAAPPHDGSNSNANGAGTSSRDRSVPIFVSDPDVLDCCICYEPLAAPVFQCENGHIACSTCCVRLSNKCPMCLMPIGYNRCRAIEKVLECIKMSCPNANYGCKETFSYSRKNNHEKECIYLPCSCPLTGCDFVASSKELFLHFSHRHVGLGTRFAYDKFFTVFLSINQRTIVLQEKNDGNLFIVHNNHEHLGNIVRISCIGPKSMAEFQYEVLARHQGNALILQSFTKIVQGQYADAPSSTFLLIPSCLFGSPQLKLDIRIKSHH

SEQ ID NO: 28301 - protein, 103 aa, Volvox carteri
MSGRGKGGKGLGKGGAKRHRKVLRDNIQGITKPAIRRLARRGGVKRISGLIYEETRTVLKNFLENVIRDSVTYTEHARRKTVTAMDVVYALKRQGRTLYGFGG

SEQ ID NO: 28302 - protein, 667 aa, Ustilago maydis 521
MSSSTIPLRSAMALPAPRPSTFNERMAARWATILRVLHRHLYFLGPGIVASVAYADPGNWATDLQAGSEFGYSLLFIVLLTGCFAVFIQILSCRVGVVTNADLARQCRMLILKEDRLGNPTQRHVSRPRLRRWALLYPLYVIAEGAIVATELAELTGSAIALNLLFPALPLWAGILITSVDVIIILFIYKPPPNGSFRLLEALIAALVFTVLACFIVLLVRIKPHWPDVFHGYLPSHHVVQSGALYVSVGILGATVMPHAIILGSHFASIDRLPSLDPPCASDDVQHCADQSRWQLISSSFSRLVRPKSETKTEVLRLTRVVRSLISHRTGTDDIETDSMRQRRRERYKAEDLPPRTLDNIRIHIKHASVDIGMSLVSFAIVINSAILIVAAAAFYYTDNGTGTGTATGQVVVASLYDAFYLLKDRLGSLAAVLFAVALLAAGQSASITVTLAGQLVSEGFINWRTDPFLRRIVTRLVAIVPSLTVSLAVGKDGLDEMLVASQVALSIELPFVLLPLILVTGSKTRMTAQVATERRDACSVRSSVELDAPSVEANDQASAQATACTAQHGRQLERNDSTRASLGVIESLPREQDAPAPDQDNKESQPQQPQASASTRVASLADALDSSQDRSHCFASAWYVQVVAYAIFGVIVVADVYVLVTTFMDI

SEQ ID NO: 28303 - protein, 897 aa, marine gamma proteobacterium HTCC2207
MSHATETRDSCTVKTTCPYCGVGCGVSAEIKNDQLIAVSGDTEHPANLGKLCVKGAALDQTMGNHGRLLQPSIEGHPVSWDRAIEEVACRLNQVREKYGPEAIAFYLSGQLLTEDYYVANKLAKGFIGTGHVDTNSRLCMSSAVAGYKRAFGADAVPCNYEDLEHCELLVLTGSNAAWTHPVLYRRIAAAKQKNPAMRVVVIDPRRTASCDLADLHLAVAPGADAFIFNGLLAFLDRADQLDRHYIEQHTEGFAAALETASAISQAELEQQTGISREELATFYQWFVETEKSITFYSMGINQSATGTDKCNAIINCHLATGRIGKLGAGPFSITGQPNAMGGREVGGLANMLAAHMDYTTENVATVSAFWNSDKVSKKAGLKAVDLFDAVADGSIKAIWIMGTNPVVSMPNADRVKAALEHCETVIVSDCIAETDTTATANILLPAAGWGEKSGTVTNSERRISRQRALVSAAGEARADWWILAQVAKAMGFSDGFNYQSPRDVFVEHAQLSDYQNQGQRLFNIGALSQLSETHYDSLQPIQWPVTTNRPQGTTRLFEDGQFVTPSGRARFIAITPRLPAKRKSQRRYPLALNSGRIRDQWHTMTRTGRAASLLDHTDQPFVAMHPDTAAAADLQNGDLAEVSTPQGVIQVISLIDLGVKPEQLFVPIHWSNQNAHSARVATLFEAIIDPVSGQPESKFSRAALKKIESPCWATLVSRTALDCSEFINWTSAALPRQLGFIYQVAVSAEFNWQHYASKVTGATAYAQFSDAANFDQRLIGYSDQQMEIALFSHRQKPSLPNKAWMQDLLNNRAPENYWRLLSGPDLSLADSGGKLICSCFKVSEEHIISAIETGADSTEQLGKQLQCGTNCGSCIPELSSLIKQVQTSSQFLAKQIG

SEQ ID NO: 28304 - protein, 435 aa, Brassica napus
  misc_feature (39)..(39): Xaa can be any naturally occurring amino acid
  unsure (1)..(435): unsure at all Xaa locations
ELQHYFNPTSDTPFLFTKLQLHYSIHNLRDSTVLYLSLXILETMASSTKTVMIPIAHGTEPLEAVAMITVLRRGGADVTVASVEDKVGVDACHNIKMVADTLLSDITDSIFDLIVLPGGLPGGETLKNCKPLENMVKKQDTDGRLNAAICCAPALALGTWGLLEGKTATGYPVFMEKLAATCATASESRVEIDGRIVTSRGPGTTIEFSITLIEQLFGKDKADEVSSGLLVRPNPGEEFTFTELNQTNWSFEDTPQILVPIAEDSEEIEAIALVDILRRAKANVVIAAVGNSLEVVGSRKAKLVADVLLDEVAEKSFDLIVLPGGLNGAPRLASCEKLVNMLKKQAEANKPYGGICASPVYVFEHHGLLKGKKATTHPVVSDKLSDQSHIEHRVVVDGNVITSRAPGTAMEFSLAIVEKFYGREKAVQLAKATLV

SEQ ID NO: 28305 - protein, 382 aa, Pseudomonas putida KT2440
MIRSKLPNVGTTIFTTMSQLAVQTGALNLSQGFPDFNGPQALLDAVGRHVAAGHNQYSPMTGLPALRQQVAAKVERLYGARVDADQEVTITPGATEAIFCAIQAVVHAGDEVIVFDPCYDSYEPSVELAGGRCVHVQLSDGDFRIDWQKFSDALSPRTRMVILNSPHNPSGALITREDLDQLAALIADRDIYLVSDEVYEHLVYDGVRHASVLAHEQLYSRAFVVSSFGKTYHVTGWKTGYVIAPPALSAELRKVHQYVNFCGVTPLQCALADFMAGHPEHIDELPAFYQAKRDLFCGLLDGSRFNFTRTTGTYFQLVDYSQIRPDLNDVDMSLWLTREHGVATIPVSVFYQQPIPEQRLVRLCFAKREETLRQAAERLCAI

SEQ ID NO: 28306 - protein, 331 aa, Rhodotorula glutinis
MVSSGIVPVINFEPFLSGTPEDKLATAQELLKAAKEVGFLMLCNVDAVVDKATVAEAFKKTQQFFDLPMEVKERLEWECAESNRGYVAEGRERVTQETDPEAIAKLRQQAPDFKETMEIGKDYREGPDDSPFENRWPEAEFPDFKAFMNDFFEKNHQLHLEIMRALALAMGIGESFFDDKVAQQSHNLRLLNYPPIEKAKILNGGNRAGAHSDYGSVTLLWQDGVGGLEVQDKDGVFVPARPVADTVVVNVGDLLQRWSNDVLKSTIHRVVLPADGDPLEMTPRCNSIAFFSNPSLRTVISALPGTGEPKYEPVETEAYLVKRLSETYTKK

SEQ ID NO: 28307 - protein, 708 aa, Oryza sativa
  misc_feature (652)..(652): Xaa can be any naturally occurring amino acid
  unsure (1)..(708): unsure at all Xaa locations
MGCVASKNAVSVTPAADSSGALRERSLPRAPEAAATVVSVTASSLRCSSAAAAGRRSEKKRDEAAVAAAGEEPSEKAVIAAATASRSFRLRSLRRSLEGEQVAAGWPPWLSAVAGEAIQGWIPLKADSFEKLEKMEDGCTYSSVFRARELDTGKIVALKKVRFDNFEPESVRFMAREIQILRRLDHPNVMKLEGLITSRLSCSLYLVFEYMEHDLAGLSSSPDIKFSEAQVKCYMNQLLSGLEHCHSRRIVHRDIKGANLLVNNEGVLKIADFGLANYFDPNKNHPLTSRVVTLWYRPPELLLGSTHYDAAVDLWSAGCVFAEMFRGKPILQGRTEVEQLHKIFKLCGSPADEYWKKSKLPHATIFKPHCPYQSTLQDVFKEMPANALRLLETLLSVEPYKRGTASAALTSEFFKTKPYACDPSSLPKYAPNKEMDAKLREDSHRRKASRGHGPEASRKSRLSRAARETTTVNKQTDGKEESKTKANGTKDNSILDRTKVNGDARLFSDIQPVSVAQVKERSRHVKNDSREEIPFSGPLIVSSSSGFAWAKKPPEDRSFARSRTKSSSRGQFTAELDQDNKMPAKENQNLGLKEQPNRDMHIARANSKVREPHDAAKRAVLKKWSQLGRPDSFDSYDTYHSQNFSNAMYLGXTLSSKNSIKGDHDQGERVEYSGPLLSQSHKVDELLEKHERHIRQVVRKSWFSRGKK

SEQ ID NO: 28308 - protein, 107 aa, Crocosphaera watsonii WH 8501
MTPELKDRIDQLVNNNKILVFMKGAKLMPQCGFSNNVVQVLNSLGVSYETVDVLADEEIRQGIKEYSSWPTIPQVYINGEFIGGADIVYEMYQKGELQQMIEVALAS

SEQ ID NO: 28309 - protein, 335 aa, Fusobacterium nucleatum subsp. vincentii ATCC 49256
MAVKVAINGFGRIGRLALRVMSKNKDFDVVAINDLTDAKTLAHLFKYDSAQGRFDGTIEVTDNGFVVNGDSIKVFAKANPEELPWGDLGIDVVLECTGFFTSKEKAEAHIKAGAKKVVISAPATGDLKTIVYNVNDNVLDGTETVISGASCTTNCLAPMAKVLNDKFGIIEGLMTTIHAYTNDQNTLDAPHKKGDLRRARAAAENIVPNTTGAAKAIGLVIPELKGKLDGAAQRVPVITGSITELVTVLGKDVTVDEVNAAMKAASNESFGYTEEPLVSSDIIGISFGSLFDATQTKVLTVDGKQLVKTVAWYDNEMSYTSQLIRTLKKFVEISK

SEQ ID NO: 28310 - protein, 414 aa, Nostoc punctiforme PCC 73102
MARLDKKELGVRSEQLIPLSLPFSGKLAQEFLSTYGSPLYVYNGDHLRETIECITKAISYRRTQFRFASVTNGNIALLKIFRSFGWGLHANTPGDIYLGLQAGFDPSEIVYSGSNLNRAEMIQVLNWGVTTLNLDSLAQLQLCCKVLPKHREKSIRLGLRLNLPEITGDSRIGVRPEEFGDAIALTREVGLKLSGLHFYRGTGTNATEAFTQVIDAVIATAQLLPDWEYLDFGGGFGYPYHHNKTAFDWEVFGAELSERITHLGRKIDLVIEPGRSAIAGCATLLAQVVSVKWQGEKQIIGVDTTVANLSVPSVHGGYREIFTWKQADNLRSLFTTDICGNTTYSRDYLGKNCQLPALEIGDIVAILDVGAYGYAMSSHFLHRPKPAEVLLENGTHRLIRRREDYSVLLTNQVL

SEQ ID NO: 28311 - protein, 410 aa, Oryza sativa (indica cultivar-group)
MAGGRPLESVLVAPGVKGKKVLAFKRDGLKKNEAVTGLIHDIVASSSARSAFHVLDLAKVVDLYAGWRRALPGVRPFYAVKCNPDTALLGALAALGAGFDCASRAEIEAVLALGVPPAAIVYANPCKPGAHVAFAAEAGVNVTTYDSEEEVAKVKRCHPSCELLLRIKAPDCGGVKVDLGLKYGANPDEVLPLLRAARRAGLGVAGVSFHVGSGASRAAVYRGAIEAARAAFDAAAGLGMPPMRVLDIGGGFVAGAAFGDAAAVINRALGRYFGDLLPTVEVIGEPGRYFAETAFTLAARVIGKRRRGDVREYWIDDGVYGSLNCILLDSYVPRPRPLAGARPGEETHASTVFGPTCDSIDTVVTGYQLPEMSVDDWLVFDDMGAYTTAAGSSFNGFATSAINIYLAYSS

SEQ ID NO: 28312 - protein, 1161 aa, Zea mays
MASGSRATPTRSPSSARPEAPRHAHPQHYTQSTGGSMNRAGGGAETKETVSKGVVRQDVTGQLVVMDKFLNISGDYLAISQTFQSPRSPQFLHQIAAFLFRNQSGRQNKLFDCTLANVDDSSFRLLAFSENSPDLLDLSPHHSVPSLDSSAPPHVSLGADARLLFSPSSAVLLERAFAAREISLLNPIWIHSRVSSKPFYAILHRIDVGVVIDLEPARTEDPALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVFHGDSTGLSTDSLADAGYLGAAALGEAVCGMAVAYITPSDYLFWFRSHTAKEIKWGGAKHHPEDKDDGQRMHPRSSFKAFLEVVKSRSLPWENAEMDAIHSLQLILRDSFRDAAEGTNNSKAIVNGQVQLRELELRGINELSSVAREMVRLIETATVPIFAVDTDGCINGWNAKIAELTGLSVEEAMGKSLVNDLIFKESEATVEKLLSRALRGEEDKNVEIKLKTFGSEQSKGPIFVVVNACSSRDYTQNIVGVCFVGQDVTGQKVVMDKFVNIQGDYKAIVHNPNPLIPPIFASDENTSCSEWNTAMEKLTGWSRGEVVGKFLIGEVFGNCCRLKGPDALTKFMVIIHNAIGGQDYEKFPFSFFDKNGKYVQALLTANTRSKMDGKSIGAFCFLQIASTEIQQAFEIQRQQEKKCYARMKELAYICQEIKNPLSGIRFTNSLLQMTDLNDDQRQFLETSSACEKQMSKIVKDASLQSIEDGSLVLEQSEFSLGDVMNAVVSQAMLLLRERDLQLIRDIPDEIKDASAYGDQCRIQQVLADFLLSMVRSAPSENGWVEIQVRPNVKQNSDGTNTELFIFRFACPGEGLPADVVQDMFSNSQWSTQEGVGLSTCRKILKLMGGEVQYIRESERSFFLIVLEQPQPRPAAGREIV

SEQ ID NO: 28313 - protein, 484 aa, Triticum aestivum
MAAANLLSRSLVPSLTPNPGSQPSRSRAASVSLRRRHGPAAPLRASLSTASPSTRVAMGEAPKHCFQRGADGHLYCEGVRVEDTMAAADRTPFYLYSKPQVVRNFTAYDKALQGLRSIVGYAVKANNNLSVLQLLRGLGCGAVLVSGNELRLALRAGFDPTRCIFNGNGKTLEDLVLAAESGVFVNIDSEFDLENIVTAARVAGRQVPVLLRINPDVDPQVHPYVATGNKTSKFGIRNEKLQWFLDSIKSYSNDIKLVGVHCHLGSTITKVDIFRDAANLMVNFVDEIRAQGFELEYLNIGGGLGIDYHHTGAVLPTPMDLINTVRELVLSRDLTLIIEPGRSLIANTCCFVNKVTGVKSNGTKNFIVVDGSMAELIRPSLYGAYQHIELVSPSPGAEVATFDIVGPVCESADFLGKDRELPTPDKGAGLVVHDAGAYCMSMASTYNLKMRPAEYWVEDDGSIVKIRHGETFDDYMKFFDGLPA

SEQ ID NO: 28314 - protein, 841 aa, marine gamma proteobacterium HTCC2207
MLKVVVVGNGMVGHHYVEQLVASDVEAQITVIGGETRPAYDRVHLSEFFAGRSPEDLALTTRDHYRELGVEAHFGDMVASIDRDTKTLTTESGKQFAYDKLVLATGSYPFVPPVKGNDLEPCTVYRTIDDLGTIQAQATGGKIGVVVGGGLLGLECANAVKNLGLETHVVEFAPGLMGVQLDGGGSAMLRRKIEALGVTVHTSKATKVIEPDAEGEARLRMQFADGSSLATDMIVFSAGIRPYDQLAKDCGLTVGERGGIEIDYHCKTSDSDIFAIGECALFGGRIYGLVAPGYRMAEAAVSQLTNEVVPFQGADMSTKLKLLGVDVGSIGDAHGKEAGSVAYTFSDERIDVYKRLIVSADGKKLLGAVLVGDCSDYDTLLQYFLNGIALPADPQTLILPYNAGAAPALGAAALPATATICSCHNVSKGDIVNAMDAGFCSLAEVKSETAASSGCGGCAALLKSVVDDELASRGLEVNKAMCEHFNLTRQEMFHIVKVESIKSFEELISKHGSGRGCDICKPTAGSILASLWNDYVLEEKHVGLQDTNDTFLANMQKNGTYSVVPRIAGGEITPDKLITIGQVAKKYNLYTKITGGQRIDLFGARVQHLPGIWEELIAAGFETGHAYGKALRTVKSCVGSTWCRYGVQDSVAMALYIENRYKGLRSPHKLKSAVSGCTRECAEAQSKDFGVIATENGWNLFVGGNGGMKPRHADLFATDLDDETLIKYIDRFLMFYVRTADRLQRTSVWMGTLEGGLDYLKQVVIEDSLGIAGELEEQMESIVGSYQCEWKTTVEDPEKLKRFRQFVNSKAEDREIIFVEERGQPRPATDAERKQLLAESA

SEQ ID NO: 28315 - protein, 437 aa, Zea mays
  misc_feature (67)..(67): Xaa can be any naturally occurring amino acid
  misc_feature (118)..(118): Xaa can be any naturally occurring amino acid
  misc_feature (146)..(146): Xaa can be any naturally occurring amino acid
  misc_feature (171)..(171): Xaa can be any naturally occurring amino acid
  misc_feature (188)..(188): Xaa can be any naturally occurring amino acid
  misc_feature (210)..(210): Xaa can be any naturally occurring amino acid
  misc_feature (222)..(222): Xaa can be any naturally occurring amino acid
  unsure (1)..(437): unsure at all Xaa locations
MDADAGLLSATPAPLPIEASPPHPAAAAQAPRDLEASPTSSRSVTQTVNGSHRFVIQGYSLAKGMGXGKHIASETFSVGGYQWAVYFYARTGRTPKDQLPATVSVFIALASDGTDVRXLFELTLLRLRAGRAKHKVHCTQLDRSLXSGPYTLQYRGSMWGYKSFFRRNALXNENFSKMIELILNVLCXSVVSTMDYSMPHSIDVPESDIXYHFGTLLDTQEXGVDVIFSVAGEKFHAHKLVLAARSPFFRSEFFDHELGEEKNGTDTGDEIKEIVIDDMDPVVFKAVLHFIYRDNLVNDDELSASSSDCSIFDSLSGKLMAAADKYELPRLRLLCESYLCKHISVNSVATTLALADRHHAMELKSVCLKFAAENLSAVIRTEGFDYLKDNCPSLQSEILRTVAGCEEPCSSGLKSQSVWAQLSDGGDTSGRRVRPRV

SEQ ID NO: 28316 - protein, 310 aa, Oryza sativa (japonica cultivar-group)
MLAPARALPLHLVARLRLDLGLAPDFPRSLLPNYPDYFALSRDGALLELVCYRKDLAVSAMQSYAQRTGGYKVGDAVPFPLSFPRGFELDKKVRKWLDDWQRLPYISPYEDGSHLTPRSDITEKRTAAVLHEVLSLTVGKKMEKEVLVKLGEALRLPPGFRKVLARHPGIFYLSHKLRTQTVVLRESFRRHMLVDKHPMMGIRYQYLHLMHMGQEEAGKRKGKGRKTVRGEQMIGEEFGAEGENDDEEDEEYDDDEEEDMEAGVASGDEDSDDDDDDEEGEKEDMEAGVASRDEDSDDEDADDTDHAAKG

SEQ ID NO: 28317 - protein, 647 aa, Oryza sativa
MHGGGARALAAAFVLALLAAAPAASEVVCSGRRYAANSSFDASLQQVARTLPGNASSSPLLFATLAVAGEAYALALCQGGTSAGSCNYCVAQTMRDGEHACAGDADVAMYDDICTVRFSDRDFLAATTNSPEKLVVAGSQSQKLVPSAAGRFYRLVGELLDATADYAVANSTARFATGDVGVGGYFDGEPFSKIYALAQCTPDLTPAQCRACLASAMEEMTRQVFAASSPGGKVIGERCGLRFEVFSFYTVDAMVHHEVAMEGKKKSTPVLAIVLPIVFAGLLTIIIVSFYIWRKKRLPTKTPLIENTEDLEDFESIFIDLSTLQSATSNFDESNRLGEGGFGVVFKGVFPDGQEVAVKRLSNCSNQGLGQLKNELSLVAKLQHKNLVRLIGVCLEEGEKVLVYEYMPNKSLDTVLFDPEKSKQLDWGKRYNILYGIARGLQYLHEHSQLKIIHRDLKASNILLDSDMKPKIADFGMAKIFGDDQTRNATSRVVGTLGYMSPEYAMRGQYSTKLDVFSFGVLVLEIVTGRRNSYAVVSEHCEDLFSLVWRHWNEGTVTEIVDPSLGNHYPRGDILKCINIGLLCVQQNPVDRPPMSAIILMLSSGTVTLQAPYRPAYIFGRNRSYTETMDVPLPSGPHSSITELEPR

SEQ ID NO: 28318 - protein, 143 aa, Glycine max
  misc_feature (135)..(135): Xaa can be any naturally occurring amino acid
  unsure (1)..(143): unsure at all Xaa locations
MAPAVMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVSNEVKEXKKEYPGTP

SEQ ID NO: 28319 - protein, 254 aa, Arabidopsis thaliana
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIDIIKAAEVNKSA

SEQ ID NO: 28320 - protein, 196 aa, Cryptococcus neoformans var. grubii
MQTIKCVVVGDGAVGKTCLLISYTTNKFPSEYVPTVFDNYAVTVMIGDSPYTLGLFDTAGQEDYDRLRPLSYPQTDVFLICFSIASPASFENVREKWFHEISHHCPGAPCLIVGTQVDLRDDPKQVERMMASQRGGRAAGLITQEQGERLARELGGRKYVECSALTQKGLKNVFDEAIVAALEPPVVKKTKKCLIL

SEQ ID NO: 28321 - protein, 193 aa, Cryptococcus neoformans var. grubii
MQTIKCVVVGDGAVGKTCLLISYTTNKFPSEYVPTVFDNYAVSVTIGDDPYTLGLFDTAGQEDYDRLRPLSYPQTDVFLVCFSVTSPASFENVREKWFPEIAHHCPGVPALIVGTQVDLRDDPAQMEKLGRQKMKPITQDMGERLARELGAVKYVECSALTQRGLKNVFDEAIVAALEPPMATKKKSKKCLIL

SEQ ID NO: 28322 - protein, 419 aa, Bradyrhizobium sp. BTAi1
MTVYAGPVFEMAANQFNVIADHLGIPADERDRLLLPKRAITVSCPIHKDDGTIAVYEGYRVQHLLTMGPTKGGTRFAPTVDIGEVAALAIWMSWKCALVGLPYGGAKGGVTVDLSKLSRRELESLSRRYMQEMIPFVGPHTDVMAPDMGTNEQVMAWFMDTYSMYQGQTVTEIVTGKPVFSGGTLGRREATGRGVAHVSRRVMDVLGIDPAKSTVVVQGFGNVGSYAALGFHQMGMKVIAVSDHTGALHDARGLDIPALMAHASKHGSIAGFSTELAFDPKEILTLACDILVPAAVERVIDAKVAANLKCRVIAEAANGPTTPDADLVLDQRRKEIFLIPDILCNSGGVIVSYFEWVQDLQQLFWEEEEVMRREYQILDRAFERMVTRAKADDISHRTAAMAIGVEKVRNAKNTRGLFP

SEQ ID NO: 28323 - protein, 159 aa, Magnetospirillum magnetotacticum MS-1
MTGAGTFYVTTPIYYVNDKPHIGHAYTTLACDVLARFKRLDGFDVKFLTGTDEHGQKVEKSAEAFGVTPKALADQNSANFRELAKILGCTNDDFIRTTEERHKVACQALWDKLLAKGDIYLGAYEGWYSVRDEAFYAEDELVKGEGGSKLAPTARPWHG

SEQ ID NO: 28324 - protein, 208 aa, Brassica napus
MEPLQKNFSDMTISGGVTGSTSTLHRNSLPIPDEVIAEIFSRLSSESIARCRCVCKLWSSILAHQDFTESFLTKSRAHPQLLFACDACTGVFFFSSAQPENPKENSFVVASNHLARFSISDELCGCTNGFFLYVSKMIWIENELQLYVPLMCNPSTGQFLTLPKLKSGKSCGVQSYLGYEPVANELKGIFNGGVACKRWFNLSGAPSS

SEQ ID NO: 28325 - protein, 516 aa, Clostridium perfringens ATCC 13124
MNTLNDILSKEIEEFREKGHKFLNKEMTVGEFKKASGGMGVYAHRGGKEFMVRLRVPSGVAGLSLLEEAYNWAKKYNLEKIHLTTREAIQLHGISIDAVCDIMQEGLTKGIYTRGGGGNFPRNVALNPLSGVQIGETFDVTPYALASNAHYMSKIYTYNLPRKIKTAFSNTEEDSAHCTVTDLGFLAVDNNGKRAFKLYIGGGLGRNPRTSVEFDELIDEKDVLYCLEAMTNLFVAEGDYKNHGKARIRYIVERMGEEEFKNCFRKHLEEVKAKGGLDLKVEDIKYSKKGEKTNIKHERLIPQKQEGLYTVLFHPVGGQLSLDVLKELIEKIEKIEEVEVRLGMDENLYVRNLNGKEAEAILDFTQGKGGETLAERSVSCIGTPICQMGVLESQKTLREFVELLKENSIKEGTLPRVRFSGCPNSCGMHEIGDIGFAGKKKKVCDALSNVFELHFGGKLGIGETRLGDYYGDILQDKVPEFLIKVAKAVEAKNSTFEEWIKDNSEEFKAIVEEYNV

SEQ ID NO: 28326 - protein, 442 aa, Bdellovibrio bacteriovorus HD100
MTLTDFCRNGRQILHKLEYQDTLRVVPYLLASLVAAGTSLLYSQAFFFGEEVALHAVEHFHWALSLSITLSMIYLSWYLPYRFAKQAGGSGIPQMLIANELDPASDKPLIRSLIGIRTITMKIIASIACVLGGGAVGQEGPTLQIASGLFYRIGEKSTKWIQQVSMRSFILAGGASGLAAAFNTPLGGIAYALEELSKDYFNNFKTYVIWSVIATGLIVQTVQGSYLYIGFPSLESISWETYMWVIVTSAITGILGASFGSVLFSVHQKRKSIQSFTRLSLLNLACGFLFWLGITFISNHGIGGGKMLILDLLFRDGSATAQDILVRIGGPLLMAIAGAAGGLFAPSLTIGAVMGSFMAQIVWPHNHHLLIMTSMISFLSGFMQTPFTAFILIFEMTDRHSALFPMMLSSAIAVGTSRIFHKKSFYDLVKEDFLHQHKKTAK

SEQ ID NO: 28327 - protein, 768 aa, Cryptococcus neoformans var. neoformans JEC21
MSDATLFLRKNKDKQRRRNVSGASRIASTSNSSLASRPGASKGQPVAGPSSSGAPSSAAPSPSSVSIKPEPDSSNNPNITEIKIFSTGSNSALRYNLMRLNSVKDVDPTQITAPVLMNRKKPGPKDPPTFALDENGKIVGRYVYDEEGKPILDEEGQPVVERKEVVDMSLVGQAPGGGRKKRVKRGTKEVFHQDIEIMRLRREEALPWVLESGNPQDKPAQPEQWVGRMLEQGQLSTVLLSNDGTRDGFEMMPLGRSYKFEPARPFKPLDSDAANKLFELQAKNKIHDRWAFRPADNQSGEASSASTPIQVKAEPNELEQRASRMETRIKMHKGVTVDRKAKVERYEDDYQREGHRVERGMEGGVDEELDFDEAEEFQDDDDNNTFYRDAQEEEEARELEERLKKEFRVANANVGDRPQIDAEDDEDDLFGDKSLDDEGKKLRKIMRRRMRENGEDYDIDDDSDSDSDDESTTSTQNKEKEKEKDKEKEKAKEKDSSRNPSQPPSRPSSRPPTARTSSPSGSNPRYPSPKKGKASTAPPPVSGASLIAQRATSRGASPRPSTHGGHVAGRASSPLGRVPSPAEGRGPGVTGQSQPASRATSPAVRESSPASGGAAATGGASPASGGPSTRDVSPAPPAGRPSPRKENAAVSTSSSSAKRKSSPSVSTPSADAPPRPKKHKKTGSLTPAPAPEDIPPFSGMITKQDVLGWFQRNKKKAVPMNEAIGAFRKRIVDAGPNRDANQKLFLGWIRMVADQENGNLSLKPEFRQ

SEQ ID NO: 28328 - protein, 108 aa, Lactobacillus delbrueckii subsp. lactis
  misc_feature (89)..(89): Xaa can be any naturally occurring amino acid
  misc_feature (92)..(92): Xaa can be any naturally occurring amino acid
  unsure (1)..(108): unsure at all Xaa locations
DAKFLAQGTLYTDVIESGTDTAHTIKSHHNVGGLPEDMQFKLIEPLRQLFKDEVRVLGEKLGLPHDLVWRQPFPGPGLAIRVIGEITEXKLXIVRDADAILREEVKNA

SEQ ID NO: 28329 - protein, 418 aa, Archaeoglobus fulgidus DSM 4304
MKLDKSRKLYAEALNLMPGGVSSPVRAFKPHPFYTARGKGSKIYDVDGNAYIDYCMAYGPLVLGHANEVVKNALAEQLERGWLYGTPIELEIEYAKLIQKYFPSMEMLRFVNTGSEATMAALRVARGFTGRDKIVKVEGSFHGAHDAVLVKAGSGATTHGIPNSAGVPADFVKNTLQVPFNDIEALSEILEKNEVAALILEPVMGNSSLILPEKDYLKEVRKVTAENDVLLIFDEVITGFRVSMGGAQEYYGVKPDLTTLGKIAGGGLPIGIFGGRKEIMERVAPSGDVYQAGTFSGNPLSLTAGYATVKFMEENGVIEKVNSLTEKLVSGIADVLEDKKAECEVGSLASMFCIYFGPTPRNYAEALQLNKERFMEFFWRMLENGVFLPPSQYETCFVSFAHTEEDVEKTVEAVSESL

SEQ ID NO: 28330 - protein, 280 aa, Candida glabrata CBS 138
MAPSQGNAVQNNPPSRVVYLGSIPYDQTEEQILDLCSNVGPVVSLKMMFDSQTGKSKGYAFVQYQDLESSASAVRNLNGYQLGSRLLKCGYSSNSDITDQGVGNANNSAMDEYNEEMLSNSINRRFPQLPQGVDVNINMTTPAMMISSELAKKSPQEQKNLLKVFQKWTRENPEDAVYLLQECPQLSFVIAELLLTTGISKVDELTQLAESNQTGSQGNITSDILNNDKTIDPAVRAKKIELLRQVLQLSDGEIAILPYDEKMVIWDLKQKALRGEFGAL

SEQ ID NO: 28331 - protein, 127 aa, marine gamma proteobacterium HTCC2207
MTNKAVIHTDKAPAAIGTYSQAVKVNNTVYLSGQIPLIPDTMELIEGDISVQIRQVFDNLSEVCAASGGDLSNIVKLNIFLTDLSNFAVVNQVMGEYFQQPYPARAAIGVSELPKGAQVEMDGILVI

SEQ ID NO: 28332 - protein, 495 aa, Staphylococcus aureus subsp. aureus MRSA252
MAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPNGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGDPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 28333 - protein, 416 aa, Bradyrhizobium sp. BTAi1
MDDDRMGQGTVTNGPVVIVGAGHAGFQLATSLRQAGFADPIHLINDEAHLPYQRPPLSKAYLKGTGGPETLMFRPQKFYADQTIDLVHDRVVSVQRDQRKVLLASGKALGYGHLVFATGARNRLLDIPNANLPAVRYLRILDDSEALRGLLGEAKRVVVIGAGFIGLEFAATARIKGLEVDVLELGARVMARAVTAEISDYFQKQHAEAGVRIHLGVQATSIEADGNKVTGVSLSDGRHIPADLVVVGVGVLPNIELAADAGLAVASGIVVDEYLLTSDPHISAIGDCALFASPRFGGTLRLESVQNATDHARCVAARLTGDVKPYDGQPWFWSDQGNDKLQIAGLTTGYDQVVLRGDPAQKAFSAFCYKEGRLVGIESVNRAGDHMFGRKLLAAGGTVDAAKAADPSFDLKSALV

SEQ ID NO: 28334 - protein, 302 aa, Bradyrhizobium sp. BTAi1
MGRVVVAGSINMDVVATAERHPRIGETVAGHSVMYFPGGKGANQAVSAAKLGAPTSLIGRLGRDAFGEQLRAFLASQGIDLTAVKDSAGAATGTALITLAKADNTIVVIPGANAEVSPEDVAQVALTASDVAVSQFEIPQATIVAFFRQARAAGATTILNPAPASAFDSALFALIDVLVLNETELGFLTGIALGDTPTLPQVSDAVRALDPRDDQTVCVTLGARGAVAVTGSKARLVEGRAVTAVDTTGAGDCFVGALAARLSQGAPIADAIGYANIAASISVQRMGAGPSMPTAEEVGALL

SEQ ID NO: 28335 - protein, 502 aa, Pseudomonas sp. Y2
MTRSLTMNSSLSAIDGLRLPHQMLIGGQWVSAQSGKTLNVYNPATGDILTEVPDGDVEDVNAAVESAAGTLRSDTWRRMPPSARERILLRLADLLEVHGDELARLETLNNGKLLIYSKLMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 28336 - protein, 125 aa, Glycine max
  misc_feature (124)..(124): Xaa can be any naturally occurring amino acid
  unsure (1)..(125): unsure at all Xaa locations
MLACLFILAAMLNLREKQTSTRMSGRGKGGKGLRKGGAKRHRKALRDNIQGITKPTIRQLARRGGVNRITRLIYEETRGVLKIVLENVIHDAVTYTEHARRKTRTAMDACYALKTHGKTHDRFXC

SEQ ID NO: 28337 - protein, 476 aa, Bradyrhizobium sp. BTAi1
MVNRLQFYIDGAWVDPVVKKSTPVVNPATEEAMYEVALGSKADVDKAVAAARRAFETFSLTSREERVALLEKIIAIYKGRMKEIGAAVSDEMGAPLPMAEKLQAGAGLGHLMSTLDVLKKYEFEETLPASVVVREPVGVVGMITPWNWPLNQIACKVAPALAAGCTMILKPSEFTPTSALIFAEILHEAGVPKGVFNLINGLGPEVGAAMSEHPDIDMISFTGSTRAGIDVAKRAAPTVKRVSQELGGKSPNVILEGADLVKAVTGGVMHMFNNSGQSCNAPSRMIVPAARMKEVAAIAKGVADKTKAGDPRGEGTTIGPVVNRGQWEKIQALINKGIEEGATLVAGGPGLPEGVNKGFYVRPTIFADVKPDMTISREEIFGPVLVIIGAQDESEAVKIANDTPYGLAGYVSAPTIEKAREVGRKIRAGNVNLQGVPNDRTAPFGGYKQSGNGREWGKFGLEEYLEVKAVAGYNAA

SEQ ID NO: 28338 - protein, 253 aa, Oryza sativa (japonica cultivar-group)
MEKKHRHARSRSFSGGAIVSFLKSTAASFTATTTTASAPPPPHGRSSFNHRNAFSGPIVSIVPPEARGGGGGSRREHRSGYRTPEPSSPKVSCIGQIKKANAKKVKASCKNGPCPASRPGRPAEAAAARRQKSSLVRRMLFRRSRSRKASSSSSRDGGFFKGRTAGRAGAAVAAAPAPAGLGQMKRFTSGRAAFEDFDWREAERMASDDDDDVLVAHSAPLVLGGGLVASEPRKEVNLWSRRPMAPPTPLRLP

SEQ ID NO: 28339 - protein, 326 aa, Nocardioides sp. JS614
MTQKITLAKGLNMGLRKAMEDDPKVLLMGEDVGKLGGVFRITDGLQKDFGEDRVIDSPLAESGIVGTAVGLALRGYRPVVEIQFDGFVYPAYDQIVCQVAKMTFRSQGKSRMPMVIRIPFGGGIGAVEHHSESPEAQFAHTPGLKVVACSNPVDGYWMIQQAIACDDPVIFLEPKRQYHADKADLEETATPDPLFSSRVVRRGTDITVLAYGPTVKTAMAAAEAAATEGRSLEVIDLRTLSPLDMTPVYESVRRTGRVVVTHEAHVNLGLGAELAARITEQCFYSLEAPVLRVGAFDTPYPASRIEEDYLPDLDRVLDAVDRSLEF

SEQ ID NO: 28340 - protein, 789 aa, Bradyrhizobium sp. BTAi1
MAKPSASSDRLDILNALTRKVLWLSSWTIHHANHIRPNIDGLKVGGHQASSASLATIMSALYFSVLRPEDRVAVKPHASPVFHAIQYLFGRQSREKLENFRGFKGAQSYPSRTKDVDDVDFSTGSVGLGVAQTLFSSLVQDYVQAHGWMKDRREGRMIALVGDAEMDEGNIFEALAEGWKHGLRNTWWIVDYNRQSLDAVVREGLWEKFETMFRNFGWDVVIVKYGRLMREAFAEPGGEALRRWIDNCPNALYAALCFQGGAAFRKHIQDDIGDQGDVTRLLDRRSDDELLALMSNLGGHDMASMLEAFESIDHDRPVCFIAYTIKGVGLPFQGHKDNHAGLMTVAQMERWRAQQNIRPGHEWDKFEGLKQDAAMLESFLASVPFNRDGRRLSDAVLDVPGRLTFTAAAQMSTQQGFGLILNDLARSDSAMASRIVTSSPDVTVSTNLGAWVNRRGLFARAEKADLFRSERIPSTFNWAASPKGQHIELGIAEMNLFIMASALGLSHAINGARLLPIVTLYDPFIERGLDALNYACYQDARFMVVATPSGVTLAPEGGAHQSIATPLIGMAQDGLSSFEPAFVDELAAIMKWGFAHMQAAPGEGGSVYLRLSTRTIDQPQRIMSPELEADIAAGAYWLRKPGPNAEVIVAYTGAVAPEAIEATGLIGESRRDVGLLAITSADRLHAGWTAARSLRRHRRGVQHLSHVEQLLAPLPRDCGIVTVIDGHPATLGWLGSVRGHRVEALGVETFGQTGTIDDLYRHNGMDANAIIDAAESLTGAPVRHRKMAV

SEQ ID NO: 28341 - protein, 289 aa, Xanthomonas campestris pv. vesicatoria str. 85-10
MAAARLRMLTAAALRAMPLPSPGGDKEQRGRVLVVGGSMRVPGAALLAGEAALRAGAGKLQIATAASVAPAMALAVPEALVLGLGQNGQGEITRGHRALDAALAACDAAVIGPGMASTTTATALVKLAAAKAVCPLVLDAGALSRSLRAPPGRPFVLTPHAGEMATLAGDDKAAVEAAPGEYALAFAQKMRSVVIVKGADSFIAGPDGALWVHRGGVPGLGTSGSGDTLAGLIAGFAARGSDALTAALWGVFVHAAAGKQLAKRIGTVGFLAREIPPEVPGILDRLSRR

SEQ ID NO: 28342 - protein, 363 aa, Erwinia carotovora subsp. atroseptica SCRI1043
MTKSYHIAVLPGDGIGPEVMAQAHKVLDAVRQRFGIRITTSEYDVGGIAIDRQGTPLPQATVAGCEQADAILFGSVGGPKWEHLPPAEQPERGALLPLRKHFKLFSNLRPARLYQGLEAFCPLRSDIAAKGFDILCVRELTGGIYFGQPKGREGSGQYERAFDTEVYHRFEIERIAHIAFESARKRRSIVTSIDKANVLQSSILWREIVTEVAKAYPDVKLSHLYIDNATMQLIKDPSQFDVMLCSNLFGDILSDECAMITGSMGMLPSASLNEQGFGLYEPAGGSAPDIAGKDIANPIAQILSLALLLRYSLGADDAAEAIEKAVNTALAEGYRTADLASASNAIGTSEMGDVIARFVAQGA

SEQ ID NO: 28343 - protein, 600 aa, Alteromonadales bacterium TW-7
MSEPVTFESLNLSPAILKAVEELGYKTPSEIQAQCIPLLLERKDVLGLAQTGTGKTAAFALPLLNNIDPSVKQPQILVLTPTRELAIQVAEAFEQYAKGTRGVEVLALYGGQSYSIQLSALRRGAQIIVATPGRLIDHINRGTIKFDALQALVLDEADEMLRMGFIDDVENIMEKTPREKQTCLFSATMPKQIQNISSKYMNNPEQVHISARNSTVSSVEQVFWNASVHKNKAIVRFLEAEQYEGAIVFVRTRNDTVQLAELLEREGFSAAPLNGDMNQQARERTVDRLKSGMLNVVIATDVAARGLDVDRLSLVINYDIPQDSEAYVHRIGRTGRAGRTGKAILFVKHNERYLLKNIIRHTKSEIAQVELPTAKVVEEKRIAALQAKLSIALENKDITFFNEVATNMAEKLDLPLENLAGALLCLAQQQSPIKVEEVKIQPRERNERNSRNDRGDRGRRNERGGERSERKPRERNSRDAGPMDTYRIEVGREHGVQVKNIVGAIANEADISSKFIGDIRLHDQHSTVQLPQNMPKDVLDHFQKVFICKRPMGMTITQDQGPAEPRGERPSGDRKRNDGPRGDKRSGPRKERRPVSFTAK

SEQ ID NO: 28344 - protein, 925 aa, Arabidopsis thaliana
MRLRHQGGQYLARGMEPVYWSNKVDSTHDLYDNYTLGSYQNNSYNILAHTGFGYDHEFQIYEINSNSWRIIDATLDFKLGYIGRGVSLKGKTYWIASGEEEKRLGKFLISFDYTTERFERLCLPNKYPCYATLALSVVREEKLSMLSQRGIKSKAEIWVTNKIGETQVVSWSMVLALDLQPKRCIGESGSFLVDEKKRVVVCCDNIRDQGKTTFDSNLPRYHRQKKKGRMIIVFDVESMRLPVTVKATKPSFLVIWIRYSSAASSPTVSLNPSGRLQQTLAGSVEVKGKSLHSGKFSTVKLNPEIAGAGRFFEFRSRFIPASIEFAQESPLCTTLLKDELKIRTVEHLLSALEAKGVDNCRIQIESESSDDREVEVPIFDGSAKEWVDAIQGVGINAAQNHDGESVEKMVAHVNKPVYVCKNDTFVAAFPALETRITCGIDFPQVPAIGCQWFSWRPIHESSFAKDIASSRTFCVYEEVERMREAGLIKGGSLDNAIVCSAEHGWMNPPLRMRRRRCDLQPKRTRMCDLQPKRTSMCDLPPKLVGEKILTRIPITSLRAVRSTCKLWNALTKDRVLVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 28345 - protein, 55 aa, Glycine max
MWILRFKFIRQTVLDVCYPMDVDQPIDPNEPTYCVCHQVSFGDMIACDNENCQGG

SEQ ID NO: 28346 - protein, 835 aa, Photobacterium profundum SS9
MVSIVIVSHSPDLAKGVHALAEQMTQGKVQIAVAAGVNDPENPIGTDAIAIMMAIEEVYSPEGVLVLVDMGSAILSTDMALELMGSEQTTNVHICAAPLIEGAMSASVAAAAGMSLEEVTNEAHNALLAKYQLLNQSAKLPNGIPTDVLPTPADSENETEIEWLVQNPHGIHARPASAIVAAISTFDAQIWLRCHDRRVSAKSINSIALLDVKQGDTLVCIASGKEAQQALQAFKLLAHNHFNESIDEQIDVMNKQNSVNTIHQVTDIIEDEHGCLRAIGISEGIAIAPIWHYRATMPKARDRSYLGYEQEWTLYTQASDAAQQELSQLADRTAHAGSKSESDIFTAHCAMLADPDLSNQIAQQLSNKINVENAWSSIIEQTAQAYKDVSSEYMQARAKDIYDIGRRVMRLLIGEAEQKIVLTEPVILAAVDLSPSDTAQLDPTMIKGIILEQGGSTSHSAILARALGIPAITGLNKLMSRSQEGSVAVINGCSGEVWLSPTSLQLESAQKELEKQQFQKEQAQATMIEKAYTQDGVSVDVFANLATLDDAEQALNSGAEGVGLVRSEFLFMEREQAPSEQYQYEFYSQIANSFGNKQVIIRTLDIGGDKPLAYLQQGHEDNPFLGCRGLRLCLQNEELFKVQLNALLRARAKHPNLHVMFPMVATPEELHQAKSLLSDCHNALQRDGISSTIPEIGIMIEVPAAVVNAKQLAKEVSFFSVGTNDLTQYVMAADRGNNAVSYLVSSTQPAVLRMIELAVKAAHDAGIPIGICGEMAGDPKLTETLIGMGIDKLSMSPIRIAAVKQAVRATHHQQAERKAKEVLNAETLPQILAIL

SEQ ID NO: 28347 - protein, 387 aa, Zea mays
SPFSSGHAGSPYVPCPHFFPLFYPHRLLSATKCVATKPFPVEDYLVATCGLTQAQALRASKHVSHLKDPSKADAVVAFLSNLGLSSAEITDVVTRDPKVLCSDVERSLTARVAELTDLGFSRPEIVRLLIVGMNHFRHSSLRLNLEFWISVFGSLEELIRALRINAALLSTRIEEVCKPNLELLQECGINVSDISNSFMSRVLTRDPKSLQEALARLHEFRIQPGSQPFFRGLYTFAILGSGKITKSIQLFEKLGWSKDHIVSAVKRDPTILGFTEERVRRNMEFLIRVVGLEVPYIARRPALINYSIDRRLLPRNCLINFLRAKGLFNDEASFLSVAAIGDEKFRRRYVHPYEEDFPGLAAAFASSCAGEHQWERLYKMTGENKES

SEQ ID NO: 28348 - protein, 125 aa, Triticum aestivum
MAAHQQQQPQQAVGFEDYLPVMAERLGEEGLMEELAAGFRLLMDPASGLITFHSLRRNAPLLGLGAMSDDDLRGMLAEGDFDGDGALSQMEFCVLMVRLSPDLMDQPPRWLDDAVAQASHFLFHS

SEQ ID NO: 28349 - protein, 293 aa, Novosphingobium aromaticivorans DSM 12444
MAEVTTLDGAWLRANPLPLPDEESDKNARGRVFVVGGCMTVPGGVRLTAEAALRSGAGKVRIATVEPTAVILGAFLPEVAVLPQPMDEAGEIDAAVARIADDVRRCDALVIGPAMGCKRQASALVGMALAEEARAGLVLDAAALMALSDHALALCRRERPAVLTPHIGEIAALLGRDAGEIDKDRVAATRDCAERFGSVVVLKGAVSIVAEPGGATFSYSGGNVGLATGGSGDVMAGIAAALIARGAEPTVAALWAVWLHGEAGRRCAETVGPLGFLASELLGFIPQVMQRAA

SEQ ID NO: 28350 - protein, 958 aa, Bordetella parapertussis 12822
MLETVIKRDRDLGTPARESAQLVTLTIDGQPVSVPAGTSVMRAAAEAGINIPKLCATDSLEPFGSCRLCLVQIEGRRGYPASCTTPVEAGMVVQTENARLRDLRRGVMELYISDHPLDCLTCPANGDCELQDMAGVVGLREVRYGYDGENHLAEAKDESNPYFTYDPSKCIVCNRCVRACEETQGTFALTISGKGFASRVSPGQDQPFMDSECVSCGACVQACPTSTLQEKSIIMLGQAEHSVITTCAYCGVGCGFKAEMKGEEVVRMVPWKDGQANRGHSCVKGRFAWGYTTHKERVLKPMIRQRITDPWREVSWEEAIGHAASEFRRIQAAHGRDAIGGITSSRCTNEETWLVQKLVRAAFGTNNVDTCARVCHSPTGYGLKQTLGESAGTQTFDSVMHTDVVIVMGANPSSAHPVFASRLKRRLREGALLIVIDPRRIELVSAPHVKADFHLQVRPGTNVALLTAMAHVIVTEGLVAESFVAERCEAPSFDMWREFVARAENSPEAMQEVTGVPAQLVRGAARLYATGGNGSIYYGLGVTEHSQGSTTVMAIANLAMATGNIGREGVGVNPLRGQNNVQGSCDMGSFPHELPGYRHISDDAVRGEFERDWGVTLQPEPGLRIPNMFEAALGGSFLGLYCQGEDIVQSDPNTQHVAAALSAMECIVVQDLFLNETAKYAHVFLPGSSFLEKDGTFTNAERRISRVRKVMRPRNGMADWEITMALSNALDYPMHYAHPSEIMDEIARLTPTFAGVTYEKLDRLGSIQWPCNEDAPEGTPTMHIDEFVRGRGRFMLTKYVATDERSTRRYPLLLTTGRILSQYNVGAQTRRTPNVMWHGEDVLEIHPHDAQERGVADGDWVGIQSRAGETVLRATLTDRVQPGVVYTTFHFPESGANVVTTDNSDWATNCPEYKVTAVQVTRVSQPSEWQRQWSRFADVQQKLLHERARETEPALANK

SEQ ID NO: 28351 - protein, 248 aa, Oryza sativa (japonica cultivar-group)
MEERPRDRTVEEAAAFSGDESDGEFEFPFVSRETDAGGVADELFADGRIRAFYPVFGRVLDDVAVTPAAAAAEERRPPLGRLFLEEGRTSSVGSTSSSSSSTDIAELDGVSPDSYCVWVPGSSPASSPSRPPRKSGSTGSIARWRRISELVVGRSHSDGKEKFRFLSAPSSPARDHPKPKPTTKGGAAAATKLHTELDTIAAGHRLSYSPNHKAHGGATRRTFLPYRQDLMGIFANVNGLSRTHHRPF

SEQ ID NO: 28352 - protein, 532 aa, Triticum aestivum
SLLSSSCYEYSCFSGGLQERWKQIKADRQLSHSMSRDLDCPVQTQMAVAVLDRSFSSDYPASSKTEGRPLSWKRVFVQTDNGSVLGIELERGENAQSVKKKLQIALNVSTEESSLTFGDLVLNNDLSNVRNDSPLLLTRNQMHRSSSTPCLSPTGNGVQQRDRSGPIAILGCSSPSPQMKQLAKDIVKAIRNDVDPVAVNSGMGGAYYFKNIWGDHVAIVKPTDEEPFAPNNPKGFVGKTLGQPGLKRSVRVGETGFREVAAYLLDHGHFANVPPTMLVKITHSVFNVNATVGCNHKMFHNKSQAVSKIASLQQFIPHDFDASDHGTSSFPVSAVHRIGILDIRIFNTDRHSGNLLVRKVGPGSDNFGVQTELIPIDHGLCLPECLEDPYFEWIHWPQASIPFSEEELEYIAKLDPLKDAEMLRMELPMIRKACLRVLVLSTIFLKEGAAFGLCLSEIGEMMSRQFTGRKEEEPSELELLLHGGQGSGSRTESYFFQKPELKTTMMTSPSSLLTARMIQMHLNHPHSAGLVP

SEQ ID NO: 28353 - protein, 588 aa, Zea mays
  misc_feature (229)..(229): Xaa can be any naturally occurring amino acid
  unsure (1)..(588): unsure at all Xaa locations
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKETDIVDWFIPVVKRLAAGEWFTARVSSCGLFHIAYPSASDQLKTELRTIYGQLCQDDMPMVRRAAASNLGKFAATVEQNHLKTEIMSIFDDLTQDDQDSVRLLAVEGCAAXLGKLLEPQDCVAHILPVIVNFSQDKSWRVRFLVANQLYELCEAACPEPTRADLVPAYVRLLRDNEAEVRIAAAGKVTKFCRILNPQLSVQHILPCVKELSSDSSQHVRSALASVIMGMAPVLGKDATIEQLVPIFLSLLKDEFPDVRLNIISKLDQVNQVIGIDLLSQSLLPAIVELAEDRHWRVRLAIIEYIPLLASQLGVGFFDDKLGALCMQWLEDKVFSIRDAAANNLKRLAEEFGPEWAMQHIIPQVLEKINNPHYLYRMTILQAISLLAPVMGAEITCQKLLPVVINSSKDRVPNIKFNVAKVLQSLVPILDQSVVEKTVKPCLVELSEDPDVDVRYYANQALQACDQMMVSS

SEQ ID NO: 28354 - protein, 432 aa, Nicotiana tabacum
MAGQTIIVSGLNPAAILQSTIGGGASPTAAAAENGTRKVIPLSRDALQDFMLSIITQKLQDEKQPFYVLDLGEVVSLMDQWKSALPNIRPFYAVKCNPEPSFLSILSAMGSNFDCASRAEIEYVLSLGISPDRIVFANPCKPESDIIFAAKVGVNLTTYDSEDEVYKIRKHHPKSELLLRIKPMFDGNARCPMGPKYGALPEEVEPLLRAAQAARLTVSGVSFHIGSGDADSNAYLGAIAAAKEVFETAAKLGMSKMTVLDVGGGFTSGHQFTTAAVAVRSALKQHFDDQPELTIIAEPGRFFAETAFTLATTIIGKRVRGELREYWINDGLYGSMNCVLYDHATVNATPLAVLSNRTNVTCGGSKTFPTTVFGPTCDALDTVLRDYQLPELQVNDWLVFPNMGAYTKAAGSNFNGFNTCAIVTHLAYTYPS

SEQ ID NO: 28355 - protein, 300 aa, Xanthomonas campestris pv. vesicatoria str. 85-10
MSGSKNQYEMQNPLTQFPQPQFPHQTQQAPGTIHELQPKADHGEHSYKGFGRLQGRKALITGADSGIGRATAIAFAREGADIVLNYLPEEEQDAAEVVQLIQAEGRKATSVPGDLKNEAFCTELVDRAVKELGGLDVLVNIAGKQTAVKDIADITTEQFDATYKTNVYAMFWLCKAAIPHLPPGASIINTGSIQSYQPSPTLLDYASTKAAIVNFTKGLAQQVAEKGIRVNAVAPGPVWTPLQPSGGQPPEKIPDFGSETPLKRAGQPVEMAPLYVILASQESSYVTGEVFGATGGLLLS

SEQ ID NO: 28356 - protein, 326 aa, Xanthomonas campestris pv. vesicatoria str. 85-10
MHRTPPAHVVISGASSGIGQATAEAFAEQGARLVLAARGEEALNAVAERCRARGAEVLVAPTDVKQAEQVKALATSAQSFLGRIDLWFGNVGVGTVGKFHEVPMEASAAVIHANLLGRMHDAHAAIPIFVEQGHGIFVNMISSGGFASTPFAAAYGASKFGQRGFSEALRAELSDYPHIHVCDVYPYFVDTPGLTHGANYVGRRISGPPLMLDTRTVAAAVVRLLDRPRNTVVLGTAVHAMRLGHALAPQTLARAMYRIFKQYLAQAPQVARSSGNVFAAPGIAGGIDGGYRRRPALRARSAHDKMLIGAAAAAVTGLAVLALRRK

SEQ ID NO: 28357 - protein, 225 aa, Triticum aestivum
RGPGRGGKKKHAKDESDRQKQAEKKRRRLEKALANSAAIISELEKKRQQKQEEQRRRDEEGAAIAEAAALHVLIGEDCDEPRQLRWNGHRGRGHRDDFVDHEPALGAQGAGADTYPYGSRSPLARASRSHMPQWRLTDCGMSGPFSFSSWERMGDFEGLYCKGTPCQTDQDTYCHGLVAATQAASPFGYGSEDPFPAHGTEGASSINIMLGGGTSNSLNIYRRQF

SEQ ID NO: 28358 - protein, 2638 aa, Clostridium perfringens ATCC 13124
MLVLFTFLFSFLPHMPVMAEVENNNTKANEKTLVKNESEAFAVVVGDFLKESGNGSDWDPRNMNGVLKKYKNGLYEGALKLKAGNYNYKIAMNGTWDESYGNNGQNIALNLSKDSEVIFRLDYKNKKVDDSINNPDQFKTKAILAGNIKDIIDGASDWNPGNDTEKLDYIGGGMYKKTFPIKESARGKDISLEYKVSYNGEWNNGEVAENAKVVIPKGTKNITILSNYLDNYVKDSINNPSLSNTVSLIGTVREGNGDWDVNNKNFEMHNLDENRVLYSKVMKKGTYEYKGLVNHSWDNGGIPSQGNVTLNVPEDRNVIFVADLKNNKIYDSINNTKEINNTKEINEALGIKGDENTGEDNNDGNQGESENKPDSVKSPVVNEDGTVTFSAKFNGDSLYLIGSMVSWDTSKQIEMKKGEDGVFKVTIPLTGGVYEYKFKPNKDNWDNSFTDPSNKVMANGNSVLNMPGLEIGGESSVEVGSNTKLVAYIYDTEGNKKEANVNWSLEEPVSGVSIKENTLKVSKDVDSSKKIKIKATDGKYSVSKELAILSQMYTYTINYYRFDGNYDNWNLWLWQTGGEGKGYDFNKKDEAEKGFTRAVYKFPSDKLNFLIRKGNWEDKDVGHDRTIEVKNGNNVEVWLIQGDENIYYDKKDVDTSPKLISALMDSKTDLLVTSAGNIEDSELDSFKLIDKTDNKEIKTSAIKVSDNKVKLTLKKGFFSTPEIDLSHDYEVSSNSFRATKVTMRKILDDPEYFYNGDDLGVTYKKDSSTFKLWAPTAKEVSLVLYDNEGTYDENGKVTDNTGGREISMKKENKGVWSLKVDEDLEGKYYMYKVSFSDGKTNYAIDPYAKAVSANGQRGAIIDFSSTNPSEWGSVKKPPMLNPTDSILYEMHVRDFSISKDSGINNKGKFEGIAEEGTKVPGTDVKTGIDHLKELGITTVHLLPSFDYASVNEISNKPQFNWGYDPQNYNSLEGSYSTNAEDPKSRVREFKDMVQTLHKNGIRVVMDVVYNHTYGIGQNSPFDPVVPGYFYRTNDEGKYTNGSGCGNEVATERPMVRKYIKDSVKYLAKEYDVDGFRFDLMGLIDTKTMSELTTELRNEIDPSLIIYGEPWQAGGSALPQEQQTLKGSQKGKGFAVFNDNFRNAIKGDSDGAGQGFATGASGKEGAIVAGVKGSVDDFTDSPSETINYVTAHDNLNLWDKIIKAAGKEKAAGFLEMRDGVLTGEDANKYSSVQEAVNKKAKPYSVITETNPLDNEYVRRSILTTAITITSQGIPFFQAGDEFLRSKYGDHNSYKSPDAINKINWQNKEKFSGVFDYYQGLISLRKSHPAFRMDTKAAIESNLVVTKANDNIVVFQLKNFANGDSWKNIVVAYNGNNAEKEISLPHEGDWNVVVNEHKAGTSVLESLKGVNSVKVAPLSAKVLYDESVEGEAQTPTSIDVTPSSLKLDIGASNFLKAVIKDQNGRIIPNAEIKWNVSDDSVIKVDSNNGKVTALKEGKSIITLNSGSLTKDVEVEVVHLVPSSLELNGPNQVYTGKDIQLNGIVKDQFGQVISGANIEWFSSDESIAKVSTLGVVQGISEGKVKITAKSGKAKATKEIEVKKYTKKYIEFTYVRDDKNYDGWNIWTWQTGINDGQQNFTQIKDGKAISKFEIAPDVTQVGFVLRKGTGWDEKDPYESDRYIQIDPSMNVTKVTVKSGVGEFFQVPAIKNAEIQEGNINFKYRDEALYEESNQSSIDKVQVKVTSPGILFKDTKTYDMDYDSQNEFFAYSLKDIKPGTYEYSFLVTKDGKTVETEKQTIEYSPLKINGEVTFKNNQVNYDENALVNLKLSGSDAKKENIKEVYMDLTNVGGPNKVLMDLNLLKDNSLSQSIGINDNVVAGEKEIPVTIVDKNGENHKALGNLTVKSKVGVGPLDFGFDESRIYFTVTDRFFNGDKNNDDPHGNNYDKKNPYTYHGGDLKGLTDKIPYLKELGINTIWITPIVENTDFNQMFSQGKTQYSYHGYWAKDFEKLDPHLGTMDDLKTLIDTAHDSGIKIMVDVVLNHAGYGMKNKEANSGANNYPTEKDRAKFKGMFRENPGNDFITQESAGLPDFKTEDPEVREKLIEWQTGWIERLKTEKGNTIDYFRVDTVKHVDNTTWKAFKNKLTEINPSFKTIGEYFGADINNDGGQLQNGQMDALLDFGYKGKARDFVNGNIEGASAYLDDRASKISNINLMGQFLSSHDEDGFLKTVGDDLGKQMLAASLQITDKGIPVIYYGEELGMSGWNGFEQGDQNRYDMDFERLNDPKYKKVHDHYEKLLNIRKEYSKVFSKGNRKTIAGNNEEGYSVVLRSYNGKEITPMNLSENNEEKNITNGQNLFVVLNTKNEDKDISFKTNFKEGDKVKDLYSGNEYSIGKDGNVTVKAPSREDGGTAILALKNDSISPSVINNAPEINAKDVTLTVGDKFDPMEGVTAMDKEDGDITKDIKVIENNVDTEKSGDYKVIYKVTDSEGASKTKEINVKVNEKEATSPEEIKVTGVKLNKKDLNLKKGKKYTLKAEISPKDATNKDVTWISSNPKVVSVDENGNIEAKSSGEAEITVTTKDGGFKDTCKVKVKHSGFLPNTGSVGGRIVIVIIGVIAIGIGVAMIFYKRKVIRRNRQDK

SEQ ID NO: 28359 - protein, 1578 aa, Oryza sativa
MITLKSSDGEPVEVTEASARISKVIGDKIDAGRGGEAIPLPHVDKKTLKKVIEYCDEHANENSDTDEQKEELKNWDKAFIDELDEDDGSFLFLVLLASSYLKIDGLLDLTYQRVADNSKAKTTEEIRKTFSTIEIELSDKEEEEQQQEEEIRPENMKKKTATAMMIVTPRPTVTTVPVAGEEVAGGTTTTTPGLIKTGDAGIETTTIGMNGDETLGVAAANNVRLIKTTAVNAHAPRASATGEGTVTMAAGVITLVPPTWTTSPILSTPSHTWQRSLCLPASRSFTPRKSRRDQLLRLALVADKAMAAPPPTAMEDLAIRSSTGTEAWFSGTAWKPVPVARVFGRIREALPATPAVETPTTYQQIEEALMRLELAAAAARTPGDDTLLPQPMSPAPLAASPPRRLEDLASDAVADKILPAPLPGALLPQEMTHMPATPPLSALEPGSLPERASSPCAIAGLFTSPPPAIIASPLRSTLPCLRPVVLTRKVKLRPRQHSQAIRRSEHLAKQPARPMMERCQRILFRRLGILHDEEDASVERVLSQYMAMFDGPLPPHAIAALTAIFGLDDDDECAMDASLLPLVGEGITDVADELACRRWPACRLPSISMEPQLLEHMSMSHSLDFISWNVRGLNSPAHCNTVHEMMLDTKCNLACLQETKLQNIYDGLARFLGGYKLDSFAFKPATGTRGGILILWNSAVLVLQDIRIGRFSISAQVTVPLTGATFLMTGVYGPTRHRLKDGFLRHIRRLKPNAGEGWLLFGDFNMIYRARDKNNGNLNLARMRRFRATIDRCELREIPLQNRRFTWSNERQRPTLVKLDRCFCNENWDLAFHHHVLHALPTGPSDHCPLVLSNPAAPRKPRPFRFENFWTRIPGFKDMVKASWTQPSPHTEPMHRLNYKLQRTASCIKTWAKSLFTEVKIQFHMALDVIQRLDVAQEHRDLSGPELRLRAALKRKTLTLATIERARKRHASRLTHIREGEANIKFFHLRVNARRRKNSIQRPSKENGWAVTHDEKEMTILDHFAHLMGRPGPRPNELNWEALDIQPFDLSTLEEPFLEQEIHQAIKEMPVDKAPGPNGYTGIFFKICWDIVKEDVSLVFNSIFNLRYASLGLLNSANIVLIPKKEGAESVSDYRPINLIHSIAKIFSKLLALWLRPHMHSLVSINQSAFIKGRSIHDNFLFVRNMARRFHRTNRPMLLFKLDITKAFDSIRWDYLMALLQRLGFPVKWRDWLDDAAIFVNPTRGDVQALTEILQRFGTATGLVTNFQKSQVAAIKCNNIDLDDVLEGVPAAGTGDITGGKCKVNWTKTCLPIRQGGLEVLNLERFMRALRLRWLWHEWKDPNKPWVGLEIPCDEVDKSLFAASTKITIGDGNIARFWDTAWIDGRRPKDLMPLVYAISKKRKKNLRQGKENDAWVGDLALETNPVITVALVEQLVALWTAVCNVQLEEEESDQIAWKFTPHGHYSASSAYKAQYTRRIWNLVATWVGFHQLEPRRWGVAQSVKDWWEMLASVSGVPKKGLRTLILLIVWEVWKERNRRIFDHKEATTSYLLSKIKEEAGMWALAGAKRLGEIISQFV

SEQ ID NO: 28360 - protein, 102 aa, Glycine max
HTSERDEDDCILEGEGATGWHGADIGGIIYWLVSASYLNVTRILRSLLQPWVTHHVVTQTRIILMIQRYGFGLLDALFCGVSSAAYVPFYTAFIPLLFWSGH

SEQ ID NO: 28361 - protein, 1151 aa, Arabidopsis thaliana
MTSLPSSVIKWRFFRRQMPSDVVFSLCLLCFASCLAGKITVLADSDKSVLLRFKKTVSDPGSILASWVEESEDYCSWFGVSCDSSSRVMALNISGSGSSEISRNRFTCGDIGKFPLYGFGVRRDCTGNHGALAGNLPSVIMSLTGLRVLSLPFNSFSGEIPVGIWGMEKLEVLDLEGNLMTGSLPDQFTGLRNLRVMNLGFNRVSGEIPNSLQNLTKLEILNLGGNKLNGTVPGFVGRFRVLHLPLNWLQGSLPKDIGDSCGKLEHLDLSGNFLTGRIPESLGKCAGLRSLLLYMNTLEETIPLEFGSLQKLEVLDVSRNTLSGPLPVELGNCSSLSVLVLSNLYNVYEDINSVRGEADLPPGADLTSMTEDFNFYQGGIPEEITRLPKLKILWVPRATLEGRFPGDWGSCQNLEMVNLGQNFFKGEIPVGLSKCKNLRLLDLSSNRLTGELLKEISVPCMSVFDVGGNSLSGVIPDFLNNTTSHCPPVVYFDRFSIESYSDPSSVYLSFFTEKAQVGTSLIDLGSDGGPAVFHNFADNNFTGTLKSIPLAQERLGKRVSYIFSAGGNRLYGQFPGNLFDNCDELKAVYVNVSFNKLSGRIPQGLNNMCTSLKILDASVNQIFGPIPTSLGDLASLVALNLSWNQLQGQIPGSLGKKMAALTYLSIANNNLTGQIPQSFGQLHSLDVLDLSSNHLSGGIPHDFVNLKNLTVLLLNNNNLSGPIPSGFATFAVFNVSSNNLSGPVPSTNGLTKCSTVSGNPYLRPCHVFSLTTPSSDSRDSTGDSITQDYASSPVENAPSQSPGKGGFNSLEIASIASASAIVSVLIALVILFFYTRKWHPKSKIMATTKREVTMFMDIGVPITFDNVVRATGNFNASNLIGNGGFGATYKAEISQDVVVAIKRLSIGRFQGVQQFHAEIKTLGRLRHPNLVTLIGYHASETEMFLVYNYLPGGNLEKFIQERSTRDWRVLHKIALDIARALAYLHDQCVPRVLHRDVKPSNILLDDDCNAYLSDFGLARLLGTSETHATTGVAGTFGYVAPEYAMTCRVSDKADVYSYGVVLLELLSDKKALDPSFVSYGNGFNIVQWACMLLRQGRAKEFFTAGLWDAGPHDDLVEVLHLAVVCTVDSLSTRPTMKQVVRRLKQLQPPSC

SEQ ID NO: 28362 - protein, 607 aa, Bacillus cereus ATCC 10987
MCGITGWVNWNKDLSNEHVILEKMAHSIQHRGPDAEGFWFSPRAAFAHRRLIVIDPEGGAQPKTFRAGDYTYALTYNGEIYNFRELREQLRKCGHTFETHSDTEVLLHAYLEWKEDCVQHLNGIFAFALWDDQKQQLFLARDHLGVKPLFYTERNDSIIFGSEIKALLAHPSVPTEIDADGINEIFGLGLFRTPGCGVFKHIEEVRAGHSITFTRDKKVVTKYWNLESKAHTDSTEDTASHILSILQDTVKRQLIADVPLVCMLSGGLDSSGITALAGKEFAAENKTLHTYSIDFVNSAKDFELTFARTGLDAPWVKRVSEHVGTSHHDIIVNAEELANHLFVPLRAKDLPSAGEMETSLYLLFCEMKKDATVALSGESADEVFGGYPWFHQEELLYVDKFPWLTNWKNTSPLLLHEVSNQCNLEEYIDTRFQEAILEVPTLKGESKKSAKQRQMFYLFLTRFLPFLLDRKDRMSMAVGFEVRVPLCDYRLVEYLWNVPFNIKSIDNIEKGILRRALKPALPDDVRNRRKSAYPTSQDPHYLQTIRHLSLDMCSNKNNPIFSLINHSTLLAIADQSNKDINNFEARSAMEYMLQVNEWLKTYHIHIA

SEQ ID NO: 28363 - protein, 428 aa, Pyrococcus horikoshii OT3
MENPYEITAIVAREILDSRGNPTVEVDVHTPIAMGRAAVPSGASTGTHEAVELRDGGKRYHGKGVRRAVENVNKIIAPELIGMDVRWQREIDKLLIELDGTENKSNLGANAILAVSLAVAKAAANSLELPLYQYLGGVNAYVLPVPLSNVINGGVHAGNELDFQEFMIMPIGASSFREAIRWVSETYHVLKRVIMGKYGKNAVNVGDEGGFAPPMKEVTEPLDALIKAIEEAGYKPGDEIALAIDAASSEFFKDGKYIVGGKEYTREELLDLYKELVSTYPIVSIEDPFHEEDWEGFVMITNELGKKIQIVGDDLFVTNPRRLKKGIELGAANALLLKVNQIGTLTEAMDAAYTAFRAGYSVIVSHRSGETEDTTIADLAVALNAGQIKTGAPARSDRNAKYNQLIRIEEELEGIAVYAGKNFRKVFF

SEQ ID NO: 28364 - protein, 1151 aa, Populus trichocarpa
MASQSQRQSNQRQHQNQAAQSSGTSNMRQHHHATESVSKAIAQYTVDAQLHAVFEQSGGSGKSFDYSQSVRTTSQSVPEEQITAYLSKIQRGGHIQPFGCMIAVDEGSFRVIAYSENAKEMLGLTPQSVPSLDKQEILSDGTDVRTLFRPSSSAMLEKAFGAREIILLNPIWIHSKNSGKPFYAILHRIDVGIVIDLEPARTEDPALSIAGAVQSQKLAVRSISQLQSLPGGDIKLLCDTVVESVRELTGYDRVMVYKFHEDEHGEVVAENKRADLEPYIGLHYPSTDIPQASRFLFKQNRVRMIVDCHATPVRVIQDEALMQPLCLVGSTLRAPHGCHAQYMANMGSIASLAMAVIINGNEEEAIGGRNSTRLWGLVVCHHTSARCIPFPLRYACEFLMQAFGLQLNMELQLASQLSEKHVLRTQTLLCDMLLRDSPTGIVTQSPSIMDLVKCDGAALYYQGQYYPLGVTPTEAQIKDIVEWLLALHGDSTGLSTDSLADAGYPGAASLGNAVCGMAVAYITKRDFLFWFRSHTAKEIKWGGAKHHPEDKDDGQRMHPRSSFKAFLEVVKSRSLLWENAEMDAIHSLQLILRDSFRDVEATNSKAVVHAQLEDTELQGMDELSSVAREMVRLIETATAPIFAVDVDGCINGWNAKVAELTGLSVDKAMGKSLVHDLVYKEYEETVDKLLHRALRGEEDKNVEIKLRTFGSEHQKKALFVVVNACSSKDYMNNIVGVCFVGQDVTGQKVVMDKYVHIQGDYKAIVHSPNPLIPPIFASDENTCCLEWNTAMEKFTGWSRGEVIGKMLVGEVFGSCCQLKGSDALTKFMIALHNAIGGQDTDKLPFSFFDRNGKYVQALLTANKRVNMEGEIVGAFCFLQIASNELQQALKVQRQQEKKCSARMKELAYICQEIRNPLSGLRFTNSLLENTDLTEDQKQFLETSAACEKQILKITRDVDLESIENGLLELEKAEFLFGSVINAVVSQAMLLLRERNLQLLRDIPEEIKTLVVYGDQARIQQVLADFLLNMVRYAPSSAGWVEIHVCPTLKQISDGHTLVHMEFKYALLNSFACLPPELVQDMFHSSRWVTQEGLGLSMCRKILKLMNGEVQYIRESERCYFLVILEVPMPNKCERYNCKKCCRLGCLVCNVY

SEQ ID NO: 28365 - protein, 512 aa, Arabidopsis thaliana
MDIIFEQALFPLFCFVLSFFIIFFTTTRPRSSRKVVPSPPGPPRLPIIGNIHLVGRNPHHSFADLSKTYGPIMSLKFGSLNTVVVTSPEAAREVLRTYDQILSSRTPTNSIRSINHDKVSVVWLPPSSSRWRLLRKLSATQLFSPQRIEATKTLRENKVKELVSFMSESSEREEAVDISRATFITALNIISNILFSVDLGNYDSNKSGVFQDTVIGVMEAVGNPDAANFFPFLGFLDLQGNRKTLKACSERLFKVFRGFIDAKLAEKSLRDTNSKDVRERDFVDVLLDLTEGDEAELNTNDIVHLLLDLFGAGTDTNSSTVEWAMAELLRNPETMVKAQAEIDCVIGQKGVVEESDISALPYLQAVVKETFRLHPAAPLLVPRKAESDVEVLGFMVPKDTQVFVNVWAIGRDPNVWENSSRFKPERFLGKDIDLRGRDYELTPFGAGRRICPGLPLAVKTVPLMLASLLYSFDWKLPNGVGSEDLDMDETFGLTLHKTNPLHAVPVKKRGRN

SEQ ID NO: 28366 - protein, 1146 aa, Populus trichocarpa
MASQSQRQSNQPVHNQAQSSGTSNMRQHHHATESVSKAIAQYTVDAQLHAVFEQSGGTGRSFDYSKSVRTTNQSVPEQQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVRVIQDEALMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTETQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDITGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMEGDIIGAFCFLQIASPELQQTLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFKYLERVLQTRMLGLQHPLRSFLNFKLTLVMLHREGMVPKIQFQGLSVCQGRLIWLSYPENTTVTLYPLTIWFLLLYRRQSRSITHT

SEQ ID NO: 28367 - protein, 267 aa, Brassica napus
  misc_feature (123)..(123): Xaa can be any naturally occurring amino acid
  misc_feature (156)..(156): Xaa can be any naturally occurring amino acid
  misc_feature (185)..(185): Xaa can be any naturally occurring amino acid
  misc_feature (198)..(198): Xaa can be any naturally occurring amino acid
  misc_feature (219)..(219): Xaa can be any naturally occurring amino acid
  unsure (1)..(267): unsure at all Xaa locations
RPRVRTGWLLRQEQKGEIDTEMTIVMSSIAMACKQIASLVQRAGISNLTGVQGAVNIQGEDQKKLDVVSNEVFSNCLRSSGRTGIIASEEEDVPVAVEESYSGNYIVDFDPLDGSYNIDAAVXAATGSIIGVYSPYESNDISTLWSEEQIRIVNAXQPGHNLLAAGYCMYSSSVIFVLILGKDVXMYGEFVLTQENIXIPKIRKIYSFNEGKMWYESLXKYIDDLKDPGPSGKSYSLRYIGSLVVNFHRSLLYSGIYGCCQEQKRNA

SEQ ID NO: 28368 - protein, 486 aa, Arabidopsis thaliana
MMMMIILLLCSIILITILFFKKQSRGKKSNAPPSPPRLPLIRNLHQLGRHPHRSLCSLSHRYGPLMLLHFGSVPVLVVSSADAAKDVLKTHDRVFASRPRSKIFDKIFYNGRDVALAPYGEYWRQMKSVCVLHLFSNKMVRSFRDVRQEEISLMIEKIRISSSLRINLSEILVNLTNNVICRVALGRKYGGKTDFKDLMKRLTRLLGEFSVGSYVSWLAWIDWIRGLDGQLIKISNDLDEFLERVVQDHVDGDGHKNDFVDFLLTIEREKSVGFEIDRLSIKAIILDVFVGDMDTTYTLLEWAMTELLCHHECLDRLQEEVRMVCKDKSGVSEDDLQDMKYLKAVIKETLRLHPPLPLMVPHESTHDVKLRDYHIPAGTHVMINAWAIGREAATWGPDAEEFRPERHLNSYVDYRGQDTELVPFGAGRRICPAISFAVVLDEVVLANLVHQFDWTLPEESTEYQTDVAESTGMAVHRMFPLFAMTT

SEQ ID NO: 28369 - protein, 402 aa, Saccharomyces cerevisiae
MFKLTSRLVTSRFAASSRLATARTIVLPRPHPSWISFQAKRFNSTGPNANDVSEIQTQLPSIDELTSSAPSLSASTSDLIANTTQTVGELSSHIGYLNSIGLAQTWYWPSDIIQHVLEAVHVYSGLPWWGTIAATTILIRCLMFPLYVKSSDTVARNSHIKPELDALNNKLMSTTDLQQGQLVAMQRKKLLSSHGIKNRWLAAPMLQIPIALGFFNALRHMANYPVDGFANQGVAWFTDLTQADPYLGLQVITAAVFISFTRLGGETGAQQFSSPMKRLFTILPIISIPATMNLSSAVVLYFAFNGAFSVLQTMILRNKWVRSKLKITEVAKPRTPIAGASPTENMGIFQSLKHNIQKARDQAERRQLMQDNEKKLQESFKEKRQNSKIKIVHKSNFINNKK

SEQ ID NO: 28370 - protein, 249 aa, Arabidopsis thaliana
MYPCGYVAQVTNLSPQATEKDVHRFFSHCGIVELVEITGCQGDAITAYVTFRDAYALDMAVLLSGATIVDQTVWISVYGVYLHESNNLRQEEDYSVTVTRSDAFASSPGEAITVAQQVVQTMLAKGYVLSKDAIGKAKALDESQRFSSLVATKLAEISHYLGLTQNIQSSMELVRSADEKYHFSDFTKSAVLVTGTAAVAAATITGKVAAAAATSVVNSRYFANGALWFSDALGRAAKAAAHIGGGGSN

SEQ ID NO: 28371 - protein, 775 aa, marine gamma proteobacterium HTCC2207
MLASLRNIVQEVNSARSLGEVLTIIVKEVRSAMQAGVCSVYLFDESDQRYVLMATEGLRQESIGQVRLAMREGLVGLVAAREEPLNLEDADKHPSFAYFEETGESPFHSFLGVPIIHHRKVLGILVLQQETQRRFETEEEAFVVTVCAQLSGAIAHAEATGALRQLASAGGDRLREAIFCGIPSSPGVGIGRVVLAAPSADLQSVPERFAADIPAEIEIFRTALESAKDDMRNLSKGLEGKLSSEEIALFDIYIRMLDDHSLGGEVIAAIVDGQAAQSAWSSVILKHVRTFRKMEDPYLRERAADVNDLGRRVLGYLQRNEKNIQPLPRRIILVGEDLSASALADIPVDRLVGIVSVKGSSNSHMAIVGRALGVPTVMGAVDLPWTEMEGHELIIDGFSGDVISRATRSMRRAYLHRQRQETLLAKDLESLRDIPCVTPDGFSMALWINTGLRQDIALALKSSAEGVGLYRTEIPFFTRSSFPTEDEQTEIYREQLQAFAPNPVTMRTLDIGGDKALPYFPIEEENPFLGWRGIRISLDHPEIFLIQVRAMLRASEGLNNLRIMLPMISSVPELDSAMELIDRAYRELIQEEGYQLEKPAIGAMIEVPAAVYQVKEIGRRVDFLSVGTNDLTQYLLAVDRNNPRVADLYHSLHPAVLRALKSIIEQADAVNCQISVCGEMAGDPLSVVMLMGLGYDHLSMSANSLLKVKSMLSQVSKTEARRLAKRALRMSDASSVSQLLSDALSRPELSKLYRPAELDEKAGFSGSSSSLKQIK

SEQ ID NO: 28372 - protein, 254 aa, marine gamma proteobacterium HTCC2207
MCLLAIAFNHHPDTSLAVCSNRDEFYQRPTLPMHWWQDMPVLAGRDEQQGGTWMGLSRNGRFAAVTNFRDFSKPGFHEARPKSRGNLVTDFLCSQASAKDWADSVLEDFDVYGGFNLLIYDGEQLLYLNNFNHQVRSLEPGIYALSNHLLDSPWPKVDYARRQLKETLSKRGSNQQLAEDLLGLLEQNQTYPDHLLPSTGVPADWERRLSSAFIVAEDYGTRAATSIVLSSSGSSIAEQTYIKGVAERHEIFTF

SEQ ID NO: 28373 - protein, 137 aa, Leptospira interrogans serovar Lai str. 56601
MSRTFIMIKPDGVKNKHVGNILSRIEKEGFKILGLKYLKLSLEDAKQFYKVHSARPFYNDLCNYMSSGPIVAAALERDNAVLHWREVIGATDPKEAAAGTIRALYAESKEANAVHGSDSDDNAALEISFFFKGNELF

SEQ ID NO: 28374 - protein, 522 aa, Arabidopsis thaliana
MVVSADCRISLSAPSCIRSSSTGLTRHIKLGSFCNGELMGKKLNLSQLPNIRLRSSTNFSQKRILMSLNSVAGESKVQELETEKRDPRTVASIILGGGAGTRLFPLTKRRAKPAVPIGGAYRLIDVPMSNCINSGINKVYILTQYNSASLNRHLARAYNSNGLGFGDGYVEVLAATQTPGESGKRWFQGTADAVRQFHWLFEDARSKDIEDVLILSGDHLYRMDYMDFIQDHRQSGADISISCIPIDDRRASDFGLMKIDDKGRVISFSEKPKGDDLKAMAVDTTILGLSKEEAEKKPYIASMGVYVFKKEILLNLLRWRFPTANDFGSEIIPFSAKEFYVNAYLFNDYWEDIGTIRSFFEANLALTEHPGAFSFYDAAKPIYTSRRNLPPSKIDNSKLIDSIISHGSFLTNCLIEHSIVGIRSRVGSNVQLKDTVMLGADYYETEAEVAALLAEGNVPIGIGENTKIQECIIDKNARVGKNVIIANSEGIQEADRSSDGFYIRSGITVILKNSVIKDGVVI

SEQ ID NO: 28375 - protein, 362 aa, Oryza sativa (japonica cultivar-group)
MAGGVSSVEVVKDGATGLEKLVLREAHGCSVQVDPLSSTLAFSCNVDKLFIGGGHHDAIVSCGFDWPFAIILSILGNVILDNLTGSLLSFFFLRNGQVFLYGGQVIFWENEYREQLLFVSRKFGNHGVLEQHGFARNRLWSVDETPPPFPATTSNCHIDLILKQSPEDLKIWPHSFEFRLRVALSPTGDLMLTSRIKNTNADGKPFKFGFSYNTYFSVSDISEVRVEGLETLDYIDNLQCGKRCTEQGDAVVFESEAEKVYLSAPPKIVIIDHDKKRTFELRKEGLPDVVVWNPWDRKAKTILDFGEEEYKCMLCVGAANAEKPITLRPGEEWQGRQEISVVPSSYSSGQWDPEIIHRIQDI

SEQ ID NO: 28376 - protein, 278 aa, Myxococcus xanthus DK 1622
MDASRDRAALARAGNPRNNDAVRKYVAEFIGTFVLVLGGVGAAVLAGDHIGFQGVALAFGLSLLAMVYVIGPISGCHVNPAVTLGLLLSGKMEGKDAVGYVVAQCAGAILGAGVVLLIAKGMPGGYSAVTEGLATNGYGAASPDGFNMGAAFLTEVALTFLLVLTVLGATDARAPVGFAGLAIGLVLALIHLVGIPVTNTSVNPARSLGPAVFAGSVPMGQLWLFIVAPLLGGATAAAVYRTVFRPAVPISAEEAERALRREREARIAEDRAGTRAPV

SEQ ID NO: 28377 - protein, 141 aa, Zea mays
  misc_feature (52)..(52): Xaa can be any naturally occurring amino acid
  unsure (1)..(141): unsure at all Xaa locations
MALAEADDGAVVFGEEQEALVLKSWAVMKKDAANLGLRFFLKVFEIAPSAKXMFSFLRDSDVPLEKNPKLKTHAMSVFVMTCEAAAQLRKAGKVTVTGFALLETIKEALPADMWSLEMKKAWAEAYSQLVAAIKREMKPDA

SEQ ID NO: 28378 - protein, 745 aa, Saccharomyces cerevisiae
MSHTNKIAYVLNNDTEETASPSSVGCFDKKQLTKLLIHTLKELGYDSAANQLLLESGGYQNESNHIQTFFKLIKTGQFHLINWQIVCSLPLAHSSPLRSEWLQRLLIPTPTPATTSLFDHMLLQLQYLQQLMSSVNSSTCSDAEIATLRNYVEIMILVNRQIFLEFFHPVTNSASHKGPHTALPVLYLRKILKNFIEIWDSLLVSNDQFLNEENIFNPETTLRELSTYLTNPKLTAQLNLERDHLIDAISKYIDPNELVPKGRLLHLLKQAIKYQQSQDIFNIIDPDDDASFSSPPHRINLLQDNFSHDLTVTFQEWKTIQDTTDEIWFLTFSPNGKYLASATSESSRGYFITVYDVEQDFKIYKTCVSLSQSVLYLMFSPDSRYLVACPFSEDVTIYDMNATSLPDASATDSFLLYPSTRLSPMDSFKLDTTTYPDDTESSASSSSRPANANSNQSRVWCCDAFHTAERAGWMVVGSPDREAIVHSLTTKESLFSLKGRTCIALGHDENISGRKSIDPAKVLYKPTSSNGNWQYVEDDETFPRVHDVKISYDDKYVLLMTHQGVIDVYDFSGFPSKEELSKQTVDPKNFLIPRIARLDVGKNMTCISLPLNTTHQGFHRQQISESQHLVLVSLQDNELQMWDYKENILIQKYFGQKQQHFIIRSCFAYGNKLVMSGSEDGKIYIWDRIRGNLVSVLSGHSTVMSNSTKPMGKNCNVVASNPADKEMFASGGDDGKIKIWKISRN

SEQ ID NO: 28379 - protein, 477 aa, Rhodococcus sp. RHA1
MTVDSSHEQLNEDGLAQGLNKRHIRMIAIGGAIGVGLFLGSGKGISYAGPALVGVYAITGVFIFIIMRALGELLMYRPVTGSFAEYAREFLGPVYGFITGWGYWITWTIIGMAELTAAGIFVRFWFPSMPQYLTALIALIALVTLNLAKVGFFGEAEFWFASIKVITIVALIAGGIFALVFNVGKAGQEGGIANLWDHGGIAPHGLLAVLLAFQIVVFSYQGVELIGMTAAETKNRATVLPKAINSIPWRIGIFYVGTLVVLLSLFPWDQFNADSSPFVKGFTQIGLPAAASIMNFVVLASALSSCSAGLFSNGRLLKKLAADGVAPKMFEKTNRGHVPAAAIIASGSLMLVSVAINAIVPEQAFSYISSVATLGAIWSWGVIVACHLVYRRRVERGEVPASTFRLPLATPLCWATLAFLAAVTVLLAFDEGQRIALYALPIWAAVLLTGYYLSARRTASPVAPSPATENDRPALHP

SEQ ID NO: 28380 - protein, 110 aa, Saccharomyces cerevisiae
MVSQETIKHVKDLIAENEIFVASKTYCPYCHAALNTLFEKLKVPRSKVLVLQLNDMKEGADIQAALYEINGQRTVPNIYINGKHIGGNDDLQELRETGELEELLEPILAN

SEQ ID NO: 28381 - protein, 717 aa, Rhodococcus sp. RHA1
MTSPAAPAASPRHRVVVIGSGFGGLFATKALRRADVDLTIVDRTTHHLFQPLLYQVATGILSEGEIAPSNRMILEDQPNATVLLGDVSTVDLTAQTVTSVQDGRTTVTGYDSLIVSAGAQQSYFGNDHFAEHAPGMKTIDDALELRGRILGAFERAEICSDPPERAKLLTFVVVGAGPTGVEMAGQIAELAHRTLVDVYRNFDTRDARIILLDAAPTVLPPFGLNLGNKAAAALEELGVEIQLGTMVTDVDADGLTVRDSDGEHHRIDAACKVWSAGVAANPLGAQLAAQSGADLDRAGRVTVEDDLTLPGHPNVFVVGDMMAKDRLPGVAQVAIQGGRYAAQQIKTELTAATKDRTTSERAPFRYRDKGSMATIARFKAVTKVGNPELTGVLAWILWLAVHVVYVVGFRSRLATLISWTCTFLGRWRGQLTITDQQITARNAIAQLHLINNGHDDADDPIAKAGADFLGDAFAPETPPSPSPSRGKKRSAGIGGGVTGFVARCRWLGPGVVEIVRLVLALGSAHRCGLEALADEHVSVPTDKGACGQGVRTGGRNGCGRGQHRRHGSAAARSPPHGLRPPVCPVDAGLVPAVVHLRARPPTRRRSHPLPVWLWPNGHSACTTGSPVAGFPIRGLGTSEKRHPSAHRFEGAAAIEPTSATQNRRLPHLPAENDPLSGTGSPDSAPHRSNVSHTDRRSGCNRVECAESTVRIRSRPSR

SEQ ID NO: 28382 - protein, 507 aa, Arabidopsis thaliana
MGSKKKCFDGSRDGISGLPDAMICHILSFLPTKVAASTTVLAKRWKPLLAFMPNLDFDESFRFDPRMTCEERRKGSESFMLVVDSVLALQAEANATLNKFYVKCEGVEQNSVLEWIPKVLKRGVLDIDLQIPSSRGFGSNSTFYPLPSEIFVSKTLVRLKIQFQDGANVNVEGDVSLPMLKTLHLDYVKMDTRMLQKLLSGCHTLEELLLMNLIWKESSEPEPCFVSVSVRTLKILKFSRFENFMKAKDFKPIVLLSFDIPNLVYLEYLDTIADKYEQVRFDSLVKASIGLCKTSKQIENDNNNVTKLFMGICNVTILYLTEDTLKVLGCCRETMPVFENLIHLTIRTGVHIGWKSLPHLLKNCPNLQTLVFEGMHHIYRKGRACGDVDEDGTCMCKNLDNMRVKKDIDACLSSSPVKVIKILNFGELCGFCEFCDVEEDVAGQIKQVKQFLETMPDLEKVILYYNTPEDEDVMKVFKKLKKLPRVASAKCEVQIISDNINLSFTFR

SEQ ID NO: 28383 - protein, 483 aa, Pyrococcus horikoshii OT3
MITMKIEDVYIWDINARWLGVTPYQLMENAGASVARVIEEKFGKNLKIAVFCGTGNNGGDGFVAARHLSYENDVTVFLIGEEVKIRSEEAKLNWNILKNLDFVKIKVLKDSSQIRELDLSEFDIIVDALLGAGTRGKPREPIKSAIEKINEYSGKVKIVSIDLPSGYPSEIRVKADFAVTFQWDKEEFKDFKRIIAKIGYPKELKYLVGPAHVKFAYKRKGEHKGQNGKLLIIGGSENYYGAPVLAASAAKHLVDLVFLLLPQNAARRVNDPDLIVREVDGLNFTPEHIKSALELVEKVDAIVIGPGIGVREETKEFVKGIIERVEKPIVVDADGLKIIAEFKDILKGKEIVLTPHAGEFKLLFGEKVPEDLVEKGKVVMRRAKEIGATILLKGKYDVISDGKVWLYNKTGNRGMTTGGTGDVLAGTVGAFLALGNKALKAAAAGAFLVGFAGDLVMEEKGEAFTARDVAEKIPIALKKIIEF

SEQ ID NO: 28384 - protein, 426 aa, Podospora anserina
MLPSRGILRSTPSLGLARKSSSSRISTRQFGTALRSNGSLPQTPRTVLSGSRIGGPAAFTAVRYASTQPAVAPTPAPAAAAAPVVDPIASPSVLSDIDTTPVSLSGSDLLNMPEQIGFLKNLGLDYGFGPTALMEWILEHTYIYTGLPWWASIGLVSLAIRAVLVKPMFTAAEMAQKLQDLKRDPKYEQLEKEVMSAFQGGQADQYAMLDKRNKMKAMRRAVGYKMLPASVPALVQIPVGFGMFRLIRGMADLPVPSMETGGALWFNDLTVSDPLFILPIVGAGLMIASMRVPLPYMASSQQGTMKIMTMVAAPITLGVSIFLPAGLQLYFAISTFLQFGQQWLTYQNWFRKMIGLRPVVFGGHHRSPIGGAYQAPRTLDTKGTVVPQKETLFESLKSTKAAAQQKLEQWQDNSTHKATFAPPPRV

SEQ ID NO: 28385 - protein, 450 aa, Geobacter metallireducens GS-15
MSPQLIDERLAGIYQDVLKRNPGEVEFHQAVAEVLESLGPVVTKHPEYLERKIIERIAEPERQIIFRVPWQDDKGQVHINRGFRVEFNSALGPYKGGLRFHPSVYLGIIKFLGFEQIFKNSLTGMPIGGGKGGSDFDPKGKTDDEVMRFCQSFMTELYRHIGEHTDVPAGDIGVGGREIGYMFGQYKRITNRWEAGVLTGKGLKFGGSLVRPEATGYGATYFINEALKVRKDSFDGKTCLVSGSGNVAIYTIEKIHQLGGKCIACSDSNGVIIHEKGLDVELIKQLKEVERRRIADYATYHKDAKYIANGNIWDIPCQVAMPSATQNEINGKDAKTLVKNGCIAVGEGANMPTTPEGIKVFIEAQIAYGPGKAANAGGVATSALEMQQNAQRDSWSFEETEKKLEKIMVGIHKLCYETAEEYGDKGNYVTGANIAGFIKVADAMVAHGLV

SEQ ID NO: 28386 - protein, 257 aa, Triticum aestivum
  misc_feature (155)..(155): Xaa can be any naturally occurring amino acid
  unsure (1)..(257): unsure at all Xaa locations
QVCTKKQAGTGPESRGYRRPTRPKLRRTHTQAHSIQGSRRSRFEKPAWASAEEEDLPATDMPRVVGVLSALLERVTERNDAATGPGALEPASGSAFRAMTKPGISVRAYMARIARFAGCSPACFVVGYIYLDRLLRRRRALAVDSYSVHRLLITXVLSAVKFMDDICYNNAYFAKVGGISLPEMNYLEVDFLFGVGFDLNVSPETFGHYCAILQSEMLCLELGPEVPSSGLPASPRSRRRMHCCLSEDDGTSRHHQQ

SEQ ID NO: 28387 - protein, 1076 aa, Archaeoglobus fulgidus DSM 4304
MPKREDIRKIMVIGSGPIVIGQAAEFDYSGSQACKALREEGYEVVLVNSNPATIMTDPEMADRVYIEPLDAEIVAKIIERETPDALLPTLGGQTALNLAVQLTEMGVLDKYGVELIGAKFEAIKKAEDRELFKEAMRKIGLDVPKSDVAHDVSEALAIADEIGYPVVVRPAFTLGGTGGGIAYNREELREIAERGIKMSMINQVLIEEGVLGWKEFELEVMRDLADNVVIICSIENFDPMGVHTGDSITVAPAQTLTDVEYQYLRDAAIKIIREIGVETGGSNIQFAVHPENGRVVAIEMNPRVSRSSALASKATGFPIAKIAAKLAVGYTLDEIPNDITKETPASFEPTIDYVVVKIPRFAFDKFPTANQVLGSQMKSVGEVMAVGRTFEEALQKAIRSLEIGRYGLGCDGKDKEVTMEEIRERLRYPNASRVFYIRYALQKGMSVNEIYELTKIDPWFIDKIKNLVEFEEQLKQIAERMSIEEVPKEILKKAKELGYSDRQLAVIFNTTEREVRRVRKGKGLRVVYKMVDTCAAEFEAKTPYYYSTYEDENEALRSERKKVMILGAGPNRIGQGIEFDYCCVHAVFSLKDEGYETIMVNCNPETVSTDYDTSDRLYFEPITHEDVMNIYENEQPEGVIVQFGGQTPLNIARELEDSGARILGTSVDSIDIAEDRERFAELLERLNIPQPENGIAHSLEEAKEIARKIGFPVLVRPSYVLGGRAMEIVYDEETLERYITEALEVSPEKPILIDKFLEDAIEVEVDALCDGEEVVIGGIMEHIEEAGVHSGDSACVLPPVSLDEVTINTIVDYTRKLALALNVVGLINIQYAVKDGKVYVLEANPRASRTVPFVSKATGIPLAKIAAKLMMGKKLRELGVKEKLKLKHVAVKEAVFPFIKLPGVDPVLGPEMKSTGEVMGIDYDFGLAYYKAELAAGMKLPLKGTVFISVRRKDKNDRLLYLARKFKELGFRIIATDGTRDFLVQNGIEADLILKISQGRPNILDAIVNGQVDLIINTPSGKRGRTEGYMIRRAAVDYGVAHITTLAGAMAAVRAIEAVKSRKMVVKSIQEYHEES

SEQ ID NO: 28388 - protein, 363 aa, marine gamma proteobacterium HTCC2080
MSKLTAQDSTEHETVITTKDADSGLTAIIAIHNTQLGPAVGGCRMFPYAQEAHALRDALRLSRGMTYKSALAGLPFGGGKSVILGDPRREKTPALLRAMGAFVDMLAGRYIIAEDSGTSPDDMRVVAETTRHVTGINAQKREDPSPATAHGVFLGIIAGIRQVFGTECLAGRSVAIQGLGHVGYHLAKNLTNAGAKVYGSDINVDNLRRAKDDLGLTAVSPDEILCQPCDVLAPCAMGAVLDESSIAKLQTQIIAGAANNQLATTEDDERLRARNIVYCPDFAINAGGIIDIHHQQHNACSDTRAAALEHIGHNVANILERAQDRAVGTQQIAIAMAEEQLRASSQTNPHDSKQLLCSPGVSR

SEQ ID NO: 28389 - protein, 1039 aa, Oceanospirillum sp. MED92
MLSVEELLSNEFSPAQQSEIWQTISDYYCHSENSLVDQLLISAPKSTQAQQNARNWIEEIRSLPHDLLSVNDLMSRFGLNSDEGIALLSLAEALLRIPDADSAESLIEDKLERLIPEKLLSDPQIDLIGNTTLWGIALSQQLISTDVSSANLTQRLIQKLGNQSVHKAISYAMKILGNQFVFAETIQDALRSRCDYSIDNTAFSFDMLGEAAICDSDVDYYFKAYLEAIQAAGEQNHDQNTSISIKLSALHPRLENAHLEEIQRSLFNRLLQLLATARQLDIAITIDAEESERLELSLLIFEQLLRSELCSGWGKLGLAVQAYSKRALPVLRWLSLLAEDCDTQIPVRLVKGAYWDSEIKKAQQAGIEDYPVYTSKSATDLSYLICSRFLLSAQSPLLLPQFATHNALSIAQILETDSDKSFEFQRLHGMGDSLYALILRSLPYKCRIYAPIGNQSSLLPYLVRRLLENGANSSFVFQINDSDIPLEEITRSPQEILRSIVSPVIKKPNAIYLPVRDNSQGENLGSLDTWEAWKTTINHYKTKQWYCQPIIDGEISEGVQLQPIYPSYQLDRTLGYYSGASIEQIKQALSIAEYSLPQWRNSPLSQRCDMLRTYAQTLQNNKAELTCLLMYEAGKTLRDALNEIREAIDFCYYYANLAEQSLHAETLVSVTGEKNTLSYQGQGTFLCISPWNFPLAIFTGQIAAALVCGNTVIAKPASVTSLIAFRATELWYTAGLPGYALQLLPFQRGEQAEAVLKDSRIAGVAFTGSTQTAMALQQQLASRGDGAISKLIAETGGINAMIADSTALPEQVILDVIQSAFNSAGQRCSALRVLYVQEDIAEQIERRLVGAMDTLVIGSPEKLNTDIGPVINKAAMDRLFDHIELCRAQNKLIHELPLQEQHNQGYFVPPTLIKLHSIDELPDEVFGPVLHIIRYAREDIDRVINEINRSGYGLTFGIHSRNDHFINKVIAGIEAGNIYINRDQVGAIVGSQPFGGIGLSGTGPKAGGPNYLKSFSREMTVSRNTTAQGGNRELLSRKS

SEQ ID NO: 28390 - protein, 391 aa, Mycobacterium tuberculosis H37Rv
MRKLGPVTIDPRRHDAVLFDTTLDATQELVRQLQEVGVGTGVFGSGLDVPIVAAGRLAVRPGRCVVVSAHSAGVTAARESGFALIIGVDRTGCRDALRRDGADTVVTDLSEVSVRTGDRRMSQLPDALQALGLADGLVARQPAVFFDFDGTLSDIVEDPDAAWLAPGALEALQKLAARCPIAVLSGRDLADVTQRVGLPGIWYAGSHGFELTAPDGTHHQNDAAAAAIPVLKQAAAELRQQLGPFPGVVVEHKRFGVAVHYRNAARDRVGEVAAAVRTAEQRHALRVTTGREVIELRPDVDWDKGKTLLWVLDHLPHSGSAPLVPIYLGDDITDEDAFDVVGPHGVPIVVRHTDDGDRATAALFALDSPARVAEFTDRLARQLREAPLRAT

SEQ ID NO: 28391 - protein, 949 aa, Arabidopsis thaliana
MRLRHQGGQYLARGMEPVYWSNKVDSTHDLYDNYTLGSYQNNSYNILAHTGFGYDHEFQIYEINSNSWRIIDATLDFKLGYIGRGVSLKGKTYWIASGEEEKRLGKFLISFDYTTERFERLCLPNKYPCYATLALSVVREEKLSMLSQRGIKSKAEIWVTNKIGETQVVSWSMVLALDLQPKRCIGESGSFLVDEKKRVVVCCDNIRDQGKTTFDSNLPRYHRQKKKGRMIIVFDVESMRLPVTVKATKPSFLVIWIRYSSAASSPTVSLNPSGRLQQTLAGSVEVKGKSLHSGKFSTVKLNPEIAGAGRFFEFRSRFIPASIEFAQESPLCTTLLKDELKIRTVEHLLSALEAKGVDNCRIQIESESSDDREVEVSKEWVDAIQGVGINAAQNHDGESVEKMVAHVNKPVYVCKNDTFVAAFPALETRITCGIDFPQVPAIGCQWFSWRPIHESSFAKDIASSRTFCVYEEVERMREAGLIKGGSLDNAIVCSAEHGWMNPPLRFDDEACRHKILDLIGDLSLVSRGGNGGLPVAHIVAYKNEEEEVRSSTEENENVRSSTEENEYVRSSTEAGRGEDPHEDSDNISESGAIHLQIMERFNQRSGSGKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 28392 - protein, 899 aa, Nocardia farcinica IFM 10152
MTINRSRTGELARFSQELSFDLDPFQREACQALEAGHGVLVCAPTGAGKTVVGEFAVHLALVSGGKCFYTTPIKALSNQKFADLTRRYGRASVGLLTGDQSINPDAPVVVMTTEVLRNMLYASSDALRGLSYVVMDEVHYLADRFRGAVWEEVILHLPADVRLVSLSATVSNAEEFGAWMETVRGDTAVVVDETRPVPLWQHVMVGRRMFDLFDTKSSDQKVIVDEDLVRYIRHREQADRINGWGGPRGRGGPRRDFRPLPRPEVLARLDEEGLLPAITFIFSRAGCDGALAQCLRSRLDLSRPEDADEIDAIIEKHTGELPKSDLEVLGYWEWREALHRGLAAHHAGMLPAFRHTVEELFVRGLVRAVFATETLALGINMPARTVVLERLVKFNGESHAELTPGEYTQLTGRAGRRGIDVEGHAVVLWQPEVDTSAVAGLASTRTYPLRSSFRPGYNMSINLIDRMGAAEARALLERSFAQFQADRSVVGLVRGIERNEAQLARLRDQLGGAEGGFLDYIALRERIKQRERQLAQQSRADRRGAAVRALTTLRRGDVVAIPSGRRAGLAVILEPDATPHDPRPLVLTEDKWAGRVSVADFPVPAEALGHMRLPRRVDHRTARARRDLASALRSTGITAPGRQRRGRHSDAAEDRELATLRRTLRAHPAHSRPDREQLSRIGERYNRMLRETETMRQKVAATTNSLARTFDRILGLLEERGFVHEGEVTADGRRLARIYAESDLVVAECLRRGVWRGLGPAELAGVVSVLVYESRQEGGYLGPAGPTPPVRRAVGATVDVWSELRTDEARHKLPPTREPDLGFVTGVYKWARGDGLAEALLAGGDQGVPLSAGDFVRWCRQVIDLLDQIQGTADDTEVASTAAKAVRAIRRGVVAVDAA

SEQ ID NO: 28393 - protein, 476 aa, Humicola grisea var. thermoidea
MSLPPDFKWGFATAAYQIEGSVNEDGRGPSIWDTFCAIPGKIADGSSGAVACDSYKRTKEDIALLKELGANSYRFSISWSRIIPLGGRNDPINQKGIDHYVKFVDDLIEAGITPFITLFHWDLPDALDKRYGGFLNKEEFAADFENYARIMFKAIPKCKHWITFNEPWCSAILGYNTGYFAPGHTSDRSKSPVGDSAREPWIVGHNILIAHARAVKAYREDFKPTQGGEIGITLNGDATLPWDPEDPADIEACDRKIEFAISWFADPIYFGKYPDSMRKQLGDRLPEFTPEEVALVKGSNDFYGMNHYTANYIKHKTGVPPEDDFLGNLETLFYNKYGDCIGPETQSFWLRPHAQGFRDLLNWLSKRYGYPKIYVTENGTSLKGENDMPLEQVLEDDFRVKYFNDYVRAMAAAVAEDGCNVRGYLAWSLLDNFEWAEGYETRFGVTYVDYANDQKRYPKKSAKSLKPLFDSLIRKE

SEQ ID NO: 28394 - protein, 556 aa, Oceanospirillum sp. MED92
MTAETDFLKKLQGEIDSCNSLVELWREACQEFAFKDAFTNMGASLTYAELDHYSDHLASYLQNCTDLKAGDRIAIQLPNTLQFPVAVLASIKAGLVVVNTNPLYTADETTQQFNDAGVKAVIVLANSAYLLEKVLPITSLETVIVTQLGDLHPFPRRQAINFAAKYVRKIVPRYRLKGAVKLRDALTRGAKLELKPIECSVNDPALIQYTVGTTGQPKGAVLSHRNLISNVMQIKGRLPESLRIGEEIAIAPLPIYHIYGFILNCLVMPMMGAQVVLITNPRDTSGFVNELGRWDFTVFSGINALFVSLCRNAAFSQLDMTRLKLTLSGGGALTKAMSDEWERITGCPIVQGYGLTEASPVVSVADIHQPFGSVGQPLPLTEVKIVGEQGEDLCSGETGELYVKGPQVMQGYWETNDKIPDSEGWLATGDIARLADDGSIRIVDRKKDIINISGFPVYPNELENIISSHPDVIECAVIGLPDDCSGEVVKLFVVTSNHRLSVKQVRDYCRERLTSYKVPRLVEFRTHLPKSNVGKVLRRTLLEEELNRLQKQRKRI

SEQ ID NO: 28395 - protein, 267 aa, Thermotoga maritima MSB8
MGSDKIHHHHHHMKEVFDLRGRVALVTGGSRGLGFGIAQGLAEAGCSVVVASRNLEEASEAAQKLTEKYGVETMAFRCDVSNYEEVKKLLEAVKEKFGKLDTVVNAAGINRRHPAEEFPLDEFRQVIEVNLFGTYYVCREAFSLLRESDNPSIINIGSLTVEEVTMPNISAYAASKGGVASLTKALAKEWGRYGIRVNVIAPGWYRTKMTEAVFSDPEKLDYMLKRIPLGRTGVPEDLKGVAVFLASEEAKYVTGQIIFVDGGWTAN

SEQ ID NO: 28396 - protein, 466 aa, Hypocrea jecorina
MLPKDFQWGFATAAYQIEGAVDQDGRGPSIWDTFCAQPGKIADGSSGVTACDSYNRTAEDIALLKSLGAKSYRFSISWSRIIPEGGRGDAVNQAGIDHYVKFVDDLLDAGITPFITLFHWDLPEGLHQRYGGLLNRTEFPLDFENYARVMFRALPKVRNWITFNEPLCSAIPGYGSGTFAPGRQSTSEPWTVGHNILVAHGRAVKAYRDDFKPASGDGQIGIVLNGDFTYPWDAADPADKEAAERRLEFFTAWFADPIYLGDYPASMRKQLGDRLPTFTPEERALVHGSNDFYGMNHYTSNYIRHRSSPASADDTVGNVDVLFTNKQGNCIGPETQSPWLRPCAAGFRDFLVWISKRYGYPPIYVTENGTSIKGESDLPKEKILEDDFRVKYYNEYIRAMVTAVELDGVNVKGYFAWSLMDNFEWADGYVTRFGVTYVDYENGQKRFPKKSAKSLKPLFDELIAAA

SEQ ID NO: 28397 - protein, 183 aa, Brassica napus
MSQLGDLLRESADETRSGRTVMLSLLEEDRIDGEDRATSKWSTLKQRLRFDWVGCCGGPTLLRLRGSEAPVAEEDEDDEEEEETSGQNRVVNLSNSVRDPGLVVDTECLTRGTRNLAEALAEERLARGENVTEASVAKVPLMKLFAETEGCDATTWTGADPLCCVCMGREKGAAFIPCGHTYC

SEQ ID NO: 28398 - protein, 444 aa, Cryptococcus neoformans var. neoformans JEC21
MSVVTKVHARQIFDSRGNPTVEVDLYTEKGLFRAEVPSGASTGAHEAVELRDKGSDYMGKGVLKAVENVNKVIAPALIDSKLPVTSQKEIDDLLIKLDGTENKGKLGANAILGVSMAVSEAAAADKGVPLYGYLAQLAGVSEPYVLPVPAFNVINGGSHAGNALAFQEFMLLPTGASSFTEAMKMGSETYHTLKKVITKKYGIDAANVGDEGGFAPNVSGAEESLDLLTEAIKQAGYTGKVQIGLDVASSEFFKEGKYDLDFKNPNSDSSKWLSGKELADLYHGYCEKYDICSIEDPFHEDDFDAWAAYNQTAKIQIVGDDLLVTNPRRIKMAIEKKACNALLLKINQIGTISESIQAVQLAQSNGWGVMTSHRSGETESTYIADLAVALRTGEIKTGAPCRSERMAKYNQLLRIEEQLEGKSIFAGGKGLSKGTTAPELHSSK

SEQ ID NO: 28399 - protein, 467 aa, Streptococcus pneumoniae R6
MESKMNIFRTKNVSLDKTEMHRHLKLWDLILLGIGAMVGTGVFTITGTAAATLAGPALVISIVISALCVGLSALFFAEFASRVPATGGAYSYLYAILGEFPAWLAGWLTMMEFMTAISGVASGWAAYFKGLLSQYGIALPQALNGTFNPQAGTFVDLLPILVLVLVTSLVLLNAKAALRFNSILVILKFSALALFVLVGIWNIKFDNWSNFAPYGFGQIYGASTGIMAGASLMFFGFLGFESISMAVDEVKTPQKNIPRGIVLSLSIVTILYALVTLVLTGVVHYSHLNVDDAVAFALRSVGISWAANYVSLVAILTLITVCISMTYALSRMIYSLARDGLVPAAFKELTKTSKVPKNATILTGLASAVAAGMFPLASIAAFLNICTLAYLILLAYGLIRLRKEKGMPKAGEFKTPLVPLLPILSIIICLSFMLQYNVNTWIAFLVALLVGSIIYFTYGYKHSTIEE

SEQ ID NO: 28400 - protein, 523 aa, Solanum lycopersicum
MAGGGFTTSGNGARISRLKSHQLVIISCIMAATGGLMFGYDVGVSGGVTSMDPFLKKFFPTVYKRTKEPGLDSNYCKYDNQGLQLFTSSLYLAGLTATFFASYTTRKLGRRLTMLIAGCFFIIGVVLNAAAQDLAMLIIGRILLGCGVGFANQAVPLFLSEIAPTRIRGGLNILFQLNVTIGILFANLVNYGTAKISGGWGWRLSLGLAGFPAVLLTLGALFVVETPNSLIERGYLEEGKEVLRKIRGTDNIEPEFLELVEASRVAKQVKHPFRNLLQRKNRPQLIISVALQIFQQFTGINAIMFYAPVLFSTLGFGNSAALYSAVITGAVNVLSTVVSVYSVDKLGRRVLLLEAGVQMLLSQIIIAIILGIKVTDHSDNLSHGWGIFVVVLICTYVSAFAWSWGPLGWLIPSETFPLETRSAGQSVTVCVNLLFTFVMAQAFLSMLCHFKYGIFLFFSGWIFVMSLFVFFLVPETKNVPIEEMTERVWKQHWLWKRFMVNEDDVDMIKKNGHANGYDPTSRL

SEQ ID NO: 28401 - protein, 141 aa, Burkholderia thailandensis E264
MALERTLSIIKPDAVAKNVIGQIYSRFENAGLKIVAARMAHLSRADAEKFYAVHAERPFFKDLVEFMISGPVMIQVLEGEDAILKNRDLMGATDPKKAEKGTIRADFADSIDANAVHGSDAPETARVEIAFFFPEMNVYSR

SEQ ID NO: 28402 - protein, 297 aa, Bacteroides thetaiotaomicron VPI-5482
MIQTKLKGMGVALITPFKEDESVDYDALMRLVDYLLQNNADFLCVLGTTAETPTLTEEEKKTIKKMVIDRVNGRIPILLGVGGNNTRAIVETLKNDDFTGVDAILSVVPYYNKPSQEGIYQHYKAISEATELPIVLYNVPGRTGVNMTAETTLRIARNFSNVIAIKEASGNITQMDDIIKNKPDNFNVISGDDGITFPLITLGAVGVISVIGNAFPREFSRMTRLALQGDFANALTIHHRFTELFDLLFVDGNPAGVKSMLNAMGMIENKLRLPLVPTRITTFEAIRKVLNELNIKC

SEQ ID NO: 28403 - protein, 69 aa, Brassica napus
MASNDAGRPLPKFGDWDVNDPATADGYTVIFSKAGEDKKTGRSSTKTNSQRKQDGDKPAVKKWLCFTFS

SEQ ID NO: 28404 - protein, 298 aa, Agrobacterium tumefaciens str. C58
MMTKKAFVAIVTCFNDDETINYEATRAQVRRQVTAGNNIMCAGTNGDFTALTHSEKIRILEEVVDEVGGKVDVIVNAGMPATFETLQLAKEFDRIGVKGIAVITPFFIACTQDGLIRHFSTVADEVNTPVYLYDIPARTQNHIEPETARKLATHGNIAGIKDSGGAQETLEAYLQVSKEVDGFEVYSGPDHLVLWALQNGAAGCISGLGNAMPDVLAGIVNGFNSGDITYAERQQSVYTAFRTDLYAHGFPPAMVKRALYLQDPSVGASRQPALLPDAEQDQKIEEILRKYGLLVTKA

SEQ ID NO: 28405 - protein, 244 aa, Saccharomyces cerevisiae
MTVVEIKSQDQFTQLTTTNAANKLIVLYFKAQWADPCKTMSQVLEAVSEKVRQEDVRFLSIDADEHPEISDLFEIAAVPYFVFIQNGTIVKEISAADPKEFVKSLEILSNASASLANNAKGPKSTSDEESSGSSDDEEDETEEEINARLVKLVQAAPVMLFMKGSPSEPKCGFSRQLVGILREHQIRFGFFDILRDENVRQSLKKFSDWPTFPQLYINGEFQGGLDIIKESIEEDPEYFQHALQ

SEQ ID NO: 28406 - protein, 299 aa, Saccharomyces cerevisiae
MSTFSASDFNSERYSSSRPSYPSDFYKMIDEYHDGERKLLVDVGCGPGTATLQMAQELKPFEQIIGSDLSATMIKTAEVIKEGSPDTYKNVSFKISSSDDFKFLGADSVDKQKIDMITAVECAHWFDFEKFQRSAYANLRKDGTIAIWGYADPIFPDYPEFDDLMIEVPYGKQGLGPYWEQPGRSRLRNMLKDSHLDPELFHDIQVSYFCAEDVRDKVKLHQHTKKPLLIRKQVTLVEFADYVRTWSAYHQWKQDPKNKDKEDVADWFIKESLRRRPELSTNTKIEVVWNTFYKLGKRV

SEQ ID NO: 28407 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLAKQAFDDAIAELDTLSEESYKDSTLIMQLLRDNLTLWTSDMSESGQAEDQQQQQQHQQQQPPAAAEGEAPK

SEQ ID NO: 28408 - protein, 548 aa, Ralstonia eutropha JMP134
MQQNLIVSTPSAYSYPLLVKQLLIHSMSLYGDQEISYRGEMRYTYRDFRRRVGQLASTLASLGAKHGSTVAVMDWDSHRYLECYFGVPMMGATLFTVNVRLSPQQILYTLNDADADIVLVHPDFVPVLDQIRNELTCNPRFVLLADGHAAPQTELQFAGEYEALLADASPDFDFPEFDENTKAATFYTTGTTGDPKGVCYSHRDIVLHTLSTSASLCSPRDGQRMHREDVYMPITPMFHVLAWGIPYLAVTLGLRTVLPGRYAPDVLLKLREAEKVTFSHCVPTILQMLLQSSQDSGQDLSGWKIIIGGSALPPSLCEAALDRGIDIFAGYGMSETGPIVSLAQLPPNVKPANRADEVRMRCSTGRPVVMADFRIVSEDMQDLPRDGKNRGEIVLRAPYLTQSYFKKPGASEELWAGGYLHTQDVAVMGEDGFVQIVDRIKDVIKTGGEWVSSIEVENLISEVPGVQECAVIGVPDDKWGERPMAFVVRKAGAEVGADSIREKLLGHVDSRRISKYAVPEAERIAFVAEIPKTSVGKINKKQLREKAA

SEQ ID NO: 28409 - protein, 114 aa, Alkaliphilus metalliredigenes QYMF
  misc_feature (105)..(105): Xaa can be any naturally occurring amino acid
  unsure (1)..(114): unsure at all Xaa locations
MECLFCKIVDQEIPATIIYENEDVMAFKDINPEAPVHLLVIPKKHIPSFAHLTQEDNEVLMPKIFVAIQHLAREFELEEEGFRVVNNCGTNGGQTVGHIHFHLMXGRRMVWPPG

SEQ ID NO: 28410 - protein, 423 aa, Schizosaccharomyces pombe
VSWNYFINYFVTFPLELTTCAITFRYWTDINSAAWISIFLVVIIIVNLFGVRAYGEVEFILSTVKVVATFGFIILAIIINCGGVPTDHRGYIGGSIIKHKPFRHGFKGFCSVFTTAAFSFSGTEVIGLAAAEVDNPQKALPHAVKQVFWRIAIFYVVSLILIGLLISPDDPNLMGNGSTSVSPFVLAIKEANIKGLPSVFNAVIIISVVSVTNSSTYTAGRTLHGMANLKQAPSFFKYTDRLGRPLLAMIVVLLFGFFAYINEADKNGNDVSDTVFNWLLALSGLSNFFTWGSICLCHIIFRLAFKKQGHSLKELGFVSPMGIWGSCIGLFFNILCLMAQFYVSLFPIGGKPNANDFFQGYLAAPVTLAFFIGYKIYDRSHIPSLDKLDITTGLKTYENLDEEEDEPTTASKRIFKKISSVFC

SEQ ID NO: 28411 - protein, 1074 aa, Erwinia carotovora subsp. atroseptica SCRI1043
MPKRTDIKSILILGAGPIVIGQACEFDYSGAQACKALREEGYRVILVNSNPATIMTDPEMADATYIEPIHWEVVRKIIEKERPDAVLPTMGGQTALNCALELERKGVLAEFGVTMIGATADAIDKAEDRRRFDVAMKKIGLDTARSGIAHNMEEALAVAADLGFPCIIRPSFTMGGTGGGIAYNREEFEEICERGLDLSPTKELLIDESLIGWKEYEMEVVRDKNDNCIIVCSIENFDAMGIHTGDSITVAPAQTLTDKEYQIMRNASMAVLREIGVETGGSNVQFSVNPKTGRLIVIEMNPRVSRSSALASKATGFPIAKIAAKLAVGYTLDELMNDITGGRTPASFEPAIDYVVTKIPRFNFEKFAGANDRLTTQMKSVGEVMAIGRTQQESLQKALRGLEVGATGFDPKVDLDDPEALTKIRRELKDAGAERIWYIADAFRAGMSVDGVFNLTNVDRWFLVQIEELVRLEEQVAEKGITALDADFLRALKRKGFADARLAKLAGVAESEIRKLRDKFDLHPVYKRVDTCAAEFSTDTAYMYSTYEEECEANPTQDRDKIMILGGGPNRIGQGIEFDYCCVHASLALREDGYETIMVNCNPETVSTDYDTSDRLYFEPVTFEDVLEIVRIEKPKGVIVQYGGQTPLKLARELEAAGVPVIGTSPDAIDRAEDRERFQHAVNRLGLKQPSNATVATIEQAVEKARGIGYPLVVRPSYVLGGRAMEIVYDEIDLKRYFQNAVSVSNDAPVLLDRFLDDAIEVDVDAICDGERVLIGGIMEHIEQAGVHSGDSACSLPAYTLSKEIQDVMRQQVEKLAFELCVRGLMNVQFAVKDNEVYLIEVNPRAARTVPFVSKATGVPLAKVAARVMAGKTLAEQGVTKEIIPPYYSVKEVVLPFNKFPGVDPILGPEMRSTGEVMGVGRTFAEAFAKAMLGSSSHMKKTGRALLSVREGDKARVVDLAAKLLKHGFELDATHGTAIELGEAGINPRLVNKVHEGRPHIQDRIKNGEYTYIVNTTAGRQAIEDSKLIRRSALQYKVHYDTTLNGGFATAMSLTADPTEKVTSVQEMHAMIKG

SEQ ID NO: 28412 - protein, 496 aa, Arabidopsis thaliana
MAGTGLFAEILDGEVYKYYADGEWKTSSSGKSVAIMNPATRKTQYKVQACTQEEVNAVMELAKSAQKSWAKTPLWKRAELLHKAAAILKDNKAPMAESLVKEIAKPAKDSVTEVVRSGDLISYCAEEGVRILGEGKFLLSDSFPGNDRTKYCLTSKIPLGVVLAIPPFNYPVNLAVSKIAPALIAGNSLVLKPPTQGAVSCLHMVHCFHLAGFPKGLISCITGKGSEIGDFLTMHPAVNCISFTGGDTGISISKKAGMIPLQMELGGKDACIVLDDADLDLVASNIIKGGFSYSGQRCTAVKVVLVMESVADELVEKVKAKVAKLTVGPPEENSDITAVVSESSANFIEGLVMDAKEKGATFCQEYKREGNLIWPLLLDNVRPDMRIAWEEPFGPVVPVLRINSVEEGINHCNASNFGLQGCVFTKDINKAILISDAMETGTVQINSAPARGPDHFPFQGLKDSGIGSQGVTNSINLMTKVKTTVINLPTPSYSMG

SEQ ID NO: 28413 - protein, 485 aa, Oceanospirillum sp. MED92
MKLQLNDSSLLQTQAFINGEWVNGDAGETFPVSNPATGEVIAEVASVGAEETARTIDLAEAAMSAWKKLAPAERSGILERWYDLIIENTDDLAAIMTLEQGKPLFEAKGEVMYGASYLKWFAEEGKRIYGDVLPSPGDRRSIVIKQPVGVVAAITPWNFPNAMITRKAAPALAAGCSILLKPAAETPLSALALAELSKRAGVPAGLFNVLPTKSSSTVGGEMTSNTKVKKLTFTGSTPIGKLLIKQCADTVKRTSMELGGNAPVIVFDDADLDLAVKGALASKYRNSGQTCICANRLLVQEGIYDQFVEKFAAAVKEFKLGHGFDEEATHGPVVSKKALSDIDAIVQNAVEQGANVVAGGKPSELGNCFYEPTILTDVNDKMSIFGEEIFGPVAPVFKFSTEEEAIAMANDTEFGLASYVFTQNLGRIWRVSEGIEYGMVGVNETAISSEVIPFGGVKESGQGREGSKYGLEDYLETKYICMGGL

SEQ ID NO: 28414 - protein, 350 aa, Mycobacterium tuberculosis H37Rv
MGGVLTLDAAFLGSVPADLGKALLERARADCGPVLHRAIESMREPLATMAGYHLGWWNADRSTAAGSSGKYFRAALVYAAAAACGGDVGDATPVSAAVELVHNFTLLHDDVMDGDATRRGRPTVWSVWGVGVAILLGDALHATAVRILTGLTDECVAVRAIRRLQMSCLDLCIGQFEDCLLEGQPEVTVDDYLRMAAGKTAALTGCCCALGALVANADDATIAALERFGHELGLAFQCVDDLIGIWGDPGVTGKPVGNDLARRKATLPVVAALNSRSEAATELAALYQAPAAMTASDVERATALVKVAGGGHVAQRCADERIQAAIAALPDAVRSPDLIALSQLICRREC

SEQ ID NO: 28415 - protein, 415 aa, Novosphingobium aromaticivorans DSM 12444
MASEVQAERADVVIVGAGHGGAQAAIALRQNGFEGRVLVIGREPEIPYERPPLSKEYLAREKTFERICIRPAQFWEDKAVEMKLGAEVVSLDPAAHTVKLGDGSAIEYGKLIWATGGDPRRLSCVGADLAGVHAVRTKEDADRLMAELDAGAKNAVVIGGGYIGLEAAAVLTKFGVNVTLLEALPRVLARVAGEALSEFYQAEHRAHGVDLRTGAAMDCIEGDGTKVTGVRMQDGSVIPADIVIVGIGIVPCVGALISAGASGGNGVDVDEFCRTSLTDVYAIGDCAAHANDFADGAVIRLESVQNANDMATAAAKDICGAPVPYKATPWFWSNQYDLKLQTVGLSTGHDNAVLRGDPATRSFSVVYLKGGKVVALDCVNMVKDYVQGKKLVEARAQIAPEQLADAGVPLKEMLA

SEQ ID NO: 28416 - protein, 138 aa, Zea mays
AGRAGAQHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEECASA

SEQ ID NO: 28417 - protein, 222 aa, Vibrio cholerae O1 biovar eltor str. N16961
MPEIKQLFENNSKWSESIKAETPEYFAKLAKGQNPDFLWIGCADSRVPAERLTGLYSGELFVHRNVANQVIHTDLNCLSVVQYAVDVLQVKHIIVCGHYGCGGVTAAIDNPQLGLINNWLLHIRDYYLKHREYLDQMPAEDRSDKLAEINVAEQVYNLANSTVLQNAWERGQAVEVHGFVYGIEDGRLEYLGVRCASRSAVEDNYHKALEKILNPNHRLLCR

SEQ ID NO: 28418 - protein, 449 aa, Bacillus cereus E33L
MKTKQTDEILAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKEEIGEHPLVGDIRGKGLLVGIELVNDKETKEPIDNDKIASVVNACKEKGLIIGRNGMTTAGYNNVLTLAPPLVISSEEIAFVIGTLKTAMERI

SEQ ID NO: 28419 - protein, 495 aa, Zea mays
  misc_feature (179)..(179): Xaa can be any naturally occurring amino acid
  misc_feature (290)..(290): Xaa can be any naturally occurring amino acid
  unsure (1)..(495): unsure at all Xaa locations
VWQVKEGKRQPKDQRIKRGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNMMFQLATTLGIFTANLINYGTQNIKPWGWRLSLGXLAAVPALLMTLGGLFLPETPNSLIERGRVEEGRRVLERIRGTADVDAEFTDMVEASELANTVEHPFRNILQPRNRPQLVMAVCMPAFQILTGINSILFYAPVLFQSMGFGXGNASLYSSVLTGAVLFSSTLISIGIVDRLGRRKLLISGGIQMIVCQVIVAVILGVKFGAEKQLARSYSVAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAEGHAAPASNNHKG

SEQ ID NO: 28420 - protein, 339 aa, Triticum aestivum
MAFFSHHHLQQPLPAAPPPQQQQQQPAPLSFRNALAVPVDGQIPAPLAFFNAPPAFPDQAGQPQIVDAAGLTAAAGMGWRQPREQELLGENSQMSSIDFLQTGSAVSTGLALSLEDRRHGGGGAGAGNSSGDSPLLLLPMLDDDISREVQRLDADMDRFIRAQSERMRQSILEKVQAKQFEALASVEDKILRKIRDKESEVQNINKRNLELEDQIKQMPGEVGAWQQRAKYNESMISALKYNLEQVCAHQSKDFKEGCGDSEVDDTASCCNGGAVNLQLMPKENNHPKDLTACRVCKSSEACMLLLPCRHLCLCKECESKLSFCPLCQSSKILGMEIYM

SEQ ID NO: 28421 - protein, 254 aa, Solanum chacoense
MGRTFFVGGNWKCNGTSEEIKKIVATLNAGQVPSQDVVEVVVSPPYVFLPLVKNELRSDFHVAAQNCWVKKGGAFTGEVSADMLVNLGIPWVILGHSERRAILGESNEFVGDKVAYALSQGLRVIACVGETLEQRESGSTMDVVAAQTKAIAERVKDWSNVVVAYEPVWAIGTGKVATPAQAQEVHAELRKWLQANVSAEVAASTRIIYGGSVSGANCKELAGQPDVDGFLVGGASLKPEFIDIIKAAEVKKGA

SEQ ID NO: 28422 - protein, 595 aa, Marinobacter sp. ELB17
MSVVNPNTSAAAAPDHRASSLVAMLRERFGDQVLHEQPTLTGMPVLWVSRDALVEVLATLRKLPEPFEMLFDLSAVDERLRSHRHGLPEADFTVFYQLLSVSGNRDIMLKVALLEQDLSLPTVIPVYPNANWYEREVWDMFGVRFDGHPNLSRILMPSTWQGHPLRKDHHARATEFDPYTLTVASQEREQQALKFKPEDWGMKRKNDETDFMFLNLGPNHPSAHGAFRLVLQLDGEEVIDCVPDIGYHHRGAEKMAERQSWHSFIPYTDRIDYVGGVMNNLPYVLAVEKLAGIQVNGRIETIRVMMAELFRITSHLLFLGTYLQDLGAMSPVFYTFTDRQKGYDVIEAITGFRMHPAWYRIGGVMQDLPKGWDRLMQGFVDWMPARLNEYERAMMKNSLVWDRTKHIAAFDTANALAWGVTGPNLRATGCDFDLRKKRPYSGYENFDFEIPLAHNGDVFDRGQLRIDEMRESVKIIQQCINHMPAGDYKADHPLTTPPPRERMLEHIETLITHFLQVSWGPVLPGNESLQMIEATKGINSYYLTSDGGTMSYRTRIRTPSFPHLQQIPVLMRGGFVPDLIAHLGSIDFVMADVDR

SEQ ID NO: 28423 - protein, 656 aa, Cenarchaeum symbiosum
MATIQTDTRFADKVYLLPVNPEYVGSIIESERPDSLMLAYGGQTALNCGVKLDEEGMLEKYGIRVLGTPVSGIRNTEDRQLFKDSMDGCGVPVLKSRTVTDFAGARDAAAELGYPVIVRVAYTLGGKGGGVARNEIELHEIVERGTRASMVGQVLVEEYIGDWKQIEYEVMRDSAKNGVIVCNMENVLSMRVHTGDNIVVAPSQTINNREYHAMRSAALDATAHVGIIGECNIQYALDPASGRFAAIEINPRLSRSSALASKATGYPLAYMSAKIGLGYTLPELANHITKSTTACFEPALDYIVCKHPRWDFAKFELANRRLGVTMKSVGEVMAIGSSFEESLQKAIRMLDTGADGLVLNRNPHETGGDEELEDRLARHDDLILYNVAEALKRGMTVSRIHTLSAIDPWFIEKIARIIEIEGRLRTGSSKELLREAKGAGFSDPQIARASGTMPSKVRQARKDAGITPAVRQIDTLAAEWPAKTNYLYMTYGGAKNDIEAPLPGRDIIVLGAGPYRIGSSVEFDWSTVNMVWGLKEGGGGVAVVNCNPETVSTDYDICDRLYFEELTHERIMDIAEFERPRGVVTCVGGQTANNLTPGLDDEGVPILGTAAANVDRAEDRSKFSSVLDGLHIRQPPWSKLTTCPMPKSSPRRWATP

SEQ ID NO: 28424 - protein, 478 aa, Oryza sativa
MTSLPDRGVSSSSSDPLCEGNIAPCSSSSEQKEDCSLKQSKTSILSCVFNSPFNIFEAHQDSSANKSPKSSSGSYDWSRVLRRIVCSGSMWRFLGTSKVLTSSDVWFLGKCYKLSSEESSSDSDSESGHATFLEDFSSRIWITYRKGFDAISDSKYTSDVNWGCMVRSSQMLVAQALIFHHLGRSWRRPLQKPYNPEYIGILHMFGDSEACAFSIHNLLQAGNSYGLAAGSWVGPYAMCRAWQTLVRTNREQHEVVDGNESFPMALYVVSGDEDGERGGAPVVCIDVAAQLCCDFNKGQSTWSPILLLVPLVLGLDKINPRYIPLLKETFTFPQSLGILGGKPGTSTYIAGVQDDRALYLDPHEVQMAVDIAADNIEADTSSYHCSTVRDLALDLIDPSLAIGFYCRDKDDFDDFCSRATELVDKANGAPLFTVVQSVQPSKQMYNQDDVLGISGDGNINVEDLDASGETGEEEWQIL

SEQ ID NO: 28425 - protein, 250 aa, Panax ginseng
MPIHEIAVGRYEEFRHPGALKAAAAEFFSTLIFVFAGQGSGLAFSKLTDGGATTPSGLVSAALAHAFGLFVAVSVGANISGGHVNPAVTFGAFIGGNLTLIRGILYIIAQLLGSTVACLLLSFATGGSPISAFALSGVSVWSAFVFEIVMTFGLVYTVYATAIDPKKGELGIIAPIAIGLIVGANILAGGAFTGASMNPAVSFGPALVSWDWTNHWVYWAGPIVGGGVAAVVYELIFISSSHEPLPVADY

SEQ ID NO: 28426 - protein, 226 aa, Brassica napus
MSESWADVVDSENNTASGSTTQNSHNTASGSTKPSRPAYVPPHLRNKQPSSDPVPPLPANDRVGYNGPPSASRWAPPGGYRADAGRPRGTGGGWNNRSGGWDRREREVNPFENADAEPEPAFTELDNTGINFDAYEDIPIETSGDNVPPSVNTFAEIDLGEALNLNIRRCKYVKPTPVQRHAIPILLAGRDLMACAQTGSGKTAAFCFPIISGIMKDQHVLQRPRG

SEQ ID NO: 28427 - protein, 385 aa, Lactobacillus reuteri
MEDKEILSMHAKNQGVLNIAPQFEVKNRKELGEAYTPGVAIISKLIERYPELKDKYTLSGKLVALVTDGSAVLGLGNIGPAGGLPVVEGKALLYKDLANVNALPLTVEQVPVNEFVATLKNMQESFAGFHLEDIKAPRCFEIEEKLSKVVNIPVYHDDQEGTAIVVLAGLINAARVVKKNLKDLKVIINGVGASGVATARLLFAAGIKNITFVDIDGPVHVDSQNYNHYQTDLVKQSADQTPYKNLSEAVKDRDVFIGLSDADVLTSEQVKTMAKNPIIFALANPKPEIDPQIAKDADAAVMATGSSQYPNQVNNILVFPGLYKGLLSADLNKVDFGLEKAIASALANMISNPTAEKIVPGVFDDGVVNTVAKAVQHYASQKNND

SEQ ID NO: 28428 - protein, 339 aa, Medicago truncatula
MAPELVPTAAKSVTGFTKPVTIPKRAYVTFLAGNGDYVKGVIGLAKGLRKVMTAYPLVVAVLPDVPEEHREMLEAQGCIVREIEPVNPPENQTQFAMAYYVINYSKLRIWEFVEYSKMIYLDGDIQVYENIDHLFDLPDGHFYAVMDCFCERTWSHTPQYKIGYCQQCPEKVHWPKEMGQPPSLYFNAGMFLFEPSIDTYHDLLKTLKVTPPTPFAEQDFLNMYFKDIYKPIPFVYNLVLAMLWRHPENVELHKVKVVHYCAAGSKPWRYTGKEENMQREDIRMLVKKWWDIYNDSSLDYNKNLSGSGEVQTNGFEIEPFVQALSEVGRVQYVTAPSAA

SEQ ID NO: 28429 - protein, 647 aa, Oceanospirillum sp. MED92
MSIITITVPDLSGSTDVDVVEVLVKDGDTISEGDSLIVLETDKASMEVPATHSGVVVSMKVNVDDQVNEGDLLLELDTGASASAPAAEEAPAPAAAPEAAPAPAAAPAAASAVENVLIPDLSGATDVDVVEVLVKDGDTVSEGDSLIVLETDKASMEVPAPKDGVVVSMKINVDDQVNEGDLLMELSVGGAAAPAAAAPAVAPAQEAAPAAAPAPVAGGKENVLIPDLSGASDVDVVEVLVKDGDSVEEGDSLIVLETDKASMEVPAPKAGTVVSMKINEGDTVNEGDLLLELEVSGGAAPAPAAPAAAPAAPAPAAPAPSAPAKAAPAAGNVDKAALEKKNKTVHAGPAVRAIAREFGVDLSLVTGTGRRGRIVKEDVQAYVKGALKQLAEAPKGGAVTGGSGIPAIPEVDFSKFGEIEVEKLSKIAKVTRDNMSRCWLNIPHVTQFDKADITDLEAFRKEMKDEAAKSGVKLTPLPFMLKAIAIALKEHPKFNASLHADGEHIVYKKYVNIGMAVDTPNGLMVPVIKDADKKSIYELSKEAIELAGKAKDRKLKPDEMQGACFTISSLGGIGGTGFTPIVNAPEVAILGVSKADIEPRWNGKEFEPRKMLPLCLSYDHRAINGGDAGKFLTYLNGLLSDIRRLVL

SEQ ID NO: 28430 - protein, 333 aa, Pinus taeda
MGMCSLVKTWWRWGWDVALSVPLLLMLPSAISFCKLFRMFIITRPERVRGKVVLITGASSGIGQHMAWEYAKRGANLVVVARRRNRLEEVAKECKAYGAQYAVVCPADLTKPQDCKRIVEFTVSTFGRLDVLVNNAGTAGGSLFEEYENAAEYKRIVDIDFWGHVNTTHFALEHLQRRRGQIVVISSMIAFLPFPFTTVYSAAKGALLNFFETLRIELISKSVTVTIASPGFIQSELTSREGPGKLPWWFPMARTEDAAREIVEAALRKERDVITPRWYSSLLWFRILCPEILEWVPRVFILGQAPTRGVEIVCNSVFGKFNTHTLFRTLKLA

SEQ ID NO: 28431 - protein, 886 aa, Oceanospirillum sp. MED92
MQDIIDDVDPIETQEWLDALESVAKNDGDERAKYLLRKLGEKANDMGVSSASALTTPYRNTISVKDESRMPGDLFMERRIRSFIRWNAMAMVMRANDNEDGLGGHISSFSSSATLYDIGFNYFFRGNEGGQESDMVFFQGHISPGIYSRAYLEGRLTEEQMDNYRREVDGNGLSSYPHPWLMPDFWQFPTVSMGLGPIQAIYQAHVMRYLSARELINRGDRKVWAFLGDGECDEPESLGAISLAGREQLENLIFVVNCNLQRLDGPVRGNGKIVQELEGIFRGAGWNVIKCLWGRHWDALFEKDTKGLLQKRFDEVCDGELQNYKANGGAYTREHFFGKYPELLELVADLSDEDIMNLNRGGHDPYKVFAAYNEAVNHKGQPTVILAQTVKGYGTGKSGEAKNDTHSMKKVAMDDLKDFRDRFNIPLTDDQLKEVPYYRPAPDSPEMKYMFERRESLGGFYPVRRTEFEKLETPPLSDFDGQLKDSGKRSASTQMVLNRVMSTLVKDKNMGERVVPIVPDEARTFGMEGMFRQLGIYTSEGQRYVPHDSDQIMFYKESKTGQILEEGINEAGAMSAWMAAATSYANNNCTMVPFYIYYSMFGFQRVMDLAWAAGDMQARGFLIGATSGRTTLNGEGLQHQDGHSHLMAQMIPNCKSYDPTYGYELAVIVQDGLRRMYQDQENCFYYITTMNENYHHPAMPQDAEEGIIKGMYLLKEGKSSDKKVQLMGCGTILREVEAAAEILSEEYGVESDIWSTTSINELRRDAMSVARENMLNPEAEPKKAYVTECIESRGEGPVIASTDYMRSYADQLREYIPRNFKVLGTDGYGRSDTRTKLREFFEVNRYYVVLAALKALQEEGKVEGAVVAKAMQKFNINPAKPAPWTV

SEQ ID NO: 28432 - protein, 228 aa, Glycine max
MAFLNKIGNLLKNSAVKHINQDFSASTPSLFQAIRSMSSAKLFVGGISYSTDDMSLRESFARYGEVIDVKVIMDRETGRSRGFGFITFATSEDASSAIQGMDGQDLHGRRIRVNYATERSRPGFGGDGGYRGSGGSDGYNRGGNYGSGNYNVTSSYSDGNAETSYTSGANAGNYQFNENSGGVFGSASGEFSSNQNDATGADNDEFIEPLEDNVRENNDEPTDYAQNR

SEQ ID NO: 28433 - protein, 311 aa, Streptococcus pneumoniae R6
MSYQDLKECKIITAFITPFHEDGSINFDAIPALIEHLLDHHTDGILLAGTTAESPTLTHDEELELFAAVQKIVNGRVPLIAGVGTNDTRDSIEFVKEVAEFGGFAAGLAIVPYYNKPSQEGMYQHFKAIADASDLPIIIYNIPGRVVVELTPETMLRLADHPNIIGVKECTSLANMAYLIEHKPEEFLVYTGEDGDAFHAMNLGADGVISVASHTNGDEMHEMFIAIAESDVKKAAAIQRKFIPKVNALFSYPSPAPVKAVLNYMGFEAGPTRLPLVPAPEEDAKRIIKVVVDGDYEATKATVTGVLRPDY

SEQ ID NO: 28434 - protein, 509 aa, Nepeta racemosa
MVSLSYFLIALLCTLPFLLFLNKWRRSYSGKTPPPSPPKLPVIGNLHQLGLYPHRYLQSLSRRYGPLMQLHFGSVPVLVASSPEAAREIMKNQDIVFSNRPKMSIANRLFFNNRDVAFTQYGEYWRQIRSICVLQLLSNKRVQSFRRVREEETSIMVEKIMQLGSSSSTPVNLSELLLSLTNDVVCRVTLGKKYGGGNGSEEVDKLKEMLTEIQNLMGISPVWEFIPWLNWTRRFDGVDQRVDRIVKAFDGFLESVIQEHKERDGDKDGDGDGALDFVDILLQFQRENKNRSPVEDDTVKALILDMFVAGTDTTATALEWAVAELIKNPRAMKRLQNEVREVAGSKAEIEEEDLEKMPYLKASIKESLRLHVPVVLLVPRESTRDTNVLGYDIASGTRVLINAWAIARDPSVWENPEEFLPERFLDSSIDYKGLHFELLPFGAGRRGCPGATFAVAIDELALAKLVHKFDFGLPNGARMEELDMSETSGMTVHKKSPLLLLPIPHHAAP

SEQ ID NO: 28435 - protein, 432 aa, Arabidopsis thaliana
MYQIFFFFLPLLHSYASAQTPPPFRNGDLVANFEPSLAVVTGVLAIMFALTFVLLVYAKCCHIDLRSGSGDRRRHDRRLRQGIFFNRSTASSDRFSGLDKTAIESLPLFRFSALKGSKQGLDCSVCLSKFESVEILRLLPKCRHAFHIGCIDQWLEQHATCPLCRDRVSMEEDSSVLTNGNSFRFLNQSEIREDSSLELYIEREEEEERIHREELSGSSRFSIGESFRKILKLGNKEKTLLDEHVNDKDEKKLMHKFNHRIVVSDVVFKNRWSNVSSSDLMFLNSEMVNSISSERFSSLDHVKRGDEEDQIGILRIKEEMEAKRMLENKLTSMTTMFSSENGDSGSKSRSVMIEPGRRSVSDITAVPRLSISIHGDCSGSAAETASALQNGGNETEERRRRLWLPIARKTAQWFANREKRSQINTTHQHFDV

SEQ ID NO: 28436 - protein, 690 aa, Burkholderia thailandensis E264
MPPVPRFLDSFSGLDMTTSSPASTTLMANAIRALAMDAVQQANSGHPGMPMGMAEIGVALWSRHLKHNPTNPHWADRDRFVLSNGHGSMLLYSLLHLTGYDLPIEELKNFRQLHSKTPGHPEYGITPGVETTTGPLGQGLANAVGMALGEALLAAEFNRDDAKIVDHHTYVFLGDGCLMEGISHEACSLAGTLKLNKLIALYDDNGISIDGDVVNWFHDDTPKRFEAYGWNVIPNVNGHDVDAIDAAIAKAKRSDKPSLICCKTRIGNGAATKAGGHDVHGAPLGADEIAKTREALGWTWAPFVIPQEVYAAWDAKEAGKRSEDDWNAAFAQYRAKYPAEAAEFERRMAGTLPADWAAKAAAIVAGANERGETVATRKASQQTIEGLAAVLPELLGGSADLTGSNLTNWKASKAVRANADGPGVQWGNHINYGVREFGMSAAINGLVLHGGYKPFGGTFLTFSDYSRNALRVAALMKVPSIFVFTHDSIGLGEDGPTHQSVEHVASLRLIPNLDVWRPADTVETAVAWTYAVAHQHPSCLIFSRQNLAFNARTDAQLANVEKGGYVLRDWDEEIVARKIILIATGSEVELAMKAVEPLAQQGIAARVVSMPSSDVFDRQDAEYRERVLPHGVRRVAIEAGVTDFWRKYVGLEGGVVGIDTFGESAPAGVLFKHFGFTVEHVIETAKAVLA

SEQ ID NO: 28437 - protein, 483 aa, marine gamma proteobacterium HTCC2080
MFCNAILGEFMSDYSMLINGESVGAEGSIEVLNPATETAIATVPEASLAQLDDAVAAARGALPGWSAHSMDERRALILKIADRLEENIGELAQLLSEEQGKPIEGFAGLGAMFELGGSLAWIRYTASLDLPVEVIQDNDEARIEVHRKPVGVVGSITPWNYPLLITCWHIIPGLLAGCTVVAKPSEYTPLTVLKAMHLISDLLPPGVVNIVTGKGALGAAISAHSDIDKIVFTGSTRTGKRIMEAAADNLKRLTLELGGNDAAIVLPDTNVAEAAGKIFATAMINNGQTCAALKRLYVHEDIYEEMCEALAGIAGSVKTGPASESPDFGPIQNKMQYDRVCELAESAKADGATFLTGGEPMPGPGYFFPVTIVKDIPESSRLVQEEPFGPILPVVSFSDVEDALEKANAVSVGLGGSVWSSDVAVAQKLASRLECGTAWVNNHAMIQPDAPFGGVKQSGVGVEFGRYGLVEYTNIQTLQISKS

SEQ ID NO: 28438 - protein, 559 aa, Nocardioides sp. JS614
MLSDIEIAGAATLRPITEVATESLGIGAEHLVPYGHYKAKVGITYLNSLADRPLGRLILVTALSPTPPGEGKTTTSVGLTDALHGLGKRAIACLREPSMGPVFGLKGGAAGGGYSQVVPMTDINLHFTGDFAAIAAANNLLAALIDNHVHHGNELDIDVRSVTWKRVLDTNDRALREVVVGLGGPPNGFPRQDGFDIVVASELMAIFCLTESWADLKRRIGDIVIGYSRAGAPVTARDLGADGAMAVLLRDAIAPNLVQTLEGAPALVHGGPFANIAHGCSSVMATRAGLRLADYVVTEAGFGADLGAEKFIDIKCRMSGMRPDVAVVVATVRALKYHGGVALADLDREDLGAVEAGMDNLRRHLDNLRHLNGVPCVVAVNRFPTDTDLEVVRVVELAASYGVPAYQATHFTDGGIGAQDLAKGVLQALEEPARDEFSFTYPDELSLTEKVEAVATRVYGAGQVTWDGKARKRLARIERDGYGTLPVCVAKTQYSFSTDPGLLGAPTGHELRVREVRLSAGAGFVVVICGDMMTMPGLPTRPAATRIDLADDGTIIGLS

SEQ ID NO: 28439 - protein, 312 aa, Arabidopsis thaliana
MDGDGSSFEQCYRCYPVTFIDKAHLEKGDKIIMPPSALDRLASLHIEYPMLFQLSNVSVEKTSHCGVLEFTADEGLVYLPYWMMQNMSLEEGDVMQVKNISLVKGTYIKLQPHTQDFLDISNPKAILETTLRSYSCLTTGDTIMVPYNNKQYYINVVEAKPSSAVSIIETDCEVDFAPPLDYKEPEKPQKLTPSNKRPLQVKEEEEPASKVPKFTPFTGSGKRLDGKAQTQTEPEDTKQQEKPTENGKDDEKLSVTTPRQISGKLVFGSNSKSAAKETAKVDDPKNIVQESSTKSDEAKFKVFTGKKYSLNG

SEQ ID NO: 28440 - protein, 271 aa, Burkholderia thailandensis E264
MHRRRDRREARVGRRRAAALGGLHARRPQGHGPRRGRMGAQDGRIRCGRDPADEHGPRRHEGGLRSRAHARGIGRGARARDRVGRGRLARASRGGHHRGPRRRRARREHFPLRRAHGRRGEALHGRARHCSEVVMNEAAKPGGWLDKVRWDANGLVPVIAQDAATNDVLMFAWMNRDALARTIELKRAVYYSRSRQRLWFKGEESGHVQHVHEVRLDCDEDVVLLKVEQVEGIACHTGRRSCFFQKFEGTVDDGEWVAVDPVLKDPEHIYK

SEQ ID NO: 28441 - protein, 179 aa, Marinobacter sp. ELB17
MYKGLLKGTWSQLRTLGMVFMHGFRKRETVNYPEEEVYLSPRYRGRIVLTRDPDGEERCVACNLCAVACPVACISLEKGEREDGRWYPEFFRINFSRCIFCGMCEEACPTSAIQLTPDFEMGEYNRQELVYEKEDLLISGPGKDHNYNFYKVAGMAIAGKDKGKGVAEYEPIKVTTLLP

SEQ ID NO: 28442 - protein, 314 aa, Scenedesmus vacuolatus
NGFGRIGRNFLRCLETRQNSLLEVIAINDSGGVKQASHLLKYDSTLGKFDADVKIVDDGHISVNGKSIRVVSSRDPTKLPWGEMEIDLVIEGTGVFIDTPGASKHIEAGAKKVLITAPAKGSDIPTYVVGVNAHDYKHSDAIISNASCTTNCLAPFVKVLDEKFGIVKGTMTNTHSYTGDQRLLDASHRDLRRARAAALNIVPTTTGAAKAVALVLPKLKGKLNGIALRVPTPNVSVVDLVVQVEKKTFAEEINNAFKEAAAGSLNGVLAVSDEPLVSVDFRCTDVSSTIDSSLTMVMGADMVKVVAWYDNEWG

SEQ ID NO: 28443 - protein, 525 aa, Mycobacterium tuberculosis H37Rv
MVQPADIDVPETPARPVLVVDFGAQYAQLIARRVREARVFSEVIPHTASIEEIRARQPVALVLSGGPASVYADGAPKLDPALLDLGVPVLGICYGFQAMAQALGGIVAHTGTREYGRTELKVLGGKLHSDLPEVQPVWMSHGDAVTAAPDGFDVVASSAGAPVAAFEAFDRRLAGVQYHPEVMHTPHGQQVLSRFLHDFAGLGAQWTPANIANALIEQVRTQIGDGHAICGLSGGVDSAVAAALVQRAIGDRLTCVFVDHGLLRAGERAQVQRDFVAATGANLVTVDAAETFLEALSGVSAPEGKRKIIGRQFIRAFEGAVRDVLDGKTAEFLVQGTLYPDVVESGGGSGTANIKSHHNVGGLPDDLKFTLVEPLRLLFKDEVRAVGRELGLPEEIVARQPFPGPGLGIRIVGEVTAKRLDTLRHADSIVREELTAAGLDNQIWQCPVVLLADVRSVGVQGDGRTYGHPIVLRPVSSEDAMTADWTRVPYEVLERISTRITNEVAEVNRVVLDITSKPPATIEWE

SEQ ID NO: 28444 - protein, 349 aa, Triticum aestivum
MDLVNGALNWAAMPAMVAALLLFYPPYYLFKLCYSFLSYLFPDDLKRKVVLITGASSGIGEQLAYQYAAKGACLALVARKEWSLRQVADRAFDLGAPDVIILPGDVADPDDCNRFVQATVDHYGRLDHLVCNAGIASVGAFQEIPDVTNYSSQLDVNFWGAVQSTSAALPHLKRTRGRIVVTASATGWNPVPRMIFYNAANAALINFFETLRSELGSEVGITIVTPGWIESEMSKGKFLKEHGGVEVDQEYRDAQIGLFPVEYAKNCARAMVQAARQGDRYLTVPSWFGTMYLWRVFAPEVVEFCYRLLYMHRHGGGDQTDAPSKTMAQGGGKQMLYPSSLRSSDVKSD

SEQ ID NO: 28445 - protein, 233 aa, Scenedesmus vacuolatus
LAIPPFNYPVNLAVSKLAPALMAGNTVVLKPPSQGVVAGIHMIKCFQAAGLPAGTVNLVTGKGSEIGDFLTTHPAVNCISFTGGDTGIAISRKAGMVPLQMELGGKDACIVCSDADLDLAATHIIKGGFSYSGQRCTAVKVVLVMQDIADELVRKVHAGVQKLKVGRPEDNADITAVVSEGSANFIQGLVEDAKAKGATFLTDWKREGNLLWPVLLDNVTADMRIAWEEPFGP

SEQ ID NO: 28446 - protein, 625 aa, Triticum aestivum
  misc_feature (330)..(330): Xaa can be any naturally occurring amino acid
  unsure (1)..(625): unsure at all Xaa locations
MPPSLRLLLLLALALALTLPPAAPQPAPGSAAQPQEDDAKCLRGVKSDLRDPEGRLSSWTSNTSAGAVCDFSGISCWNPQESRILAVSLSGFGLQGKIPPALQYCRSANTLDLSSNALEGQIPPALCDWIPFVVNLDLSGNRLTGPLPSELANCRFLNSLKLSDNAFSGQIPASLARLDRLKALDLSRNRLDGQIPSQLGSAFSKDSFSGNSGLCGHPVSSRCGGGLGGTGLGIVIAAGVFGAAASLLLAFFFWRCTGKGKAGRRRQGRGGSESEVTAAEDGSWWAERLRAAHNRLAPVSLFQKPIVKVKLADLLAATQDFSTSHIVVAXSSRAGTAYRAVLRDGSALTVKRLHSCPLSEKAFRSEMGRIGQLRHPNIVPLLGFCVVEEERLLVYKHMESGALSKVMKEPGETLLDWATRLRIAVGAARGLAWLHHGFQMPQIHQNLSSSAVLLDEDYEARITDVGLTRLVRMAPGEGGDTSPFLNGDFGEFGYVAPEYASNPVGTMKGDTYAFGVILLELVSGQEAASVSSDVGEGFKGTLVDWVYQLKSTGRIADAVDKSLKGSDAEISEFLKVAFQCIVARPKERISMYRVYHSLKSIGTGRDVSEQFDEFPLAYNKDDSDT

SEQ ID NO: 28447 - protein, 216 aa, Glycine max
MLQNSSMSSLLLHRINGGGGATTATNCHDTVFMTVPDGVARYHTHAVAPNQCCSSVAQEIGASVATVWSVLRRFDNPQAYKHFVKSCHVIGGDGDVGTLREVHVISGLPAARSTERLEILDDERHVISFSVVGGDHRLANYRSVTTLHPTASSASGGCSGTVVVESYVVDVPPGNTREDTRVFVDTIVKCNLQSLAQTAENLTLRKNNNNDYKCCS

SEQ ID NO: 28448 - protein, 498 aa, Novosphingobium aromaticivorans DSM 12444
MSYFSDLGLAEPILRALETKGYNDPTPIQRQAIPALLEGRDLLGIAQTGTGKTAAFALPSLHRLAANPQPRKPASCRMLVLSPTRELAAQIADNMKGYARNLNLIVDCVFGGVPIGKQARRLVPGVDILVATPGRLLDLIDNRALTLGRTEIFVLDEADQMMDLGFIHALKRVANLLPKTRQSLFFSATMPKAIEDLGKQFIVNPVRVEVAPNSTTAERVEQYVTFINQAEKQALLTLRIRDLLKTKELDRALVFTRTKHGADRVVRHLSSAGIDARAIHGNKSQAQRTAALEAFRQGSCPVLVATDIAARGIDVSGVSHVFNFELPNVPEQYVHRIGRTARAGADGIAISFCAPDEKPYLKDIERLTRVKVDALPLPENFTAEAAKLPAPSRKPAEQEQDARRDARDARGNGGRGGQGRGQAHGGRAQGRDGRPRDASPRQDRREGDRGPVRNPLHTDRTDRPERIEGERDGNKPRRFRPRGAPGVGAHRNKVRRAS

SEQ ID NO: 28449 - protein, 460 aa, Saccharomyces cerevisiae
MTVPYLNSNRNVASYLQSNSSQEKTLKERFSEIYPIHAQDVRQFVKEHGKTKISDVLLEQVYGGMRGIPGSVWEGSVLDPEDGIRFRGRTIADIQKDLPKAKGSSQPLPEALFWLLLTGEVPTQAQVENLSADLMSRSELPSHVVQLLDNLPKDLHPMAQFSIAVTALESESKFAKAYAQGISKQDYWSYTFEDSLDLLGKLPVIAAKIYRNVFKDGKMGEVDPNADYAKNLVNLIGSKDEDFVDLMRLYLTIHSDHEGGNVSAHTSHLVGSALSSPYLSLASGLNGLAGPLHGRANQEVLEWLFALKEEVNDDYSKDTIEKYLWDTLNSGRVIPGYGHAVLRKTDPRYMAQRKFAMDHFPDYELFKLVSSIYEVAPGVLTEHGKTKNPWPNVDAHSGVLLQYYGLKESSFYTVLFGVSRAFGILAQLITDRAIGASIERPKSYSTEKYKELVKNIESKL

SEQ ID NO: 28450 - protein, 124 aa, Cryptococcus neoformans var. neoformans JEC21
MAAVLLFTMVFFIIMFSDLECDYINPIDLCNKLNQFVLPEMIAHAFLTLCFLLSGQWLAFLLNAPLVAYNVNKIMSKNHMYDATEIFRTLSGHKKESFIKLGFYLISFFYYLYRMILALISESD

SEQ ID NO: 28451 - protein, 494 aa, Magnaporthe grisea 70-15
MPPARTARGQLVSNENDENAGSTRMTRTKAKAAALNVDELALPTKQLQTKKGVAGKPAPTTRTTRNALGDVSNVTKVDAGRKAVGGKAGAVAKAAAPAGVQKSSARTAPTRSALSSKPANVTNGNAEKQSGRGTLSKRKAPAQAAANNIKEESTLEGEPARKQARVAATAAVDTKRAAPAKELKCVEPELKPTREFIRDPRLLAGEVPPGVIDLSMDDYDDPLMVAEYAEEIFSYMLNLELSSMPNPNYMDHQDDVEWKTRGILIDWLIEVHTRFHLVPETLFLAVNIVDRFLSEKVVQLDRLQLVGITAMFIASKYEEVMSPHVTNFRHVTDDGFSESEILSAERFILSTLNYDLSYPNPMNFLRRVSKADNYDTPCRTIGKYLMEISLLDHRFLQYRPSLVAASAMALSRIILDRGEWDKTISYYSGYNEDDVEPVVNLMVDYLSRPVIHEAFFKKYASKKFFKASILSRNWVEENGYLFGIDQTDVAIDQL

SEQ ID NO: 28452 - protein, 114 aa, Geobacter metallireducens GS-15
MDNCIFCKIINGTIPARKVYEDDDLVAIEDINPVAPHHILLIPRKHIVNALDLTAGDDALVGRVFRAAAAIARERGVDERGFRIVQNTNADAGQSVFHIHFHLLAGRHLGWPPG

SEQ ID NO: 28453 - protein, 446 aa, Candida albicans SC5314
MASVPPLFKVPNTKRTSNNKVLPNLSIPPTSNNKNGNPNTKPSLSLNQNIINHDSQQHENLNPLSYQPHQLQHQQYQNPQGLKLSTSPSSVSSSKSTKRKPPPIDTKVISHSPDMMDVDQQGSADESVNVDENEYSVKHHLEQLTPYDWHLIANANKIVEISSLGEGNGGAVTKCYIPQLPNKQIFALKLVMCDPNPDLQKQIFRELEVAKKCQHPNIVKYYGTFLLEKQSMIGIAMEFMDGQSLDSIYKEVLKRDKTNRINEKVLGKIANSILSGLDYLHSKNIIHRDIKPSNILLDTKGNVKLCDFGVSGEAVNSFASTFVGTQYYMAPERITGGNYSITSDIWSLGMSLLEVANGCFPIIQSLGPIEVVEIISRSNLELKDCEEDNIFWTREFKQFIAKCLTKDYLRRPKPSDFLAHDEWCLIQSKEKVKMDKFVKVVWELNE

SEQ ID NO: 28454 - protein, 351 aa, Staphylococcus aureus subsp. aureus MRSA252
MKALVKTREGHGNLELLDKEVATPLDDKVKIKVHYAGICGTDIHTYEGHYKVNFPVTLGHEFSGEIVEVGADVKDFKVGDRVTSETTFYVCNECEYCESKDYNLCNHRKGIGTQVDGAFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDILRKKGFYSQIGIFKDAEITFDMEKVIQKEITVVGSRSQKPADWEPSLQLMADGLVNAEALVTKIYDISKWDEAYQHLKSGEGIKALLKPLDLDENEGEN

SEQ ID NO: 28455 - protein, 729 aa, Gibberella zeae PH-1
MAPSAIAPETQYDHTALSNVVKLIKNDDARTIDLALRQFRCLIADLCEQFKGGHPGFRGAMGMAAIGLALWKYIMQYSPNDPDYFNRDRFVLSNGHTCLFQYTFLHLVGYKAMTFDHLKSYHSSNYDSLAPGHPEIEHEGIEVTTGPLGQGIANAVGLAMATKNLAATYNKPNFELVNNMTYCMIGDACLQEGVALEAIQLAGHWKLNNLVVMYDNNQITCDGSVDLCNTEDVNAKMRACGWDVIEVEDGCYDVEGIVKALIKAKASTDKPTFINIHTVIGVGSKVAGDAKAHGVAFSPEGVKAVKEHFGMDTDKQYVVSDEVYTFFRDRKARGDRLVEDWNILVDCYAKEYPELHQEFIKRVEGRFTEDWRSIIPAKESLPTTPTPSRKSAGIICNPLAAKLKNFMVGTADLSPSVNMIWKDKVDFQHPELRTTCGINGDYSGRYIHWGIREHAMASISNGLAAYSKGTILPVTSSFFMFYIYAAPGVRMGALQNLQAIHIATHDSIGTGEDGPTHQPIALPALYRSMPNILYIRPCDTEETAGAFITALEAKDTPSIISLSRQNLEQYPQHSSREGTQKGAYVFIEDEDADVTLIGVGAEMVFAVKTREVLKNKFGIRARIVSFPCQRLFNSQPLEYKRQVLQYRSNAPRVVIEAYAVNGWERYADAGYSMSTFGKSLPGKDAYKYFGFDETVIAPEVARLVEEVKEEGIESLRGEFRDLNNVTHEH

SEQ ID NO: 28456 - protein, 347 aa, Staphylococcus aureus subsp. aureus MRSA252
MKALKLYGVEDLRYEDNEKPVIESANDVIVKVRATGICGSDTSRYKKMGPYIQGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDIAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 28457 - protein, 298 aa, Campylobacter upsaliensis RM3195
MDKNCIIGAMTALITPFKNGNLDEQGYARLIKRQIQNGIDAIVPVGTTGESATLTHEEHRTCIEIAVDICKDSKVKVLAGAGSNATHEAVGLAQFAQKCGADGILSVTPYYNKPTQEGLYQHYKAIASSVEIPVLLYNVPGRTSCEIATDTAIRLFRDCENIYGIKEASGNIDKCVDLLAHEPRLVLISGDDAINYPILSNGGKGIISVSSNLLPDRLSELTKKALNEDYKAAKKINDELYNINKILFCESNPIPIKAAMFIAGLIEKLEFRLPLCPPSKEDFAKIEAVMKHYEIKGF

SEQ ID NO: 28458 - protein, 234 aa, Brassica napus
AHPNELKLVGAHCHLGSTITKVDIFRDAAVLMVEYIDDIRRQGFEVSYLNIGGGLGIDYYHAGAILPTPMDLINTVRELVLSRGLNLIIEPGRSLIANTCCFVNHVTGVKTNGTKNFIVIDGSMAELIRPSLYDAYVDPRVRSPPAPEAEVSKFDVVGPVCESADFLGKDRELPTPPKGAGLVVHDAGAYCMSMASTYNLKMRPPEYWVEDDGSITKIRHAETFEDHLRFFDGL

SEQ ID NO: 28459 - protein, 428 aa, Mycobacterium tuberculosis H37Rv
MAGEFRLLSHLCSRGSKVGELAQDTRTSLKTSWYLLGPAFVAAIAYVDPGNVAANVSSGAQFGYLLLWVIVAANVMAALVQYLSAKLGLVTGRSLPEAIGKRMGRPARLAYWAQAEIVAMATDVAEVIGGAIALRIMFNLPLPIGGIITGVVSLLLLTIQDRRGQRLFERVITALLLVIAIGFTASFFVVTPPPNAVLGGLAPRFQGTESVLLAAAIMGATVMPHAVYLHSGLARDRHGHPDPGPQRRRLLRVTRWDVGLAMLIAGGVNAAMLLVAALNMRGRGDTASIEGAYHAVHDTLGATIAVLFAVGLLASGLASSSVGAYAGAMIMQGLLHWSVPMLVRRLITLGPALAILTLGFDPTRTLVLSQVVLSFGIPFAVLPLVKLTGSPAVMGGDTNHRATTWVGWVVAVMVSLLNVMLIYLTVTG

SEQ ID NO: 28460 - protein, 1082 aa, Ralstonia eutropha JMP134
MPKRTDIKSILIIGAGPIIIGQACEFDYSGAQACKALREEGFKVILVNSNPATIMTDPATADVTYIEPITWEVVERIIEKERPDAILPTMGGQTALNCALDLHRHGVLDKYKVELIGASPEAIDKAEDRQKFKDAMTKIGLGSAKSGIAHSMEEALAVQTRIAQDTGTSGYPIVIRPSFTLGGTGGGIAYNREEFEEICKRGLDLSPTRELLIEESLLGWKEYEMEVVRDKADNCIIICSIENLDPMGIHTGDSITVAPAQTLTDKEYQILRNASLAVLREIGVDTGGSNVQFSINPKDGRMIVIEMNPRVSRSSALASKATGFPIAKVAAKLAVGYTLDELKNEITGGATPASFEPSIDYVVTKVPRFAFEKFPQADSHLTTQMKSVGEVMAMGRTFQESFQKALRGLEVGVDGLDEKSTDRDEIVEEIGEAGPDRIWYVGDAFRIGMSLEEVYAETDIDPWFLAQIEDIVKTEGQIKARTLETLSAAELRYVKQKGFSDRRLAKLLKTKAKAVREARIANNVRPVYKRVDTCAAEFATNTAYMYSTYEAEHGECEANPTDKKKIMVLGGGPNRIGQGIEFDYCCVHAALALREDGYETIMVNCNPETVSTDYDTSDRLYFEPVTLEDVLEIVAIEKPVGVIVQYGGQTPLKLALDLERNGVPIIGTSPDMIDAAEDRERFQKLLQDLGLRQPPNRTARAEDEALRLAEEIGYPLVVRPSYVLGGRAMEIVHEPRDLERYMREAVKVSNDSPVLLDRFLNDAIECDVDALSDGKRVFIGGVMEHIEQAGVHSGDSACSLPPYSLSAETVAELKRQTAAMAKALNVVGLMNVQFAIQQNNGVDTVYVLEVNPRASRTVPYVSKATGLQLAKIAARCMAGQSLDSQGVAAEVVPPYFSVKEAVFPFNKFPGVDPVLGPEMRSTGEVMGVGKTFGEALFKSQLAAGSRLPERGTVLITVKDSDKVRAVAVARMLHDMGYPIVATRGTASAIEAAGIPVKVVNKVKDGRPHIVDMIKNGELALVFTTVDETRGAIADSRSIRTSALANRVPYYTTIAGASAAVEGLKHMQSLEVYDLQGLHASLA

SEQ ID NO: 28461 - protein, 537 aa, Clostridium cellulovorans
MKTGIAASKGYAIGNVFVKEEKEIKIVEQHIEDVEAEVARLNDATSLARTQLEKIKDKAEKEVGADKAAVFESHIMMLDDPEFTGAIENTIRDKQINAEKALTEVLDMFIAIFDSMDDEYMRERVADVKDVGTRILKNLAGIVEDLSEVENNTVIVAHDLTPSDTAQLDKSKVIAFVTNIGGRTSHSAIMARTLEIPAVVGLNDIVQTAKSGDKIIVDGNEGIIILNPDEATIAEYEAKKAQFEKEKEELKKLISVKTVTKAGKKVKVMGNIGKPEDINGVFENGGDGVGLFRTEFLYMDRDSMPTEEEQFQAYKYVAEKAGEREVVVRTLDIGGDKKLPYLPLPEEMNPFLGYRAIRLCLDRTDIFKTQLRAILRGSAFGNLMIMFPMISSLEEFNKSKEILAECMAELKAEGKAYNENISTGIMVEIPAAAVNADELAKHVDFFSIGTNDLIQYTLAADRMNEKISYLYNPMHPAVLKLIKMTIEAAHAQGKWCGMCGEMAGDETAIPTLVKYGLDEFSMSASSILTAKQIIMNN

SEQ ID NO: 28462 - protein, 610 aa, Glycine max
MSHELLETYACMPTTERGRGILISGDAKSNSIVYTNGRSVVMMNLQNPLNVSVYGDHAYPATVARFSPNGEWVASADASGSVRIWGTRNDFVLKKEFRVLSARIDDLQWSPDGLRIVACGEGKGKSFVRAFMWDSGTNVGEFDGHSRRVLSCAYKPTRPFRVVTCGEDFLLNFYEGPPFRFKLSHRDHSNFVNCVRYSPDGSKFISVSSDKKGIIFDGNSAEKIGELSSEGGHTGSIYAVSWSPDGKLVLTVSADKSAKVWDITEDNNGKVKKTLTCAGSGGVEDMLVGCLWLNDYLVTVSLGGTISIFLATDLDKAPTTFSGHMKNVSSLTILRSNPRVLLSSSYDGLIVKWIQGIGYSEKLQRKENSQIKCLAAVEEEIVTSGFDNKIRRVSLHRDQCGDTEAIDIGSQPKDLSVALLSPELALVSIDSGVVMLRGTKIVSTINLGFIVTASAVSPDGSEAIIGGQDGKLHIYSISGDTLVEEVVLEKHRGAISVIRYSPDVSMFASGDVNREAIVWDRASREVKLKNMLYHTARINCLAWSPDSHRIATGSLDTCVIIYEVDQPASSRITIKGAHLGGVYGLAFTDEYSLVSSGEDAFIRVWRITPR

SEQ ID NO: 28463 - protein, 115 aa, Enterococcus faecalis V583
MNPLIQELTQEQLRTDIPAFRPGDTVRVHAKVVEGTRERIQLFEGVVIKRRGAGISETYTVRKVSNGVGVERTFPLHTPRVAQIEVVRYGKVRRAKLYYLRALHGKAARIKEIRR

SEQ ID NO: 28464 - protein, 468 aa, Medicago sativa subsp. x varia
MNMMRRLKSIASGRTSISSDPGGDSNSKRVKLDQETEKVYEGINSLGRNDREQCVDASKEASVGTSNEVSTETKTEKKSGFDELPKELHEMKIRDEKSKNNNEKDIEATTVSGNGTETGQIITTTIAGRDGQPKQTISYMAERVVGTGSFGVVFQAKCLETNEAVAIKKVLQDKRYKNRELQVMRMVDHPNIVKLKHCFYSTTEKDELYLNLVLEFVPETVYKVSKNYIRIHQHMPIIHVQLYTYQILRGLNYLHEVIGVCHRDIKPQNLLVNPQTRQLKICDFGSAKMLVPGEPNISYICSRYYRAPELIFGATEYTTAIDMWSVGCVLAELLLGQAMFLGESGVDQLVEIIKVLGTPTREEIRCMNPNYNEFKFPQIKAHPWHKLFHKRMPSEAVDLVSRLLQYSPHLRCTALAACAHPFFNDLRDPNASLPNGQPLPPLFNFTPQELVNAPEDLRQRLIPEHARS

SEQ ID NO: 28465 - protein, 453 aa, Enterococcus faecalis V583
MKEKKTEKMLNYANGPSLEEINNTVEVPKNASFWRTLLAYSGPGALVAVGYMDPGNWITSIAGGAEYKYTLLSVILLSSLVAMLLQSMAARLGIVTGMDLAQATREHTSKRTGVALWVVTELAIMATDIAEVIGGAVALQLLFGFPLLIGVLITTFDVLLLLLLTKLGFRKIEAIVSCLIAVIFFVFAYEVALADPNVGEVLRGFIPDTKIATDKSMLFLALGIVGATVMPHNLYLHSSIAQARKFDRNDDVEKAKAIRFTTWDSNIQLTVAFVVNCLLLILGGALFYGTNSELGKFVDLFDALKNPDIVGNIASPVLSILFAIALLASGQNSTITGTLSGQIVMEGFIHLKMPLWARRVLTRLLAIVPVIICVIIYGGSETAVEDLLLYTQVFLSIALPVSIIPLTMYTSDKKLMGQFANPAWVKFLAWIIAIALTLLNLFLIYGTLTGLTN

SEQ ID NO: 28466 - protein, 294 aa, Nocardia farcinica IFM 10152
MTAALFVGLSTVDIAYAVDRYPEEDTKTQAREQFLGAGGPAANAAVACAVVSGEPTVLVTALGRHPLTEVARHDLAAHRVTVVDVTPERAEQPPVSSIVVALEGQSRTIVGLDAAGTRAPFTTELVEHVDRASIVLVDGHHPELAIGMARRAKELGVPVVLDGGRWKPIHEDLLPLVDVAICSEAFRPPGFEGDATALVDYLRARGPTCAALTRGPKAIVYTAGGRRGSVQVTPVGGDADTLGAGDILHGAFCAYFRRTGDFVAALTRAAAVSTLSCRTFGTRNWARELSELNG

SEQ ID NO: 28467 - protein, 321 aa, Oryza sativa
  misc_feature (25)..(25): Xaa can be any naturally occurring amino acid
  unsure (1)..(321): unsure at all Xaa locations
IADFPYASIPKESQFVFDAKASPLXVGSTGYYNYIANNHLSAMNQERNTNNDVGHEKQLNLQMSLNYFPVENLDRLARIGNPSAVSTGLRLSYENNEHTSITSGSGNMSSLPIMASFVDEVMAELDKENKEFNCYFGLQVEQLVKCMKDVKQRQMVEFLASLERGVGKELKEKELEVEAMNRKSKELNEQIRQVALEVQSWQSVALHNQSVANSMKSKLMQMVAHSSNLTREGSGDSEVDNTASSQNVNAVPGVFFQSGLLGINSMADGGLGACRLCRMKEAAVLVMPCRHLCLCADCEKNADVCPVCRFPKSCSVEINMS

SEQ ID NO: 28468 - protein, 497 aa, Rhodococcus sp. RHA1
MNHQDLPGLFVGGRYRDGRAAERYEVLDPATGEVISSRTEASVDDVDEAVATAKTAYADWSTTSPGERSAVLTRWAAELTEMSDDIARTETRQTGKPLKLSTAFDVPGSIDNVSFFAGAARNLEGKASGEYSPDHTSSIRREPIGVIGSIAPWNYPLQMAAWKVLPAVAAGNTIVLKPAEITPLTSLLFAEAASRAGMPDGVVNVITGRGVTTGSSLVSHRDVSMVSFTGSTPVGRQIAAAAAGKRLHLELGGKAPFVVFDDADLEAAINGAVAGALINSGQDCTAATRAYVQRPLYDDFVAGVASLMGTVRLGDPSDPGTDMGPLVSRRQQQHVAGFIDRARDTGAKIVRGGSVPGGDLASGFYYEPTLVVGADQSSEIVQREIFGPVLVVLPFENDSDGIALANDTDFGLAASAWTRDLYRAQTASRDIAAGCVWINDHIPIISEMPHGGYKASGYGKDMSTYSLDEYTNVKHVMSDITGTARKDWHRTVFGDRR

SEQ ID NO: 28469 - protein, 453 aa, Novosphingobium aromaticivorans DSM 12444
MPRPEWLRQGRNPPFLSRLEPNGPSDRRNLMRAKPNDVDLRERAAKVIPNGMFGHEATHLLPASFPQFFSRAKGAYIWDVDGNRYLDFMCAYGPNLLGYGDELIDAAATRQLALGDTMTGPGPVLVDLCETLVDMISHADWVMVCKNGTDATTMALTAARAQTGKRRVLVAEGAYHGAAPWCTPMPGGIVPEERAFISKYKYNDVASLEAAVAAAGDDLAAIFASPFKHDAFEDQALPDPAYARRARELCDQTGAMLIVDDVRAGFRLVRDCSWELVGVRPDLSSWGKSFANGHPISALLGSNSCRAGAEAIYATGSFWFSAVPMAAAIETLRILRESDYLERTIRLGERLREGLAAAAARHGFSLRQTGPVQMPQILFNDDPDFRIGFAWAEAMLERGVYVHPWHNMFLNGAMSETDIDFAIEAADGAFAQVREHVGELEPHATLMSLLGAH

SEQ ID NO: 28470 - protein, 191 aa, Glycine max
AAATYCTSLVLPRVRPSVGFTGILVLLVFLSACCSSTHGSLETEKTFAIIKPDGLLGNYTDDIKRTIVEYGFRILKEKIVQLDEGTVKSFYAEHSSKSFFSSLIKYMTSGPVLIMVLEKDNAIADWRALMGPTDASKAKITHPHSIRAKCGLDMEKNCVHGSDSPKSAQREISFFFKELSAEFLLKLIVVF

SEQ ID NO: 28471 - protein, 207 aa, Triticum aestivum
MAKKGAGGEESVVVPGQTEEAKQGPPRKRNPCPGIRCVGGRIYDPENGKTCHQCRQKTMDFSVACTQPRKKGLCPIHFCHKCLLNRYGENAEDMTKEAGWTCPKRCGRGNCSFSRKKKGETPTGLLAHAAKASGHSSVHDLLIKGSDMVVAAQTLSSLPKKIKKERKEGSLKRALGIDDANGGLFAEGDENIKTDLNALPSVPIQKK

SEQ ID NO: 28472 - protein, 354 aa, Glycine max
MDSQMTKLGTSLLVPSVHELAKQPMTKVPERYVRLNQDPVVSDTISLPQVPVIDLNKLFSEDGTEVEKLNQACKEWGFFQLINHGVNPLLVQNVKIGVQEFFGLQMEEKRKLWQKQGELEGYGQMFVVSEEQKLEWADIFYINTLPSCARNPHIFASIPQPFRNDLESYSLELGKLSIAIIKLISKALEINTNELLELFEDLSQSMRMNCYPPCPQPEHVIGLNPHSDAGALTILLQVNEMEGLQIRKDGMWIPIKPLSNAFVINVGDILEILTNGIYRSVEHRATINAEKERISIATFHRPQMNRIVGPTPSLVTPERPALFKRIGVADYYRGYFSRELRGKSYIDVIKIKNT

SEQ ID NO: 28473 - protein, 470 aa, Vibrio cholerae O1 biovar eltor str. N16961
MIKFGTGGWRAFIGEEFTKDNVRLVAQALANIIHHEQAANEGFVIGYDRRFLSDKAGRWFAEVLAANGVVVSFIDKFVPTPVVMFKAKAMDCAYSACITASHNPADYNGIKVFIRGGRDADEVITQKIEQQIATLTLQDVKSIDFDQAVNDKLIDIINPMNEFVDSIINFIDIEAIKKANLRVLIDPMFGVAKNALQTVLINGRCDVDVINDGKNPDFGGLMPSPSAATLYRLKHLVKHEGYDIGIGTDGDADRLGIIDEKGNFIHPNEVLILLYYYLLEYKGWKGSVVRNIATTHLLDKIAADHGERCFEVPVGFKHISSQMEADDSLIGGESSGGLTIRGHIKGKDGVFASSLLVEMISVTGKKLSELLTEIYDRYGYAYTAEGDCKFKPAQRDEIYNKVYIEKKLPEFEFDIDKVSYEDGAKVYFKNGGWVIARFSGTEPLLRIFAEMADKDTAERVLQQMKAFLAL

SEQ ID NO: 28474 - protein, 461 aa, Rhodococcus sp. RHA1
MTTVTNSSPTTAHLEAAARRHLWGHFSRHGQNITPPIITRGEGARIWDTAGKSYLDGLSGLFVVQAGHGRTELAEAAAKQAEQLAFFPLWSYATEPAIELAERLAGYAPGDLNRVFFTTGGGEAVESAWKLAKQYFKKVGKPGKHKVISRSIAYHGTPQGALAITGIPALKAPFEPLTPGAFRVPNTNIYRAPEPLGSDPKAFGIWAADRIAEAIEFEGPDTVAAVFLEPVQNAGGCFPPPPGYFERVRQICDEYDVLLVSDEVICAFGRIGSMFACDDFGYVPDIITCAKGLTSGYSPIGAMIASDRLFEPFSDGTSMFAHGYTFGGHPVSAAVALANLDIFEREGLNAHVAEQAPAFRATLDKLTDLPMVGDVRGEGFFYGIELVKDKTTKESFTDDEAERILHGFLSTALFDAGLYCRADDRGDPVIQLAPPLICGQAEFDEIEHILRSVLTEAWTLL

SEQ ID NO: 28475 - protein, 115 aa, Bdellovibrio bacteriovorus HD100
MTSELPEVKITDTVIGTGQTASKGALVFCHYEGFLEDGTKFDSSYDHGRPFEFVVGSKKVIAGWSLGFLGMKEGGKRTIYVPAHLAYGERQIGKFIKPHSNLIFHVELIEARPRE

SEQ ID NO: 28476 - protein, 635 aa, Triticum aestivum
  misc_feature (369)..(369): Xaa can be any naturally occurring amino acid
  unsure (1)..(635): unsure at all Xaa locations
HYRTSLYKKAGWYRSGIPGISSTHASAFAQLSLSFNAVKYSVDMPQAMSAQGVTDDHLVLLKGVSGSFRPGVLTALMGVSGAGKTTLMDVLAGRKTGGYIEGEITVSGYPKKQETFARISGYCEQNDIHSPHVTIYESLVFSAWLRLPAEVDSERRKMFIEEIMDLVELTSLRGALVGLPGVNGLSTEQRKRLTIAVELVANPSIIFMDEPTSGLDARAAAIVMRTVRNTVNTGRTVVCTIHQPSIDIFEAFDELFLMKRGGEEIYVGPVGQNSANLIEYFEEIEGISKIKDGYNPATWMLEVSSSAQEEMLGIDFAEVYRQSELYQRNKELIKELSMPAPGSSDLNFPTQYSRSFVTQCLACLWKQSXSYWRNPSYTAVRLLFTIVIALMFGTMFWDLGSKTRRSQDLFNAMGSMYAAVLYIGVQNSGSVQPVVVVERTVFYRERAAGMYSAFPYAFGQVAIEFPYVLVQALIYGGLVYSMIGFEWTVAKFLWYLFFMYFTMLYFTFYGMMAVGLTPNESIAAIISSAFYNVWNLFSGYLIPRPKLPIWWRWYSWICPVAWTLYGLVASQFGDIQQPLDQGVPGPQITVAQFVTDYFGFHHDFLWVVAVVHVAFTVLFAFLFSFAIMRFNFQKR

SEQ ID NO: 28477 - protein, 573 aa, Novosphingobium aromaticivorans DSM 12444
MTDVTKWLASLEAALAGEDKAAVASLFLPTGLWRDFLAFDWTLATHEGGEAIAAFAAARGGATATHSWATSAAPSASEGFISFETAVGAGRGYVRLMDGKALSLFTMLADLRGHEFPVRGRRASGVVHDAQGRNWQDLIAAERSAMGTSEQPYVLVVGAGQAGLAIGATLRLLGVPHLLIDKHPRVGDQWRSRYKSLTLHDPVWYDHMPYLPFPDHWPVFTPKDKMGDWLELYAEAMELNVWCDTELLAARHDPATGAWTARVRRGGTEIELRPTQLVMALGNAGFPRVPQIEGQDRFKGAQYHSSAHSGGEGLAGKRVVVIGANNSAHDICADLVEHGAHATMVQRSSTHIVRQHTMTDVMLKQVYSQEAVDAGITTELADLINASVPIRLAEISARQAWAEIREAEAPFYARLEQAGFKLDFAEDGAGINGKYLRAASGYYIDVGASEMIADGRIALKSGTEISHLTETGVAFADGTHLEADIVVYATGFGSMEEWVARLIGEDVAMKIGKCWGYGSGYKGDPGPWEGELRNMWKPTAQEGLWFMGGNLAQVRFYCKVLGLQLKARHAGLV

SEQ ID NO: 28478 - protein, 401 aa, marine gamma proteobacterium HTCC2080
MSGVLIVGAGQAGGTAALQLRASGYDGDIKLAGSEPHAPYERPPLSKGYLSGALAYNSLLVRPETTYEQQQIELLKETTIARIDPESGIAQTSKDCEIKFDRLLFTTGARPRQLLIPGAELPGVYYLRTIADVEKLKGAMATAKRVCLIGGGYVGLEFASVAIKAGLDVTVLESADRLLKRVTTETMSHYFENLHRSQGVDIQCNSEIFSIEGEVCAERVVCRNSVIEADLILVGIGAIPNTELAESAGVECDNGILVDEQCRTSVANIYAAGDCTNHPNHYLNRRLRLESAPNATDQAKVAAVNMLGEDKCYRSVPWFWSDQFSSKLQAVGFSADGTSSVCRGRQEEHEFATFYLHDNRLVAVEAINFPRAFMVGKRLYGLQVDVEKLADSSVDLKSLLV

SEQ ID NO: 28479 - protein, 197 aa, Bacillus cereus E33L
MKVLQEKILNEGKVLSGDVLKVDAFLNHQIDPVLMQEIGKEFAKRFKEENITKIVTIESSGIAPAVMAALELGVKVIFARKRKSLTLQDNMYVASVYSFTKQETNEISLSRNHIDESDRVLIIDDFLANGQAALGLMSLVEQAGASIAGIGIVIEKAFQDGGKKLREQGIRVESLAEIASLDNNAVTFVQQETAEVK

SEQ ID NO: 28480 - protein, 562 aa, Shewanella sp. ANA-3
MDDNKRPLYLPFAGPAILEAPLINKGSAFSEEERIFFNLEGLVPYAIETIEEQASRAYDQFRSFNNDLDKHIYLRNIQDTNETLFYRLVQNHISEMMPIIYTPTVGLACERFSKNYRRNRGLFISYPNKDRIDDILNNSTRQKVKIIVVTDGERILGLGDQGIGGMGIPIGKLSLYTSCGGISPAYTLPITLDVGTDNPQLLEDPMYMGWRHPRIGGEEYAEFIEAFMQAVHVRWPDTLIQFEDFAQKNAMPILERYKDRYCCFNDDIQGTAAVTVGSLLAACKAAGTELNKQRIAFLGAGSAGCGIAEAIVAQMVSEGISDEQARSQVCMVDRWGLLLDNMPNLLPFQQKLAQKCADICNWNNFSDNISLLDVVNNAKPTVLIGVSGAPGLFTEEIVRAMHSHCERPIIFPLSNPTSRVEATPKDILHWTSGQALVATGSPFEPVVVDGETYEIAQCNNSFIFPGIGLGVLASGARHVSDAMLMASSRALAECSPLAINGSGPLLPKLEDIHSVSKHIAFAVGKVAIEQGLSLPASDELLMQSIEDNFWKPEYRRYKRTSF

SEQ ID NO: 28481 - protein, 468 aa, Thermobifida fusca YX
MQPGSHQNPQGDTDVPSPAPATGPRNGLSAGLTTLSLGIQHVVAMFGATFVFPLLMGLDPNLAIMMSGICTILFLLIVNGKVPSYLGSSASFVAAAVIIAADGGGPATITGAVLVTGVVLALAGFVIHLLGPNAIVRAFPPAVTGGVVMLIGFNLAPVVSESYWPYDQWTALLTMAFVILATVVLRGFLSRITVLLGLVFGFVLSWVFDRLFGMTPTPQEDGSVKDAFRVDLSGVADAPWFGLPEFHAPEFHLSAILVALPAVIALIAENAGHVKAVQEMTGNDLNPYMGRAIFADGVATALASSVGGAPTTTYAENIGVMAITRVYSTAPYYVAAVIAILIGLCPKFGALVYAIPQGVIGGITVILYGMIGLLGAKIWVENQVNFADPLVLVPIAAGLIAGIGNVSLVFTDGFQISGIALGTIVILAGYHLLHALAPRSKTHAAPSPGAPAGSGAEGGKAEQHAVQD

SEQ ID NO: 28482 - protein, 610 aa, Arabidopsis thaliana
MVANNNTSSNRRKRIITEGDIATLLLRYDMETILRMLQEISYCSETKMDWNALVKKTTTGITNAREYQLLWRHLSYRHPLLPVEDDALPLDDDSDMECELEASPAVSHEASVEAIAHVKVMAASYVLSESDILDDSTVEAPLTINIPYALPEGSQEPSESPWSSRGMNINFPVCLQKVTSTEGMNGNGSAGISMAFRRKRKRWSAEEDEELFAAVKRCGEGNWAHIVKGDFRGERTASQLSQRWALIRKRCHTSTSVSQCGLQGTEAKLAVNHALSLALGNRPPSNKLAIGLMPTTSSCTITETEANGGSSSQGQQQSKPIVQALPRAGTSLPAAKSRVVKKTTASSTSRSDLMVTANSVAAAACMGDVLTAASGRKVEPGKTDAPRVPKTKPVKHASTVCMPQPSGSLSMPKVEPGTSVAASIRSLANGKLKPVMASSSSNKPPLIAPRSEGSSMLSASAPLASLSRIVSNQRVFAGSVPATEIVTCKPDGGQKGQARGNEASSSAAIQPHQITSRNLEISQGKQATQAQSPNLLPRKVPVVRTAVHCATNQKLMDKPSDQTVVPIRGAGSQSKAKGEVNSKVGPVIKVSSVCGKPLEVATVAGTGQGV

SEQ ID NO: 28483 - protein, 389 aa, Triticum aestivum
YGFDKGDIGRLFIAGFGSSMLFGTIVGSLADKQGRKRACITYCITYILSCITKHSPQYRILMIGRVLGGIATSLLFSAFESWLVAEHNKRGFDPQWLSITFSKAIFLGNGLVAIVAGLFANLLADNLGFGPVAPFDAAACFLAIGMAIILSSWGENYGDASEGKDLMAQFKVAAKAIASDEKIALLGAIQSLFEGSMYTFVFLWTPALSPNDEDIPHGFIFATFMLSSMLGSSIASRLLARKMKVEGYMQIVFSISAFTLFLPVVTNFIVPPSEKGGSISFGGSVQLLGFCIFESCVGIFWPSIMKMRSQYIPEEARSTIMNFFRIPLNLFVCVVLYNVNAFPIAVMFGMCSIFLFIAAILQRRLMSVSDLHRSTKAAEMTAEDEPLNP

SEQ ID NO: 28484 - protein, 399 aa, Marinobacter sp. ELB17
MSDNRGVVYIGPGKVEVQSIPFPKLENPQGRRIGHGVLLKVITTNICGSDQHMVRGRTSALAGLVLGHEITGEVIETGSDVENFKVGDLASVPFNVACGRCRTCKEQDTGVCLTVNPSRAGGAYGYVDMGGWVGGQADYVMVPYADFNLLKLPHRDLAMEKIRDLTCLSDILPTGYHGAVTAGVGPGSTVYIAGAGPVGLAAAASSRLLGAAVVIVGDVNPTRLTHAKSQGFEVVDLSQDASLGDQIAELLGIPEVDCAVDAVGFEARGHGHEGVREEAPAIVLNSLMEITRAAGKLGIPGLYVTEDPGSADTAAQKGNLSLRFGLGWAKSHSFHTGQTPVMKYNRQLMQAIMWDRIKIADVVGVEVISLNDAPLGYGEFDAGVPKKFVIDPHNSLKLA

SEQ ID NO: 28485 - protein, 411 aa, Arabidopsis thaliana
MDSGKDMWSRLCLLAETVVMAAEEEEQRRRLLAEKREDSKSQKKTVSEEDDSEKRFLSHVPRKKRSSLVKRQQKPNGVSTSSSSLPDLNQIPIDYETETKQNPSFIERLVCDEEQRVKKGKSRIIWEEEEEADEDSEKRLFEKNLMKFVGHSQQQQKFETLNGASSSSSFLNLRCYEASLFLDYNTVESEKTETKVLPNPNYQSSSPSSCLTENDTSRKRRAVEQRKSGKVKKVKVSPLPRLSTETPEWVFQAMGHMNADAETPKLIFERTLFKSDVNSNLSRLLIPFQKLIRNDFLTPEECRAMQEDKDKDDEDISVGTILVCQAKQEDEDKDDEDIGAGTILVNQRFKMWGLRFKIWGMEKDSGHGTLNYILNWDWNDVVKGNSLKAGDNIGLWTFRCRGVLCFALDTW

SEQ ID NO: 28486 - protein, 269 aa, Coccidioides immitis RS
MSTLHEITSEADFTTQLSSLPSTSLAVLSFHTPWAAPCTQMRNVLSTLASTYPATTPPSIHFLSINAEDLPDISEQYDVSAVPYLVLLRDNKIVETVSGSDPVRVREAIEKHVGQDGQTDRPSIPPPLVAVPRATAAQDTSDDATASDAQLEPPVPTKEELFARLSELVKAAPVMLFMKGTPSAPQCGFSRQIVSILRENGVKYGFFNILADEDVRQGLKEFADWPTFPQLWVKGELVGGLDIVKEEISANPDFFCDYSVSKPTSAPSA

SEQ ID NO: 28487 - protein, 575 aa, Oryza sativa (japonica cultivar-group)
MDVKRARSPRAPGVDADDDKKRAAEWRGAVRPHMVLVGFLITLPVLVFVFGGRWGSFQTTSAPNVGGRHVVPGGVTTTQKNEAPKNVSVPATATKSLPQPQDKLLGGLLSAAFEESSCQSRYKSSLYRKKSPFPLSPYLVQKLRKYEAYHKKCGPGTKRYRKAIEQLKAGRNADNAECKYVVWFPCNGLGNRMLTIASTFLYALISNRVLLMHVAAEQEGLFCEPFPGSSWVLPGDFPHNNPQGLHIGAPESYVNMLKNNVVRNDDPGSVSASSLPPYVYLHVEQFRLKLSDNIFCDEDQLILNKFNWMILKSDSYFAPALFMTPMYEKELEKMFPQKESVFHHLGRYLFHPTNKVWGIVSRYYEAYLARVDEKIGFQIRIFPEKPIKFENMYDQLTRCIREQRLLPELGTAEPANTTAEAGKVKAVLIASLYSGYYEKIRGMYYENPTKTGEIVAVYQPSHEEQQQYTSNEHNQKALAEIYLLSYCDKIAMSAWSTFGYVAYSFAGVKPWILLRPDWDKERSEVACVRSTSVEPCLHSPPILSCRAKKEVDAATVKPYVRHCEDVGFGLKLFDS

SEQ ID NO: 28488 - protein, 812 aa, Coccidioides immitis RS
MTYLQRVKDWISYDAFPLALRQRRKGSEKIGLAPSGEDDSHVEANRKLHLYHRVHRWDPNLEDEYLDEVKDAANSYDGSPTNKRMVRRVLENSPYPEVRAAVRNTDEDLPVDTIRAWTIGLFLTTVGAGLNSLFSLRAPSIVVSSMVALLLAHPLGLGWTKVMPNKKIKIFGSEWDLNPGPFNLKEHALIVIMANASIGNGVAYFTDTVQVQIAFYNADFGWLWNICLAISTQMVGFGIAGLLRRILVEPASGSMIWPQTLVTTSFLYTLHDDTPPNPATTNGWQISRYRYFLYIFTGAFVWYWFPGFIAPFLSVFAFATWIKPNDPLVNQLFGGWTGISLFPITFDWSQIAGYVGSPLIPPWHAIGNTLIGTTVTYLIVAPIIHYTNYWYGRHIPIHDSSIYDNRGHLYNVSMVLSANNTFDVQKYKEYSPIFLPTTMALTYGLHFAAIAALIVHTALFHGQQIWIRARDARGDLDDVHTRMMRKYEQVPTWWYLALLGGCLALCFITCLAWPTHLPWWALMIALLIAIIWTVPIGIVQGSTNIQIGLNVFTEYIIGYMLPGRPLGMMLFKTYGYITMAQALSFIQDLKIGHYLKIRPRSLFWAQVIATFWSCFVQLAVIIWGLGNIEGVCERDQPNRFICPGGRVFFASSVLWGLIGPARIFSGEAMYAGLQYFWVAGALAPIFFYILARMFPRSKVRFVNTPILFGGTLMLPPATPLNYLAWGIVGFGFQKYIRYRFTGWWMRFNYITSAALDTGLAICTIVIITTLQLPNISFPSWWGNTAALKTMDQMGTAIIDPVPPGETFGPRSW

SEQ ID NO: 28489 - protein, 412 aa, Bdellovibrio bacteriovorus HD100
MLVFYATGMILGAGVYSVIGKAAGVAQEGLWLSFILAALAAVLTALSYAELATLFPKAGAEYVYMKEIFPQRKILSFLCGCLMIFAAIITASTVSLSFAAYTQDFFKAPEMLVAIVLLGFFTLVNIWGVRESGWVNIVFTLVELSGLVIFIFVGLRQPDFGKVLSVPVSWGVVTGASLIFFAYLGFESMVNLAEEAKKPDKNIPRAILLSLSLTTVVYVAVSLAALAMMSPGDLQKSDAVLSAALQKHSPEAARALAGIALFATANTVMIALLGASRISLGMARGRDLPKVFSKILPQRQSPWLSSLLVFLLALLFLPLKKIEVLASVSSFVTIVVFIIINGAVVYLRRKEPQRKRPFRVPGAVAGWPVLPILAAGMALFFLFNFEEQVYYVGVGIVIFVLVVYQALHFRRA

SEQ ID NO: 28490 - protein, 652 aa, Rhodococcus sp. RHA1
MKAAQQVQEAGAATDDRINPDRLTESEIRTAVARANVPSLLMVVFQTTGDEKWLAAPYRPTRGKGLGDHDSGGLEEPIQDEIREAAVKAILDLQNGALPAVETPSPELTVRMISVCTGEEVGEEYGPMLSLELARRAAPDAPSLALEPVDAPEGYSVVVIGTGVAGIAAAQQLEDMGIDYVILEKQPEAGGNWWQNTYPGAGVDTPSHLYSFSFAKNDWTTHFELRNELQAYFGAVLKDLGAGERVRYGTEVRSTRYDEAAAQWSVDMINPDGSSSTLRADVVISAVGVLNRPKTPNVPGMDSFTGTSFHSAAWPDDLDLDGKRVAIVGTGASSMQIAPAIADRVAHLSIYQRSPQWVAPFEKFRAPIPMELRRLMQTCPIYHSWYWIRLFWQFGDKVIESLRVDPEWEHPERSVNARNDAHREYFTRYITSQVGDRTDLLDKVMPDYPPFGKRILLDNGWYSTLRKDNVDLVDRSVTAVRPEGLVDDQGAENDVDVIVWATGFEAARFVSSMDVVGMDGRTLREVWNDDDPKAYLGVSVPGFPNFFMLGGPNSFPGSGSFMFFMEVQMRYIRGLLTEMFKKGIKAIDARPEANEEYNELVDSTHARTVWTHRGMSTYYRNSHGRVVFVMPFLNVEYWQMTRRPDLENYTAR

SEQ ID NO: 28491 - protein, 918 aa, Arabidopsis thaliana
MAPKKDKVPPPSSKPAKSGGGKQKKKKWSKGKQKEKVNNMVLFDQGTYDKLLTEAPKFKLITPSILSDRMRINGSLARRAIRELMAKAKKMDSSYSFALGTSSSILPKLSFRNVENRFYGEKNNNNGLCKRFGSDLGSKKFRNQKFKHGVVYAVATSDNPKKAMTVKTSMFERRKVDPQNVAAIILGGGNGAKLFPLTMRAATPAVPVGGCYRLIDIPMSNCINSCINKIFVLTQFNSASLNRHLARTYFGNGINFGGGFVEVLAATQTPGEAGKKWFQGTADAVRKFLWVFEDAKNRNIENILILSGDHLYRMNYMDFVQSHVDSNADITLSCAPVSESRASNFGLVKIDRGGRVIHFSEKPTGVDLKSMQTDTTMLGLSHQEATDSPYIASMGVYCFKTEALLNLLTRQYPSSNDFGSEVIPAAIRDHDVQGYIFRDYWEDIGTIKTFYEANLALVEERPKFEFYDPETPFYTSPRFLPPTKAEKCRMVDSIISHGCFLRECSVQRSIIGERSRLDYGVELQDTLMLGADYYQTESEIASLLAEGKVPIGIGKDTKIRKCIIDKNAKIGKNVIIMNKGDVQEADRPEEGFYIRSGITVIVEKATIQDVHLQLEELKFRDIDLENNKKHSQPKPDLLLFRCVVERSLFEEANSFFFFTIHSLLALLLVVLMLLSMNLGITCELFSSDCSDSRSNFRDLLKSISPMRNSLFLGFLDSLVSRITMEGSGGDSGSMATPVQKKVHEAWRVYQYYLDKTTPHSTNRWIGTLVFFLIYCLRVYSIHGFYIISYGLGIYLLNLLIGFLSPLVDPELEVSDGATLPTRGSDEFKPFIRRLPEFKFWYSMTKAFCIAFLMTFFSVFDVPVFWPILLCYWVVLFVLTMRRQIAHMIKHKYIPFSIGKQKYSGRKSSANSGGGSRAD

SEQ ID NO: 28492 - protein, 533 aa, Shewanella oneidensis MR-1
MRIFTVPEDADSTLSIIEQKLSEDLAGFLGDSIAALEKPLSEIETDFQTFEIPNQPRFVSDYTDEIMQNLVAHSVHTAAPSFIGHMTSALPYFVLPLSKMMVGLNQNLVKIETSKAFTPLERQVLGMMHHLIYAQHDDFYRNWMHSANHSLGAFCSGGTVANITALWIARNQLLKADGDFKGVTREGLIKALRHYDYDDLAILVSERGHYSLGKAVDLLGIGRDNIISIPTDADNKVDVTQMRKIAVELAHKRIKVMAIVGVAGTTETGNIDPLKQLAALASELNCHFHVDAAWGGASLLSNKYRHLLDGVELADSVTIDAHKQMYVPMGAGMVLFKNPEFAHAIAHHAEYILRRGSKDLGSQTLEGSRPGMAMLVHACLQIIGRDGYEILINNSLEKARYFAEQIDAHPDFELVTAPELCLLTYRYVPASVQAAMQVAIEQGDKAKLERFNEQLDGLTQFIQKHQREQGKSFVSRTRIQPARYFRQPTVVFRVVLANPLTSHEILNQVLIEQGEIATLDKEFLPALLAMVAE

SEQ ID NO: 28493 - protein, 432 aa, Vibrio cholerae O1 biovar eltor str. N16961
MTKSAELYQKAQTTIPGGVNSPVRAFNGVGGSPIFIDRADGALIFDADGKAYIDYVGSWGPMILGHNHAVIREAVIQAAQRGLSFGAPTEMEITMAELVSELVPSMEQLRMVNSGTEATMSAIRLARGYTGRDKIIKFEGCYHGHADSLLVKAGSGALTLGQPSSPGVPADFAKHTLTARFNDLDSVRELFAANQGEIACIIVEPVAGNMNCIPPVEGFHEGLREICDQEGALLIFDEVMTGFRVALGGAQAHYNIKPDLTTLGKVIGGGMPVGAFGGRREVMQYIAPTGPVYQAGTLSGNPIAMAAGYACLNLLREEGNEKRLAAKTKQLADGFKSLADQHGIPLLVHQVGGMFGFFFTEQETVTCYEDVARCDVERFKRFFHLMLQHGVYLAPSAFEASFTSLAHGSKEIEATLEAADRSFAILAAEAKA

SEQ ID NO: 28494 - protein, 435 aa, Burkholderia vietnamiensis G4
MIPVPSKTAGGFALNGRSAQPSDGAARAALEGRRTGVAALLPFVGPAVIASIGYMDPGNFATNIQAGAAYGYRLLWVVLAANAIAMLFQAMSAKLGIVTGRNLAELCRERFPAPVVWGMWIASEIAAMATDLAEFLGGALAFGLLCHLSLFAGMIATAFATCAILALEKRGFRPLEAAIATLVGVIGACYLGELLIAPQDWQAAAFHLVVPQIPDHAALTIAVGIIGATIMPHTLYLHSGLTQDRAAPRNDAERRRLVRFSNREVVIALGLAGFVNLAMVMMASSAFHATAPGMTDIGDAYHTLIPVLGPAAGALFLVALLTSGVSSSVVGTMAGQVVMQGFIRRRMSIWLRRAVTIAPAFLVVALGCDVTRAMVVSQVVLSFVLPMPMIALLMLSARTDVMGAYAMRMPLRIVAGAATVVIVGLNAYLVGAAFN

SEQ ID NO: 28495 - protein, 195 aa, Brassica napus
LPEMQARAIFEAAASMQKQGVTVLPELMVPLVGTPQELGHQVNVIREVAKKVFAETGHTVSYKVGTMIEIPRAALIADEIAEEAEFFSFGTNDLTQMTFGYSRDDVAKFLPIYLAKGILQNDPFEVLDQRGVGQLVKMATEKGRAARPNLKVGVCGEHGGEPSSVAFFAEVGLDYVSCSPFRVPIARLAAAQVVA

SEQ ID NO: 28496 - protein, 104 aa, Xylella fastidiosa 9a5c
MLVMERIQAEIEEHPLVLFMKGTLEFPMCGYSSRATQALLAAGARHLHIVNVLAEAEIRANLPRFSNWPTFPQLFIHGELIGGCEIILELFESGDLKRIVSEAD

SEQ ID NO: 28497 - protein, 535 aa, Oryza sativa (japonica cultivar-group)
MARALRWPDLVGLGLGGMVGAGVFVTTGRATRLYAGPAVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLVAVGVILLITVCICYSTKESSSVNMVLTAVHVLFIMFVIVMGFWRGDTRNLTRPADPEHNPGGFFPHGAAGVFNGAAMVYLSYIGYDAVSTMAEEVERPSRDIPIGVSGSVVLVTLLYCLMAASMSMLLPYDAIDTEAPFSGAFKGSSGWGWVSNVIGAGASLGILTSLMVAMLGQARYLCVIGRSGVMPAWLARVNPRTATPVNASAFLGVFTAALALFTELDILLNLVCIGTLFVFYMVANAVVYRRYVAAAEDDEEGRRRGAVPTLAFLLAFSLVALCFTLVWKLAPRGGARTGLLVACGAAAAAAVAAFRALVPQARRPELWGVPAMPWVPAASVFLNVFLLGSLDRPSYVRFGFFTAAAALVYVLYSVHASYDADEAAAALDGAKVLDEGCKV

SEQ ID NO: 28498 - protein, 122 aa, Zea mays
  misc_feature (90)..(90): Xaa can be any naturally occurring amino acid
  unsure (1)..(122): unsure at all Xaa locations
EARLSGLNLARMFGDKFLKEQDPRFSSEPYVSQAVRITKACTAFAVIASDGLWDVISTKRAVQLVFEGKERRSSGDATSAAARVASRVLXDEARSLRTKDNTSVIFVDFDVLRTDPCISPVD

SEQ ID NO: 28499 - protein, 564 aa, Burkholderia thailandensis E264
MTARGAHGSSACVRPRRFRRSHARRAGRSRPPPGAPPPSERPPTARTEHDAMNLIAALERAARATPDKPFLRDDGATITYRQMQQRSRRAAEVLASLGIAPGERVAAMCLNTPAFFDLLLGAWRIGAVVVPVNHKLQAPEVDHILRHSASRAVLFDAALAPVLAGVGHGALRLVTEGDAAGAAPFDRLVADAPGIASGTPDDAALAEILYTSGTTGRPKGCMHSHRTVALAAATSALALSMTERERTLMAMPIWHASPLNNWFGGTLYVGGTVVLMREYHPLRFLQTVEAEQATLYFGAPVSYTLPLDTIADFASFDLTSVRAWLYGGGPIGAALARRLMRAYRSEAFYQVYGMTETGPAGTVLHPFEQTMKAGSIGRQGTPGVDVRVVTAVGDVARPGEIGEIRLRADSMMLGYLDDPDATRAAFDDDGWHRSGDVARVDDDGYLFVVDRIKDMIVTGGENVYSKEVEDVLTEHPAVAEAAVIGRAHPQWGETVIAHVVLRGAGSADRAPDGERAVDADALRAFCATRLAAYKIPREYVFAERLPRTPTGKLQKYLLRARGGA

SEQ ID NO: 28500 - protein, 91 aa, Synechococcus sp. WH 8102
MPSDPLTPAVSARICKHMNEDHAEAVLAYAHHYGGVDAASAAEMVAVSATDMELKVDGQPLRIPFDHTLTDSEDAHRTLVAMLRAMPKQDA

SEQ ID NO: 28501 - protein, 137 aa, Arabidopsis thaliana
  misc_feature (50)..(50): Xaa can be any naturally occurring amino acid
  unsure (1)..(137): unsure at all Xaa locations
SRAGHTRPENPKRVRNQQEEVWVSFMSSSTVGVTSRVKATMVVPLTGWKXSVFFRVTRRANNDFTSLTGNGGGVSCMKGGPPIGKKKLGTLFYLPDLRDVEWVKEVDYLFRTKGIPGVEFKWEHGFWYREHGNTPGS

SEQ ID NO: 28502 - protein, 106 aa, Brassica napus
MGRKKGLPEFEETAPDGFDPANPYKDPVAMMEMREHIVREKWIQIEKAKIMREKVKWCYRVEGVNHYQKCRHLVQQYLDSTRGVGWGKDHRPMSLHGPKPEAVEAE

SEQ ID NO: 28503 - protein, 1175 aa, Thermobifida fusca YX
MFRAGPVWVVSPADLVDVVECPHRSVLHQARAAHQEGAPTPQIVDPLAGEAREELVEAELRRLRALFGGDAVATVAPPRPVLDEVHVAAQATREAIRDRVPVIHHGVVVAPIQPGVLLFGQVDFLIATTVDPETGACREGVPAGYEPWQAVGHATPRTIVELAACATMLADTLPQAPEFLHVRSENGHHALRVSDYVPLVGVAQDRLIRRLAAPPELPSPVWGEPCPACETCGFATWCAQGRARDRHVSLVAGIRGDQIVKLQAVGITTIDALARAGEEQRPPLLARRTYTRLREQAALQVRQDATRTADNPTGRVFATVYAEDGLVLLPAPSAGDVVFTVATTPVGDDGELAFLWGAYLPSEERHCVWWAHDRAEERVAFAAFVDFVSGQLRADGEAHLYCYTPQGASRLAAFAASLGVREAEVDDLLRQRRCVDLSDVVKKSVRVSQRSYALSALEPLYLGDDAQRWGGGEPQPDGYAAYRRACRAGDSRQAQAVQEALAAQVRRECVSVARLRDWLEKLRVDHGIVARPAPPETVGVDPGQQEQAAARRAAVEERIRSLTEALAGPAAGEGRGEDQDAWDVLSALLGYYRREEAPLWWDFFRRLSAPVEELEADADCVVPLWVRAHAWVPPQGRQRKAARHVEVGADPRRLHPFGVGDQVRLLYPGVAGQGAEAVPATVVEAAADRLVVVEKADVGAEHDRQPLAVLPGAPVRSTPKDEALWEVAERVAAALPRPPQMAGVDLLRRVPPRLRGGGALPDPGDFGGDTVAAVLAAVDALDDSYLAVQGPPGAGKTYLAARLITHLVGRGLRVGVCATSHQAIENVLRAAVRAAAEAGVGVPCAKRPSGVSPDRRVPWEQPRQVRDLVQWCHRQEGGYLVGGTAWNFTHPQMRGLGVDVLLIDEAGQFALADAVAVSAAARSLVLLGDPQQLPHVVQGVHAAGADRSALEHVVGDADIIDPAYGYFLAHTRRMHPGVCTVVSHLAYQGRLSAHPDAALRGLAGVEAGVYRKVVAHQGRSTHSPEEVRAVVEVVAQLVGREWCEPGRPPRPLQGSDIMVVAPFNVQVRALRAALAEAGLEAVRVGTVDRFQGQEAPVVVCSMTVSSAREAPRGMEFVLSRNRLTVALSRAQAVAVVVCAPSLVESAARTMAELRALAGFAHVWAQARDWPDPAPG

SEQ ID NO: 28504 - protein, 883 aa, Yarrowia lipolytica CLIB122
MSSKDSFNIDPSIHESPDVLGWIAYQLGIPPSEDTGDYPLEVHFMAEKFQEMTEAEAIDIVRKNLKYHSNDHNFSDHDRVLLTHLVAVVGGANQPHESEEHSHEETGSDEKADPEKDPTSENEDVKLLRYWATLFHWWSPYPEVRSVTDPYDDTECTTETWRVWVIGTIWVGISAFVNQFFSLRMPHITLTVSVCQLLLYPSGRLLQYCLPDWGFKVRGRRLTLNPGVWSQKEQLLATIMVSCASGTPYVTSNVLVQYLPRFYNQPWANDYGYMFLLMLVTQMLGFGFGGLMKRVAVYPVKAMWPTLLPTLAVNRALLAPRRKEIVDGWKVSRYTFFLAVFLFSFLYFWVPDYLMKFFSTFNWMTWIAPKNLDLAVVTGSIGGLGYNPISSFDWNVAVSRFQPVFTPLFSNLNTYIASLISGLIILAIYYTNNNWTGYIPINSNRLFDNKGKSYDVKRILTDYKFDDKKYREYSPPYYSAGNLVSYGSSFCVYPLMFLYTVLMDWDIMKDALMEMVKSIRHITRSNYEGRDDPFSRRMRQYPEVPDWWFYLILIIMFGLSIALVEHWPMQTPVWTLVFIIGLVGIFLLPLTIIQGYSGVQMSLNYLSELIIGYALPGQFMALNFVKAMGVQISTQAQHYANDQKLTHYAHLPPRSIFWLQLWATLVNGLICMGVVKFQITSIDDLCDPKNKDRFTCPGDTTFFSASVAWGIIGPKKMFDHQYPILKWMFLLGTVLALVFYAAQELIPNLMMKKYPHKTVQIENFKRKALMFNPILFCHGCIDWAPYNLSYKTTGIYIAIFFNYYLKNRFMNWWRKYAYVFSAGMDTGIALSAIIIFFSVEYVKHELKWWGNTVSNAGADNNGPPARLPIPKIGYFGPDSAHYP

SEQ ID NO: 28505 - protein, 193 aa, Enterococcus faecalis V583
MNVHNAEIVISAVSPKQYPESQLPEIALAGRSNVGKSSFINTLINRKNLARTSGKPGKTQTLNFYLIEDALHFVDVPGYGYAKVSKTERAKWGKMIETYITQREQLRAVVSLIDLRHPPTQDDIQMYEFLKYYDLPVIIVATKADKIPRGKWNKHESVIKKALNFDKQDDFIIFSSETKEGKEAAWTAIEKFL

SEQ ID NO: 28506 - protein, 473 aa, Mycobacterium tuberculosis H37Rv
MRHYYSVDTIRAAEAPLLASLPDGALMRRAAFGLATEIGRELTARTGGVVGRRVCAVVGSGDNGGDALWAATFLRRRGAAADAVLLNPDRTHRKALAAFTKSGGRLVESVSAATDLVIDGVVGISGSGPLRPAAAQVFAAVQAAAIPVVAVDIPSGIDVATGAITGPAVHAALTVTFGGLKPVHALADCGRVVLVDIGLDLAHTDVLGFEATDVAARWPVPGPRDDKYTQGVTGVLAGSSTYPGAAVLCTGAAVAATSGMVRYAGTAHAEVLAHWPEVIASPTPAAAGRVQAWVVGPGLGTDEAGAAALWFALDTDLPVLVDADGLTMLADHPDLVAGRNAPTVLTPHAGEFARLAGAPPGDDRVGACRQLADALGATVLLKGNVTVIADPGGPVYLNPAGQSWAATAGSGDVLSGMIGALLASGLPSGEAAAAAAFVHARASAAAAADPGPGDAPTSASRISGHIRAALAAL

SEQ ID NO: 28507 - protein, 204 aa, Synechococcus sp. WH 8102
MRNYSAIADFAKTLAGTFDNINQAQENPKDFARIKIFFRPLPWRIFRGPGFYSEQCYDYAPWDPYRQGIHRLVLDQNLFVMENFAFDNPRRLAGAGRNPELLDDLHSESLKRRCGCAMHFRSISPGHYVGNVEPGKSCLIPRDGKLTYLVSEVEVNQTSWISRDRGFDPENNAQVWGSEHGMLRFKKITSFSNEITNEWLELKT

SEQ ID NO: 28508 - protein, 425 aa, Campylobacter upsaliensis RM3195
MTNKAAFKEAFKVIAGGVNSPVRAFASVGGEPCFIAEGEGAYIKDIEGKRYIDFVQSWGPLLFGHCDKDIVKACKKALKKGTSFGAPTLSESHLAKLVLEDFKHLDKIRFVNSGTEATMSAIRLARGFTKREKILKFEGCYHGHSDSLLVSAGSGAATFNTPSSLGVLNEVAKQTLVARYNDIESVKELFEKYKGEISCVIIEPIAGNMGLVLGEQKFLEELARLCRQNGALLIFDEVMSGFRASFLGSFGVNKIKADIVTFGKVIGGGLPAAAFASRAEIMDILSPLGGVYQAGTLSGNPLAMAAGIASISKAKKDKELYKKLARLAKILTQGLSELAKEKGVPFNATFVGSMFGYFFTEDPVRNYQDALKSNLKLFAKFHQNMLKQGIYLAPSQFETGFICDKMDEKMMIKTLEAARKSFKAL

SEQ ID NO: 28509 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSEDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSAFPKWPSKDLATIVPNLDGAGLDLLDKMLRLDPSKRITARNALEHEYFKDIGYVP

SEQ ID NO: 28510 - protein, 636 aa, Enterococcus faecalis V583
MNIKDIAKLAGVSASTVSKIINNKDQTISKETRERVLKIVRDYNYTPYSANLVTNSTTKTFVLLLNSHETFEAWVTSFIDKAQENGYNCLILNSHGSLEQELKNITSPTLKQASGIIWDPINENSKQYAKFIEELTIPYYFVNHSTNELPSLAGLYEEASYVLTQELLQNNHKKISYFVTNPKYKEAIIAGYKKALFDVNLPFSKENILTTIPADFSNQLITDGITGILTDDYTQAVFLEQLLKQSGLRTPDNYSLLAIKRKIDRSFLPDHISSVLLDTETFGSKLALLLLNKRKEKTALINEAEKLVLDHKNTLGMSSVNPHSKMIVVGSLNVDNYLYSTNLPHNGKTNFLSSYAKFPGGKGLNQAVGLTKLGHQATLIGCLGSDTDANYLYKELEKYHVTTDGITRIQDTETGQAYIYVETSGDSMISILPGANTALTPKKIAQQKHLFMDASFCLIQTEIPLSAVEKACEIAQHSGVPIILKPAAIHHIPVNILEKVDFFIPNEDELLELQPDTGTLEEKAAYFLEMGVKNVIVTLGKKGVLLKTPQVCHYFPATENIAVDSTGASDSFISALASYLSKGYPTEAAIQIAIQAAGFSVSKEGVIDSLVDHVTLENYLIKKEPALFAHRNTCID

SEQ ID NO: 28511 - protein, 222 aa, Methanothermobacter wolfeii
MMKHVKGMDGVFIMRDSLVTVNLTPGVRVYGEKLIEWGGSEYRVWDPRRSKMAAAVLNGLRGFQLNPESRVLYLGASAGTTASHISDIVTMGRVYCVEFSPRMMRELIEVCRVRGNMVPLLEDASRPLDYMRMVENADLVYCDVAQPDQTGLFIRNMDCFLKDDGYGLIMVKARSIDVTRSPRKIFREEAGKLRDSGFRIIDQVGLKPYEKDHMAILVQRSV

SEQ ID NO: 28512 - protein, 338 aa, Euglena gracilis
MSRVNLAAPANHVVPRAAQEEVQGEYQTASNNWAVAAMASAGAAVGAAVLAMRRRATNTYEAIREDPEAVLAGAGRAMGAALIGAAVAGSANAASLTYDELQSLSYLEVKSSGIAGTCPVLADGVSSKLSLKAGKYEINNWCLEPSSFQVKLPPTEKQQVTEFERTKLMTRLTYTLDAISADLNVGGDGSWTIQEKDGLDYAATTVQLAGGERVPFLFTIKNLLAKGDAGQFLGQFDVPSYRGATFLDPKGRGGASGYDTAVALPASGDDEEYAKENSKSTAASVGTIAFKVAKVNAETGEIAGVFESIQPSDTDLGAKVPKDIKTSGVWYAQISPSK

SEQ ID NO: 28513 - protein, 296 aa, Symploca atlantica PCC 8002
NSRLCMSSAVSGYIQSFGSDGPPCCYEDLELTDCAFLIGTNAAECHPIVFNRLRKHHKKNRHVKMIVVDPRRTETAEAADLHLAIRPGTDIDLLNGIAHLLMRWGLMDTLFIDECTADFPAYAEVIGHYSPELVARKCGISLDELETAARYWGKSQRVLSLWSMGINQSSEGTAKVRTLINLHLMTGNVGKPGAGPFSLTGQPNAMGGREAGGLAHILPGYRLVKNSQDRREVEDFWGLKPGQISPFSGRSAWEMITGLEQGDVGLLWIAATNPAVSMPDLERTKAALKQSPFTVY

SEQ ID NO: 28514 - protein, 296 aa, Symploca atlantica PCC 8002
NSRLCMSSAVSGYIQSFGSDGPPCCYEDLELTDCAFLIGTNAAECHPIVFNRLRKHHKKNRHVKMIVVDPRRTETAEAADLHLAIRPGTDIDLLNGIAHLLMRWGLMDTLFIDECTADFPAYAEVIGHYSPELVARKCGISLDELETAARYWGKSQRVLSLWSMGINHSSEGTAKVRTLINLHLMTGNVGKPGAGPFSLTGQPNAMGGREAGGLAHILPGYRLVKNSQDRREVEDFWGLKPGQISPFSGRSAWEMITGLEQGDVGLLWIAATNPAVSMPDLERTKAALKQSPFTVY

SEQ ID NO: 28515 - protein, 861 aa, Solanum tuberosum
MIGQITSGLFGGHDDSKKVKGTVVMMNKNVLDFTDLAGSLTGKIFDVLGQKVSFQLISSVQGDPTNGLQGKHSNPAYLENSLFTLTPLTAGSETAFGVTFDWNEEFGVPGAFIIKNMHINEFFLKSLTLEDVPNHGKVHFVCNSWVYPSLNYKSDRIFFANQPYLPSETPELLRKYRENELLTLRGDGTGKREAWDRIYDYDIYNDLGNPDQGKENVRTTLGGSAEYPYPRRGRTGRPPTRTDPKSESRIPLILSLDIYVPRDERFGHLKMSDFLTYALKSIVQFILPELHALFDGTPNEFDSFEDVLRLYEGGIKLPQGPLFKALTAAIPLEMIRELLRTDGEGILRFPTPLVIKDSKTAWRTDEEFAREMLAGVNPIIISRLQEFPPKSKLDPEAYGNQNSTITAEHIEDKLDGLTVDEAMNNNKLFILNHHDVIIPYLRRINTTITKTYASRTLLFLQDNGSLKPLAIELSLPHPDGDQFGVTSKVYTPSDQGVESSIWQLAKAYVAVNDTGVHQLISHWLNTHAVIEPFVIATNRQLSVLHPIHKLLYPHFRDTMNINASARQILVNAGGVLESTVFQSKFAMEMSAVVYKDWVFPDQALPADLVKRGVAVEDSSSPHGVRLLIEDYPYAVDGLEIWSAIKSWVTDYCSFYYGSDEEILKDNELQAWWKELREVGHGDKKNEPWWPEMKTPQELIDSCTTIIWIASALHAAVNFGQYPYAGYLPNRPTVSRRFMPEPGTPDYEELKRNPDKAFLKTITAQLQTLLGVSLVEILSRHTTDEIYLGQRESPEWTKDKEPLAAFDRFGKKLTDIEKQIIQRNGDNILTNRSGPVNAPYTLLFPTSEGGLTGKGIPNSVSI

SEQ ID NO: 28516 - protein, 296 aa, Symploca atlantica PCC 8002
NSRLCMSSAVSGYIQSFGSDGPPCCYEDLELTDCAFLIGTNAAECHPIVFNRLRKHHKKNRHVKMIVVDPRRTETAEAADLHLAIRPGTDIDLLNGIAHLLMRWGLMDTLFIDECTADFPAYAEVVGHYSPELVARKCGISLDELETAARYWGKSQRVLSLWSMGINQSSEGTAKVRTLINLHLMTGNVGKPGAGPFSLTGQPNAMGGREAGGLAHILPGYRLVKNSQDRREVEDFWGLKPGQISPFSGRSAWEMITGLEQGDVGLLWIAATNPAVSMPDLERTKAALKQSPFTVY

SEQ ID NO: 28517 - protein, 414 aa, Streptomyces halstedii
MNQYEELADQYGTPLYVYDLDRVAEARHDLRTSLPDEVEIYYALKANPHPQVAGALRSGEGRECRAEISSVGELAAALTAGFRASEILYTGPGKTDGELDEAIGKGVKTFCVESLTDLQHVGAVALRHGVVADCLLRINSATASATTSIRMTGTPSQFGIDSETLVDAMPELRAVPGTRITGLHFFPLSNARDEASLIGEFRHTIAYAAGLAEETGLTLEFLDIGGGFAHPYGAPGERPVYRELRTELAAALDEHFPHWREGAPRIAVETGRYQTSGAGTLLTRVVNIKVSRGRKFVVIDAGINTFGGMSGLGRLLPVAVEPEYTGSAEATELTDVASLAGPLCTPGDILGREIRLPELAPGDLVTIPNAGAYGVTASLLMFLGRPAPVEVVLKGGKVVSASRLEHHRTPATPG

SEQ ID NO: 28518 - protein, 440 aa, Sulfolobus solfataricus P2
MEENLDSSVLEAPIINVTPPGSKSLKLLKDQEEYETSAINYPKYFKIAIDKAQGSTVTDVDGNVYIDLVTGISVVNLGHNNPFVRKRVQEQLEKVWHTLEVPTEIRVNFSKKLLSTLGMRAKLLFTTTGADAVEAAVKIARFITGKKTIIAFEGSYHGITAGTLGLTGANRFKEFQPFFDDRVVKFPYPYPYRCPFKDCLNETLSLLDYAMSNPGYLGGDVAGILVEPIQGEGGYVVPPKGFLKGLKELAEKYSVPLIVDEVQTGVGRTGKMWAYQWENIEPDIVTISKAIGEGIPVSMVAYREDFDKLPTGFHLGTYRGNPLGLAAGLASLEFIESHNILSRVERLGRKALELLKEVQNPHVGDIRGLGFMIGIELVKDSKEPWSEGTKVVIERALKRGLLVYKAGRWDNVIRLMPPLTIPESLLDRAIEILKIILNTL

SEQ ID NO: 28519 - protein, 219 aa, Synechococcus sp. WH 7803
NSRLCMSSAVAGYTRSLGSDGPPCCYEDLDHCSVVILIGTNTAECHPVLFQRLLKRKKRDPNGLTIVVVDPRSTDTAKIADYHLVLAPGTDLALLHGLARLIIQDNGFDSDSIDTATEGFAGFTQTIKTWTPGKTSKFCGIAEKDLRAVARLWSRKERILSLWSMGVNQRREGTAVVGGLINLHLLTGEIGKAGAGPFSLTGQPNAMGGREAGGLAHLL

SEQ ID NO: 28520 - protein, 129 aa, Glycine max
MANEQPAETYTVEELVAVNPYNPDILNDLEVFVNDQVSSKTYNLDANLSLLRLYQFEPERLSVQIVARILIKALMAMPAPDFSLCLFLIPEHVQMEEQFKTLIVLSHYLETGRFRQFWDEASKSRNILD

SEQ ID NO: 28521 - protein, 866 aa, Burkholderia thailandensis E264
MRRAEESQLKQQASHDQIVLVAPLTGPVVPLADVPDPVFSGGMFGDGIGIDPLEGRLLAPCGGVVSHVARTGHAVTIAADGGAEILLHIGIDTVELNGLGFSAKIAEGARVAPGDLLIEFDQDTIARAAHSLVSVIAIANSDAFEVVERAGAGVAKAGETPLLTLRARGAAAGAAASAGSAAGRADAGAEARKSITLTQPGGLHARPAARAREAARGLDAHVDVHFGGRKAALQSVVGLLGLGAGEHATIEIVATGRDAAKAVELVAHELLREAHGEAEEKPARVVSPAPVAAAVGRAPLDPNTLAGVCAAPGIAVGALVRWDETDIAPPELASGTPAAESRLLDRALAAVDAELETTVREASQRGAIGEAGIFAVHRVLLEDPSLVDAARDLISLGKSAGYAWRETIRAQTAVLAGVDDALLAERAADLRDIDKRVLRALGYASATARELPAEAVLAAEEFTPSDLASLDRERVTALVMARGGATSHAAIIARQLGIPSLVAVGDALYAIPQRTQVVVDASAGRLEYAPTALDVERARHERQRLAGVREANRRMSGEAAVTRDGHKIEVAANIATLDDARVAVDNGADAVGLLRTELMFIHRQAAPTTSEHQQSYQSIVDALQGRTAIIRTLDVGADKEVDYLTLPPEPNPALGLRGIRLAQVRPDLLDDQLQGLLSVKPYGSVRILLPMVTDVGELVRIRERIDAFARALGRADPIEVGVMIEVPSAALLADQLAKHADFLSIGTNDLTQYTLAMDRCQADLAAQADGLHPAVLRLVDATVRGAEKHGKWVGVCGALGGDPVAVPVLVGLGVTELSVDPVSVPGIKAQVRRLDYQLCRQRAQDLLALESAQAVRAASREIWPAD

SEQ ID NO: 28522 - protein, 501 aa, Oryza sativa (japonica cultivar-group)
MLLPPLVVGSTMASLASLSLPVSTASQGRARGAGPVTAAPRRRRVSVVRAKVREIFMPALSSTMTEGRIVSWTAAEGDRVAKGDPVVVVESDKADMDVETFYDGIVAVVLVPAGESAPVGAPIALLAESEEEVAVAQARAQALPRGPGQEPPPPHVPKAAPPPPPPPPPHAPPGPPPTKGVATPHAKKLAKQHRVDISMVVGTGPHGRVTGADVEAAAGIKPKLKGPKGAPPPPPPPPPSPHRHPAAHPPPPPHHPAPRPPPPMAAAPRQPAALPPVPGATVVPFTTMQAAVSRNMMESLSVPTFRVGYAVCTDKLDALCEKVKSKGVTKTLLLVKAAAMALTQHPVVNASCRDGKSFSYNSSINIAVAVAIEGGLLTPVLEDVDKLDVYLLAQKWRGLLKKARMKQLQPDEYSSGTFTLSNLGMFGVDRFDAILPPGQGAIMAVGGSRPTLVANKDGFFSIKNEMLVNVTADHRIIYGADLAAFLQTFAKIIEDPESLTL

SEQ ID NO: 28523 - protein, 329 aa, Bacteroides fragilis YCH46
MIVMGTVKCVGILTSGGDAPGMNAAIRAVTRAAIYNGLQVKGIYRGYRGLVTGEIKEFKSQNVSNIIQLGGTILKTARCKEFTTPEGRKMAYDNMVKEGIDALVVIGGDGSLTGARIFAQEYDIPCIGLPGTIDNDLYGTDTTIGYDTALNTILDAVDKIRDTATSHERLFFVEVMGRDAGFLALNGAIASGAEAAIIPEFSTEVDQLEEFIKSGFRKSKNSSIVLVAESELTGGAMHYAERVKNEYPQYDVRVTILGHLQRGGSPTAHDRILASRLGAAAIDAIMEDQRNVMIGIEHDEIVYVPFSKAIKNDKPVKRDLVNVLRELSI

SEQ ID NO: 28524 - protein, 290 aa, Bacteroides fragilis YCH46
MMERKLAVITGADGGMGTEITRAVACAGYDVIMACYSSSKAETKCRELVKETGNEKIEVWQIDLASLASVRAFADRMLRQKTPVALLMNNAGTMETGLHITEDGLERTVSVNYVGPYLLTRLLLPLMGEGTRIVNMVSCTYAIGKLDFPDFFLRGRKGSFWRIPIYSNTKLALLLFTIELAERLRARGITVNAADPGIVSTNIIRMDQWFDPLTDIFFRPFIRTPLQGAATAIGLLLDAEVEGRTATFNLNNHCRLLPEKYTRPDRRAQLWEETERILSEKGFLPINDKR

SEQ ID NO: 28525 - protein, 216 aa, Glycine max
WNRQEDSLSRARNGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 28526 - protein, 483 aa, Nicotiana tabacum
MATTQNRRSSVSSATTKRQAMTSNSSLENNNHGKLVAKKRPALTNISNHTTASARNSLSHSSKLAPCTSKAVSIKKSNSNAASSVLPTSSFVKPISKTVSIPRSDAAIPKITAIPLPATCSMDISPSHSDGSLVSMDETMSTSDSLRSPDVEYIDDNQTAAFDSIEKKAFSTLYISEDVKAADICKRDVLVDIESGDKIANIDNNFVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVVALHSLCCNNNNSSLPAIREKYSQHKYKFVAKKYCPPTIPVEFFQNISC

SEQ ID NO: 28527 - protein, 447 aa, Bacteroides fragilis YCH46
MKKEYLIYKLSEAMKDCTRIDNELFPKFDVKRGLRNEDGTGVLVGLTKIGNVVGYERIPGGGLKPIPGKLFYRGYDLEDLAHAILKEKRFGFEEVAYLLLSGSLPDKEELASFRELINDNMPLEQKTKMNIIELEGNNIMNILARSVLEMYRFDPNPDDTSRDNLMRQSIDLISKFPTIIAYAFNMLRHATFGRSLHIRHPQENLSIAENFLYMLKRDYTELDARTLDLLLVLQAEHGGGNNSTFTVRVTSSTGTDTYSAIAAGIGSLKGPLHGGANIQVADMFHHLQENIQDWTNVDEIDTYFTRMLNKEVYNKTGLIYGIGHAVYTISDPRAVLLKELARDLAHEKGREREFAFLELLEERAIATFGKIKNNGKTVSSNVDFYSGFVYEMIGLPQEIYTPLFAMARIVGWCAHRNEELNFEGKRIIRPAYKNVLEEEQYVPLKKR

SEQ ID NO: 28528 - protein, 493 aa, Nicotiana tabacum
MRHANIKHGSFHLEEHNMRITRARARVSGSSGRLPPLHPSTKQDKKQALGAESKRSKRSASDENRPGTSSIATGVQPKRRAVLKDMKNVLHENSHMNCINGSKIQVKKGSDKRNNKAKPAVSLKLSQLQEKGKEDIADKVKKVKVEGSQEISSGANCKEDMLPQLSRDVTPAQCGLVHLVPVNRSSCKAFPLQNVMKKDESKVCQKQEGFANLGIADIDSRHKDPLMCSLYAPDIYNNLHAIEFDRSPSVDYLEKLQLDINKGMRGILIDWLVEVSEEYRLVPDTLYLTVNLIDRFLSENYIEKQKLQLLGVTCMLIASKFEEICAPRVEEFCFITDNTYSKEEVIKMESRVLNLLSFQLASPTTKKFLRRFIQAAQASYKVPSVELEFMANYLAELTLVDYGFLKFLPSLTAASAVFLARWTLDQSNHPWNPTLEHYTRYKVSELRTTVFALQELQMNTSGCTLNAIREKYRQPKFKSVATLAASKPVQSLF

SEQ ID NO: 28529 - protein, 473 aa, Nicotiana tabacum
MASRIVLQQQNRGEAVPGAVKQKKNMAPEGRNRKALGDIGNVATGRGLEGKKPLPQKPVAVKVKGANVAKVPAARKPAQKKATVKPNPEDIIEISPDTQEKLKEKMQRKKADKDSLKQKATLTSTLTARSKAACGLSKKPKEQVVDIDAADVNNELAVVEYVEDIYSFYKLAENETRVHDYMDSQPEINDRMRAVLIDWLVEVHQKFELNPETLYLTINIVDRYLAVKTTSRRELQLLGISAMLIASKYEEIWAPEVNDFVCISDKSYTHDQVLAMEKEILGQLEWYLTVPTPYVFLARFIKASLPDSEIENMVYFLAELGLMNYATIIYCPSMIAASAVYAARHTLNRTPFWNETLKLHTGFSESQLIECARLLVSYQSAAATHKLKVIYKKYSSPERGVVSLLTPAKSLLAASSSSVLSEQADLRKSTEAAATSSSKMVVVGCQRCHMYVMVTEADPRCPQCKSTTTRKMT

SEQ ID NO: 28530 - protein, 310 aa, Guillardia theta
MLLRSGTTIILLMVALEILTVASSSSLSSPFPTKLLQSRPSRSTSLAAKVFALRLRGGVDGEDPAADQQYENLSRDSKVYMAKIAEQAERYDEMVKATRSIAKMGVDLTVEERSLLSVAYKNVVGTRRASWKIISSIEQKETDEEKLALIREYLAKVEGELSDVCRDIISLLDKFLIPSAKEDEPKVFYLKMHGDYWRYLAEVASTDMRKAASDAALKAYSAAQDIAVEHLATTHPIRLGLALNFSVFYYEILGLPEQACALAKQAFDDAITDLDSLSEESYKDATLIMQLLRDNLTLWTSDVAQPPAQQ

SEQ ID NO: 28531 - protein, 238 aa, Zea mays
MSAASKKLFQAARSLVLSASHRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 28532 - protein, 153 aa, Triticum aestivum
MTVGMINANPVVHERPERAAHPAHAALDALDVFDTVRDIKDPEHPYSLEQLSVLSQESVSVDDKLGHIQITFTPTVQHCTMATVIGLCLRLKLMQNFPPHFKIDIKVAPGSLANEESVNKQLNDKERVAAALENPNLRQLVDDCLCSDHPSSY

SEQ ID NO: 28533 - protein, 155 aa, Guillardia theta
MLAARRCFSLGQAASAGRQMSALAATWMRSSPSSQAHFMPKANLEHPQYRWAHGGADASSKFADMVKSKVEGHKVMIFSKSYCPYCAKAKSTFNDMGVKYEAMELDVVDNGADIQDTLNILTGGRSVPGCSLDESSSEVVTILWPSPSPGSWRSC

SEQ ID NO: 28534 - protein, 219 aa, Synechococcus sp. WH 7803
NSRLCMSSAVAGYTRSLGSDGPPCCYEDLDHCSVVILIGTNTAECHPVLFQRLLKRKKRDPNGLTIVVVDPRSTDTAKIADYHLALAPGTDLALLHGLARLIIQDNGFDSDFIDTATEGFAGFTQTIKTWTPGKTSKFCGIAEKDLRAVARLWSRKERILSLWSMGVNQRREGTAVVGGLINLHLLTGEIGKAGAGPFSLTGQPNAMGGREAGGLAHLL

SEQ ID NO: 28535 - protein, 219 aa, Synechococcus sp. WH 7803
NSRLCMSSAVAGYTRSLGSDGPPCCYEDLDHCSVVILIGTNTAECHPVLFQRLLKRKKRDPNGLTIVVVDPRSTDTAKIADYHLALAPGTDLALLHGLARLIIQDNGFDSDFIDTATEGFAGFTQTIKTWTPGKTSKFCSIAEKDLRAVARLWSRKERILSLWSMGVIQRREGTAVVGGLINLHLLTGEIGKAGAGPFSLTGQPNAMGGREAGGLAHLL

SEQ ID NO: 28536 - protein, 222 aa, Glycine max
MAAILARKSLLALRARQLAVSGQGLHSSQYYGLRLSAHSFSTKREDEEREQLAKDISKDWSSVFERSINTLFLTEMVRGLMLTLKYFFETKVTINYPFEKGPLSPRFRGEHALRRYPTGEERCIACKLCEAICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 28537 - protein, 521 aa, Ostreococcus tauri
MPRDDRADADARARPSSRRADARARGASTATASTATDRVARDADARLDDRAVDDGDERYVTYEARTSARETPRAEFRLTCPDKTGLGADICRTAFEFGLVVTRGDFTTDGVWALVLLTVRAGSPEGDRAREMGPATRTGEPHEPTSSSKLWRYDVDASEHGGNLALTEMENLPRTAVVDWELLRQRLELLCPHKSALSTIPSVDSLDKLEETHSQQSLYILQVEGHDRVGLLHDVTLALWELQLTLHRAHVTTSPSGNAVDLFYVTDDLHELPNPARVGEISRKIKPVVASTPEEANRVNILIHPAPAFVTRQGRIKTLRAAEGMVVTQANEVPSDFETMVEVDNLMSPAHTVFQVRTRDRQGLLYDCLRVSKDLKVSVSYAKVEIVDKAVCEVVLFTRKNKDQEQTDYLCAKYKEHVDRPIKVEMLSESGNALTSELRVVAPLDIVGHTRPRVLLDVTEALQDLRVMVFKADIITTPRTEGKQLQEEVHRFLLTDVNGEPLATDEARQQVCDRVIAALLR

SEQ ID NO: 28538 - protein, 116 aa, Arabidopsis thaliana
  misc_feature (25)..(25): Xaa can be any naturally occurring amino acid
  misc_feature (85)..(85): Xaa can be any naturally occurring amino acid
  unsure (1)..(116): unsure at all Xaa locations
MASKALILLGLFAILLVVSEVSAAXSGMVKPESEETVQPEGYHGGHGGHGGGGHYGGGGHGHGGHNGGGGHGLDGYGGGHYGGGXGHGGGGHYGGGGHHGGGGHGLNEPVQTKPGV

SEQ ID NO: 28539 - protein, 540 aa, Ostreococcus tauri
MGARATACACALVLLLANVSGARSSAHAYARASFYATNDAAIVAAGREGMFASANANDGTTDDARAGAWIDARARVSDGRAYVRLDGVTFERSERVARAGGAGQGATGLVEIVTFERGDASAIGVVDEVSGRRRFCCDAKMKSDGVCGSSDVGRVIVREDVGEDGTSTGPRRAEVWFDGDDVTARSDVEAVRVRKTGMYHVWFVICDPDHAGVTVSGRTMWKNPNGYLPGAKTALLPFYGFATMAYLGLGFAWTLAHVGHWRHVLGLHNCITAVLALSMTESAVWYFDYANFNATGYRPYVFTMVAVLLGSLRATLSRALVLTVSMGYGVVRPTLGGMSAKVISLGICYLCSAAVKDVVEHVGSVDDLRPGARLFLVLPISVFETVFLLWIFSSLSRTLTQLALRRQTQKLALYRAFTNALALSAALSVVWLAYEMWFKSTDMIDEKWESVWMLSAFWNVLSFGLLAVMCFLWKPSGASSQYAYSELTNGDITEDSWWTRAPKSSRVMNSAKKSRAMRDFSLDDDDDSTRDLEMEMGKIE

SEQ ID NO: 28540 - protein, 368 aa, Triticum aestivum
MGSGDQGKGVRIFIHKELFYSHDRVQILHRSLHREAREQSKNPSHMAASNGGALTVVDLAPFFAVGDADDAGARARATEAVREACQATGFFRAVNHGVPRELMARALELSAAFFALPDEGKAKVRPAEGASASPLPVGYARQPAHSADKNEYLLLFNPKLGLNHYPAQPAGFRDALEECYAKLTELGLLIQDILSECMGLPRGFLAEYNADRGFDFLTALRYFPATTDENNGISAHEDGNCITFVLQDGVGGLEVLGEDGSWIPAEPVEGSIVVNVGDVLQVLSNKKFRSATHRVVRRPEAHRHSIAFFLNLHGDKWVEPLPEFAGHAGEPPRYRGFQYNEYMQLRMRNKTHPPSRPEDVVHITHYEI

SEQ ID NO: 28541 - protein, 634 aa, Bacteroides fragilis YCH46
MNDNKIKSSSPLSDLQHQQLLLRMEYEYEKEEFRRQTETMGIARKVKRGLCWYPVGTGRSFYNSLNQLVIEIERKEDKDIEHVFEFGRPVCFFEQGYDGKIHYFNSICTVSYADEERMVVAVPGAGSLLEIQGAERLGVQLYFDETSYRTMFEALEDVIRAKGNRLAELRDILLSKQPSCWRETYPVRFPWLNSTQEAAVNKVLCAKDVAIVHGPPGTGKTTTLVEAIYETLHRENQVLVCAQSNTAVDWIAEKLVDRGVPVLRIGNPSRVNDKMLSFTYERRFEGHPAYTELWGIRKSIREMGNRMRKSSYSEREAARSRINHLRERATELEIQINEDLFSGARVIASTLVSSNHRILTGRRFTTLFIDEAAQALEAACWIAIRKADRVIFAGDHCQLPPTIKCIEAARNGLEQTLMEKVAANKQETVSLLKVQYRMHQSIMQFSSEWFYQGELQAAPEVTNRGILDLDLPMSWIDTSEMEFHEEFIGESFGRINKPEANLLLQELEAYIRKIGEKRVLEERIDFGLISPYKAQVQYLRGKLKGCSFFRPFRSQITIHTVDGFQGQERDVIFISLVRANEDGQIGFLNDLRRMNVAITRARMKLVILGDAVTMSKHAFYKKLIGYIRHISQGL

SEQ ID NO: 28542 - protein, 552 aa, Ralstonia metallidurans CH34
MKARKAGRSDNAREATGNDAEMGEGCPLHWFDADLGAFDDLERRVAEHPADFFAGQDFDPVGACATREASFASVQIPEDPTAPQQHADHLLNDVFRHVMPVASPTFVGHMTSSLPSFMPSLAKIVAALNQNVVKLETSGALTGLERQVIGMLHHLVFARDDAFYAQWLHNAEHSLGAFCSGGTTANLTALWASRNNTLRARDGFAGINQAGLVAALRHYGYAGLAIVVSERGHYSLRKAADILGIGRENLVPVGVDEDGRMRVDLLRDTLRDLQQRNIRTVAIVGIAGTTETGAVDPLDAIADVAQEIGCHFHVDAAWGGATLLSARERARFAGIERADSVVIDAHKQFYVPMGAGMVLFRDPAWTQDIIQHANYIVRKGSVDLGRHTLEGSRGSAAVMLYANLHLLGRKGLAKLIDTGIDNAKYFASLIEQQPDFELDSRPQLCILTYRYVPAPVRAALLSASPEQREQLLEALDALTINIQEMQRDAGRSFVSRTQLTSSQWGGRPIAVFRVVLANPDTTHEILQSLLEEQRGLAKQSPMLPALMAMVGG

SEQ ID NO: 28543 - protein, 799 aa, Oryza sativa
MMEADMENGRLYPERPRTFSTVRTKSSLPPIFRVLMRINPRAFIVLLLLVFSGVLYVGASTSPIVLFVFCICTLSLFFSLYLTKWVLAKDEGPPEMSEISDAIRDGAEGFFRTQYGTISKMACILALVILGIYLFRSTTPQQEASGVGRTTSAYITVASFLLGALCSGIAGFVGMWVSVRANVRVSSAARRSAREALQIAVRAGGFSAIVVVGMAVFGVAILYATFYVWLEVDSPGSMKVTNLPLLLVGYGFGASFVALFAQLGGGIYTKAADVGADLVGKVEQGIPEDDPRNPAVIADLVGDNVGDCAARGADLFESIAAEIISAMILGGTMAQRCKIEDPSGFILFPLVVHSFDLVISSVGILSIRGTRDSGLISPIEDPMAIMQKGYSITILLAVVTFGVSTRWLLYTEQAPSAWLNFALCGLVGIITAYAFVWISKYYTDYKHEPVRLLALSSSTGHGTNIIAGVSLGLESTALPVLVISVAIISAFWLGHTSGLVDESGNPTGGLFGTAVATMGMLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSAWACSAVGRTAQEVVNEVRRQFIERPGIMDYNEKPDYGRCVAIVASASLREMIRPGALAIISPMAVGIIFRMLGHATGRPLLGAKVVAAMLMFATVSGILMALFLNTAGGAWDNAKKYIETGALGGKGSESHKAAVTGDTVGDPFKDTAGPSIHVLIKMLATITLVMAPIFL

SEQ ID NO: 28544 - protein, 321 aa, Geobacter metallireducens GS-15
MIIEEARKVIRIEADALMALADSINGEFEQAVRRILSTKGRVVVTGMGKSGLIGQKIASTMASTGTPAFFLHPAEGIHGDLGMIMKGDVVIAISNSGETDEVVRILPIIKRLGASLISMSGNPKSSLAKAGDVFLDISVKEEACPLGLAPTASTTATLAMGDALAVALLLERGFRPEDFALFHPGGSLGKKLLLTVGDLMHAGDAVPIVTSDTPMRDALFVISSKGLGVTGVVDGSGALLGVITDGDLRRALSKGLAVLELPAGELMSRNPKRIKRGELAAKALQRMEQYSITSLFVFEGDDDAQPVGVIHLHDLLKAGLA

SEQ ID NO: 28545 - protein, 287 aa, Streptomyces sp. C5
MTVPTPRHGTPHGGLPGRTVLITGATSGIGRAAALAIARQGARVVLVGRDPERLRTVTNEVARTAGPAPDAFRADFAELRQVRELGERLRDRYPRIDVMAGNAGGMFWSRTTTQDGFEATLQVNHLAGFLLARLLRERLAGGRLILTSSDAYTQGRIDPDDLNGDRHRYSAGQAYGTSKQANIMTATEAARRWPDVLTVSYHPGEVRTRIGRGTVASTYFRFNPFLRSAAKGADTLVWLAAAPAEELTTGGYYSDRRLSPVSGPTADAGLAAKLWEASAAAVGDTAR

SEQ ID NO: 28546 - protein, 197 aa, Synechococcus sp. WH 8102
MTPTEQNFLSLLCGEYSNQQQALDNPPFFAHIFLRYRPLEHLQPGSILLEQSYAVDPKNPYRLRMIRAEEQSPGIIKLWNHTFHEPSRFAKATFDKECRQTIQDSDLICLDQCHYQVEHKSDGYHGSIEPGCRCMVTRNGQETVLASTFHLQEDSLKTLDRGHDPKTNARLWGAIAGEFQFKRTKSWEAKWEQDIHS

SEQ ID NO: 28547 - protein, 493 aa, Frankia sp. EAN1pec
MADRPQFESRMLIDGKLVEAATGKTFDNVNPATEEVLGQVTDASATDMHRAIDAARRAFDETDWPTNRALRKLCLSQLQKALESEREQFREELIAEVGCPRTITNGEQLDAPLANALRHPTKLIDTYPWETDLGNTVDERSGRLTSRRIWREPTGVVGAIVPWNFPLQIALHALGQALATGNTVVLKPAPDTPFHATRLGRLIAEHTDFPPGVVNVVTASDHLVGEELTLSPKVDLISFTGSTAVGKRIMEKGAATLKRLFLELGGKSATIVLDDADLQTATRMGIAACVHASQGCAIPTRMLLPRSRYDEGVALLEAMYAGVKVGDPQQADTVTGPVISTKQRERVLGYIRKGIDEGAKLLVGGTERPEGLDKGYFVKPTLFVDVDNSMTIAQEEIFGPVLAVIPFEDDEDAIRIANDSSYGLSGAVMSGSLERALAVTRRIRTGTVHVNGGLASGPDMPFGGYKASGIGRHKGHAGFDQYLETKSTAWPAS

SEQ ID NO: 28548 - protein, 149 aa, Arabidopsis thaliana
MEFSRDAGMMMENKRNVCSLGESSIKRHKSDLSFSSKERKDKVGERISALQQIVSPYGKTDTASVLLDAMHYIEFLHEQVKVLSAPYLQTVPDATQEELEQYSLRNRGLCLVPMENTVGVAQSNGADIWAPVKTPLSPAFSVTSQSPFR

SEQ ID NO: 28549 - protein, 363 aa, Thermobifida fusca YX
MTETIHEVDVAVIGGGQAGLASGYFLTKRGYRPHRDFVIFDRSPRPGGAWQHVWRSVRLISPPHYTRLPGLPWERPFHGPPSGDEVADYLAHYEQHFQLPVLRPATVHQVTNDGPDPTITRTTPLLITTDQGTWRARAIINATGTWDAPFIPAVPGIGDFRGRQLHAAHYDTPHEFAGHRVIVVGGGHSALQILAELSTVADTLWVTRRPPEFRTTPLTEAELVGITRAVAAHAASGRPLRSVVSYTKLIETPEVAAARERGALNPRPMFHRITPHGVAWNDGTTEHADTILWATGFRPVLAHLAPLRLRSPHGGIALADTHAAIDPRIHLVGYGPSASMISVHRAAATAARVLAASRPQPTT

SEQ ID NO: 28550 - protein, 312 aa, Schizosaccharomyces pombe
MSISSKDFQNVTSAGFADDTFAADTFAADKKSPFESSVFENKTQVLPVDSVSRLSNGARSRSNSNISLSEPHALNDTVEDQPVSKWVWVLAFAAGIGGLLFGYDTGVISGALVVIGTSLGGHELTNGGKEFITSATSLGALLGGIIAGALADFFGRKPVIAIASIIIIVGSIVQVTAHHLWHMIVGRFVIGWGVGIASLIIPLYLSEIAPSKIRGRLVIIYVLLITAGQVIAYGIDTAFEHVHNGWRWMVGLAMVPAAFQLFILIWLPESPRLLVKKERSQEAYNTLARIYPTAHPYEIKTKLYLIQEGVRD

SEQ ID NO: 28551 - protein, 219 aa, Synechococcus sp. WH 6501
NSRLCMSSAVAGYTRSLGSDGPPCSYEDLDHCTVAFLIGTNTAECHPVLFQRLLKRKRKNPGSVKIVVVDPRRTDTAKAADIHLPIAPGSDLALLHGIAHLVLRENGQDPAFIDDHTENYDAFFDVAARWTPRRVALFCNIPEKRLREVAALFHRREKVLSLWSMGVNQRREGTAVVQGLINLHLLTGQIGKQGAGPFSLTGQPNAMGGREAGGLAHLL

SEQ ID NO: 28552 - protein, 219 aa, Synechococcus sp. WH 6501
NSRLCMSSAVAGYTRSLGSDGPPCSYEDLDHCTVAFLIGTNTAECHPVLFQRLLKRKRKNPGSVKIVVVDPRRTDTAKAADIHLPIAPGSDLAQLHGIAHLVLRENGQDPAFIDDHTENYDAFFDVAARWTPRRVALFCNIPEKRLREVAALFHRREKVLSLWSMGVNQRREGTAVVQGLINLHLLTGQIGKQGAGPFSLTGQPNAMGGREAGGLAHLL

SEQ ID NO: 28553 - protein, 219 aa, Synechococcus sp. WH 8020
NSRLCMSSAVAGYTRSLGSDGPPCSYEDLDHCTVAFLIGTNTAECHPVLFQRLLERKKRHPGALTIVVVDPRQTDTAKAADIHLAVAPGSDLALLHGIAHLVMRENGQDPAFIDDCTDNYDSFFDVVARWTPRRVALFCGIPEKRLREVAQLFHRREKVLSLWSMGVNQRREGTAVVGGIINLHLLTGQIGKEGSGPFSLTGQPNAMGGREAGGLSRLL

SEQ ID NO: 28554 - protein, 219 aa, Synechococcus sp. WH 8020
NSRLCMSSAVAGYTRSLGSDGPPCSYEDLDHCTVAFLIGTNTAECHPVLFQRLLKRKKRHPGALTIVVVDPRQTDTAKAADIHLAVAPGSDLALLHGIAHLVMRENGQDPAFIDDCTDNYDSFFDVVARWTPRRVALFCGIPEKRLREVAQLFHRREKVLSLWSMGVNQRREGTAVVGGIINLHLLTGQIGKEGSGPFSLTGQPNAMGGREAGGLSHLL

SEQ ID NO: 28555 - protein, 504 aa, Debaryomyces hansenii CBS767
MVSTNLPLEIPITLPNGIKYTQPTGLFINNEFVRSKQGNKFEVLSPSTEEVVTSVYEAREDDVDIAVQHALRAFEESSWAKADPCQRGAALYKLANLIEENFETIASIEAMDNGKAIGNAKGDVTLAISVLRSTAGFSDKMLGSVIESGDSHFNFTRREPLGVCGQIIPWNFPLLMFTWKIAPALVTGNCVVIKSSETTPLSALYVSNLIKEANLFPPGVLNVISGFGKYTGNAITEHPLIKKVAFTGSTATGKTIMRKCAESNLKKVTLELGGKSPHIIFNDADMDTTLKSVVTGIFYNSGEVCSAGSRLYIQEGIYDAFVEKFVQTTKSDVKVGDPFLPDTIQGAQNSVDQLDKILKYIQIGTDEGAKILAGGERLQGKGYFIKPTIFGDVKEDMRIVQEEIFGPVITISKFKTTDDVVRMANNTDYGLAAGIQTSNVNRAIDVSRRLKAGTVWVNTYNDFHPMVPFGGYNLSGMGREMGVEVLQNYTQTKAVRMSIIKPKD

SEQ ID NO: 28556 - protein, 199 aa, Glycine max
MDTMACNKGQNVRKAKKKQVKDELDRLKQAEKKKRRLEKALATSAAIISELEKKKQIKKEEQQRLDEEGAAIAEAVALHVLLGEDSDESCKVVIDNGNQNIGISVSGESACFPHLEGGGGWSFERVGWVSDAYRYGCERGAAENGEWSFSTEPFEKNMHEPLYEGAGWGPAGFSADLIAAQAVSSLQIAEEADEDRILF

SEQ ID NO: 28557 - protein, 163 aa, Oryza sativa (indica cultivar-group)
MAAAAAVVNYPLVAALVAFALAQSSKFFTTWFKEKRWDARQLIASGGMPSSHSATVTALAVAIGIQEGYRSATFATSVIIACVVMHDAFGVRLHAGKQAEVLNQIVYELPEEHPLSETKPLREILGHTVPQVSLVCMILSNFSYFCGLVNTDIQSRKNRRKIL

SEQ ID NO: 28558 - protein, 65 aa, Zea mays
MMMGTDVCSSRMLSLPRYESGDEELTVLPRHTKVVVTGNNRTKSVLVGLQGVVKKAAGLGGWHWL

SEQ ID NO: 28559 - protein, 432 aa, Enterococcus faecalis V583 [sequence omitted]

SEQ ID NO: 28560 - protein, 251 aa, Enterococcus faecalis V583
MRKPIIAGNWKMNKTLSEAQSFAEAVKNAVPSNDVVDAVIGSPALFLAPLAWNLKDSEVKLAAQNCYWENAGAFTGENSPAAIADLGVDYVIIGHSERREYFHETDEDINKKAKAIFANGMTPIFCCGETLETYEAGKTAEWIEGQITKGLVGLSNEQVASMVIAYEPIWAIGTGKSADANIADEICGVVRSTVEKLYGKEVSEAVRIQYGGSVKPENIAEYMAKENVDGALVGGASLEADSFLALLDAVK

SEQ ID NO: 28561 - protein, 397 aa, Enterococcus faecalis V583
MAKKTIKDVDLKDKKVLVRVDFNVPLKDGVITNDNRIVAALPTIKYVIENGGKAILFSHLGRVKTEEDKAGKSLKPVAERLSELLGQPVTFVPETRGKELEDAVNNMKDGDVLVFENTRFEDVDGKKESGNDAELGKYWASLGDVFVNDAFGTAHRAHASNVGIASTGIPTVAGFLMEKEIKFIGEAVENPKRPFVAILGGAKVSDKIAVIENLIEKADKILIGGGMAYTFMKAQGYSVGLSLLEEDKVDLAKSLMEKAGDKLVLPVDTVVSKEFSNDAPFHTVPSTEIPDDEEGLDIGEKTIELFANELQGAKTVVWNGPMGVFEMSNFAKGTIGVCEAIANLEDATTIIGGGDSAAAAIQLGYENKFSHISTGGGASLELLEGKTLPGLASINDK

SEQ ID NO: 28562 - protein, 286 aa, Brassica napus
MCGILAVLGCVDNSQATRSRIIKLSRRLRHRGPDWSGLHCYEDCYLAHERLAIIDPISGDQPLYSEDKTVVVTVNGEIYNHKALRESESLKSHKYHTGSDCEVLAHLYEEHGEEFINMLDGMFAFVLLDTKDKSYIAVRDAIGVIPLYIGWGLDGSVWFASEMKALSDDCEQFMAFPPGHIYSSKQGGLRRWYNPPWFSELVPSTPYDPLVLRDTFEKAVIKRLMTDVPFGVLLSGGLDSSLVASVAIRHLEKSDARQWGSKLHTFCIGLKGSPDLKAGKEVADYL

SEQ ID NO: 28563 - protein, 219 aa, Synechococcus sp. WH 8020
NSRLCMSSAVAGYTRSLGSDGPPCSYEDLDHCTVAFLIGTNTAECHPVLFQRLLKRKKRHPGVLTIVVVDPRQTDTAKAADIHLAVAPGSDLALLHGIAHLVMRENGQDPAFIDDCTDNYDSFFDVVARWTPRRVALFCGIPEKRLREVAQLFHRREKVLSLWSMGVNQRREGTAVVGGIINLHLLTGQIGKEGSGPFSLTGQPNAMGGREAGGLSHLL

SEQ ID NO: 28564 - protein, 219 aa, Synechococcus sp. WH 8008
NSRLCMSSAVAGYTRSLGSDGPPCCYEDLDHCSVAFLIGTNTADCHPVLFQRLLKRKKRDPKGLTIVVIDPRCTDTAKIADYHLALAPGTDLALLHGLARLVLQDNGFDSDFIDSATEGFAAFTQTIKAWTPGKTSKFCGIAEKGLRSVARLWSRKEGILSLWSMGVNQRREGTAVVGGLINLHLLTGEIGKAGAGPFSLTGQPNAMGGREAGGLAHLL

SEQ ID NO: 28565 - protein, 212 aa, Oryza sativa (japonica cultivar-group)
MGLYSGMHGLTAYVGFFEMSKPKKGEYVFVSSACGAIGQIVGQLAKIKGCYVVGSAGSDDKVNLLKTKFGFDDAFNYKKETDLEAALKRCFPEGIDIDFENVGGAMLDAVLPNMRLGGRITMCGMISQYHLERPEGVRNLMYIITKRLRMEGFVIFDSIAVYRQFEEEMAGYLREGKVTYLEDIVQGLDAAPAALIGIYNGLNVGKQLVAIA

SEQ ID NO: 28566 - protein, 572 aa, Coccidioides immitis RS
MTHPYIPMTLHKVMAATRASSDALFSLSNLDLVRNLVFIVFLLRLSRRSFYTIRGQGFIGTICNIYHKAHLTLYSLFLRAPGVRGQVDKQVSSAISKLESKLAPQGPGIVKYNKLPAQGWSAEQVHAELDRLAGMEHTMWEEGRVSGAVYHGGEDLLKLQTDAWGQFAVANPIHPDVFPGVRKMEAEVVAMVLELFNAPEGGAGVTTSGGTESILMACLSARQKAYTERGVTDPEMIVPITAHAAFNKAAQYFGIKLHSVPCPAPNYTVHIPSVRRLINPNTILLVGSAPNFPHGIVDDIPALSRLAVSYKLPLHVDCCLGSFVIAFLKKSGFPSPYEEQGGFDFRLPGVTSISVDTHKYGFAPKGNSVVLYRDRVLRSYQYFILPEWSGGVYASPSIAGSRPGALIAGCWSSLMAIGESGYKDSCHQIVSAAKKFETSIREDPVLSRDLKVIGEPMVSVVAFATTTAEIDIYDIADAMSAKGWHLNALQNPAAMHVAFTVPTANAVDHLTADLTEVVEIERAKADERKRLGQKVEKERGDTSALYGVAGSIPDKSIVSRLAEGFLDTLYLS

SEQ ID NO: 28567 - protein, 219 aa, Synechococcus sp. WH 8008
NSRLCMSSAVAGYTRSLGSDGPPCCYEDLDHCSVAFLIGTNTADCHPVLFQRLLKRKKRDPKGLTIVVIDPRCTDTAKIADYHLALAPGTDLALLHGLARLVLQDNGFDSDFIDSATEGFAAFTQTIKAWTPGKTSKFCGIAEKDLRSVARLWSRKEGILSLWSTGVNQRREGTAVVGGLINLHLLTGEIGKAGAGPFSLTGQPNAMGGREAGGLAHLL

SEQ ID NO: 28568 - protein, 136 aa, Oryza sativa
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIKLARRIRGERA

SEQ ID NO: 28569 - protein, 323 aa, Photobacterium profundum SS9
MSEKFDFCAHGRKVLEIEIAALQQISQYINGCFTQACELILSSHGKVIVMGMGKSGHIGNKIAATLASTGTPSFFVHPGEASHGDLGMIEKGDVVLAISNSGEASEILSLLPVIKRLGIPLISVTGKPESSMAKFSQVHLQITVAAEACPLNLAPTSSTTATLAMGDALAIALMEARGFTANDFALSHPGGALGRKLLLCIADVMHTGDLLPIIDEAATIKDALLEVSRKGLGMTAVVNSEQQLTGIFTDGDLRRLLDKRVDIHNTAIGDVMGRNPSTIEANVLAAEGLKLMEDNKINGLLITENGQLVGALNMHDLLKAGVM

SEQ ID NO: 28570 - protein, 703 aa, Debaryomyces hansenii CBS767
MNQIEDLSLKTIRCLVSDLVQQYNGGHPGGAMGMAAIGIALWKYILKYNPKNANWFNRDRFVLSNGHTCLFQYVFLHLVGYESFTMNQLKKYHAPEVSQCAGHPEIEFEGIEVTTGPLGQGIANAVGLAIASKNLAANYNKPDLDLVDNKIYCMVGDACIQEGVGLEAISLAGHLGLDNLIVIYDNNQITCDGSVDLANSEDINAKFMAQKWHVLTVDDGSFDLRSILAAIEQAKSVKGLPILINIRTIIGVDTNVANNAKAHGAAYGVEEGRRLKALYGFDPDQFIEVPKLVYDFFREGNEGAISKGVFHQEQWEKKLEAYSKKYPQLYEEVVSRINGKLPTDWKESLPHSLPTDATASRKASGLVFTPLAAKYPQFLVGTADLSPSVNLLWPHKKDFQNPEIKTDCGINGDYSGRYLHYGIREHAMCAISNGISAYSKGAFIPITSSFFMFYLYSAPAVRMGALQNLQVIHVATHDSIGTGEDGPTHQPIALASFYRSLPNCLYVRPADNEEVAGAWELAIETTNKPTIISLSRQNLKQYPGITDRNKVKFGAYVLKEFDSSSDSQKLQIISVGAESQFAIDAAEILIESNINVKIISFPCQRLFECQSTEYKRSVLDPQIVTVAIEAYASNGWERYANAGFHLNEFGISLPGKNAYEHFGFNGAYIASKIQKYLDDLQKDDIMKFEYQELNITKNHHSSS

SEQ ID NO: 28571 - protein, 314 aa, Zea mays
MVVPVIDFSKLDGAERAETLAQIANGCEEWGFFQLVNHGIPLELLERVKKVCSDCYRLREAGFKASEPVRTLEALVDAERRGEVVAPVDDLDWEDIFYIHDGCQWPSDPPAFKETMREYRAELRKLAERVMEAMDENLGLARGTIKDAFSGGGRHDPFFGTKVSHYPPCPRPDLITGLRAHTDAGGVILLFQDDKVGGLEVLKDGEWTDVQPLEGAIVVNTGDQIEVLSNGLYRSAWHRVLPMRDGNRRSIASFYNPANEATISPAAVQASGGDAYPKYLFGDYMDVYVKQKFQAKEPRFEAVKTGAPKSSPAA

SEQ ID NO: 28572 - protein, 753 aa, Ashbya gossypii ATCC 10895
MSQEGSAKRADFKYKIGKIKHTPPVLKDVRSGLEFIELEKRDDEKVYGVTKFLGNYKEEKKLGQGTFGEVYRGVHLATQRQVAMKKILVKTENDLFPITAQREITILKRLNHRNVVQLIEMVYDYPPAQNGAAYGQDSSQASASADTMKSFYMILPYMVADLSGILHNPRVTLEMADIKNMMLQILEGINYIHCKKFMHRDIKTANILLDHKGILKIADFGLARNYYGAPPNLKYPGGAGTDAKYTSVVVTRWYRAPELVLGDKNYTTAVDIWGIGCVFAEFFEKRPILQGKTDIDQGHVIFKLMGTPSDSDWQLARYLPGAELTRTSYEPTYKERFGKYLTEKGLDLLSTLLSLDPYKRLTAMAAMQHPFFSEDPLPKLQLTLPCEESHETDIARYGQEMQKTVSNLPPAAPSGHAVEQSQTQQQSSRHHQSQPYQSLPPQKSSQPHPQQIPEAAPVQQPSQQPPQEPSAHQQQYSSRGPQQHRTTPAPTSLPPKPKPAPPGARYNREAPPQNKPVKPLTRHLGAQYQHNNYGNYYNHWQGGERYYETYNDGYPHADRYSDDTHYNGYGYRSRGYQRYDMRREGESRYNQRPYAPQQGAAYRPNRRDTYKLVDRTGQPYPPERVPNPELHPSPAPRPKRTLTNTTQLSSHSSAATGSTAASGSAVSNSSEPVRRSSTASLDNSESGNILQQKPPPPVANPLEARIYGRDEVQSNHPGGRLYPRSTPDSKNSEGAAPSEASTDPTKRNIVDYY

SEQ ID NO: 28573 - protein, 228 aa, Brassica napus
  misc_feature (165)..(165): Xaa can be any naturally occurring amino acid
  misc_feature (200)..(200): Xaa can be any naturally occurring amino acid
  unsure (1)..(228): unsure at all Xaa locations
MAFAPILRRASAAKSLFSLSRLFLGSSPSVRSFQTGASGDDRQPPPPLSPSSIAGYHVSSGGYMRGAVYREPNQPLTIEEFHIPRPKVNEVLIKTKACGVCHSDLHVMKGEIPFSSPCVIGHEITGEVVEHGPLTDHKIIQRFPIGSRVVGAFIMPCGTCSYCAXGHDDLCEDFFAFNRAKGTLYDGETRLFLRYDDSPXVYMYSMGGMAEYCVTPAHGLAPLPESLP

SEQ ID NO: 28574 - protein, 112 aa, Urtica dioica
MMMRFLAAVVIMSSAMAVGLVSAQRCGSQGGGGTCPGLRCCSIWGWCGDSEPYCGRTCENKCWSGERSDHRCGAAVGNPPCGKDRCCSVHGWCGGGNDYCSGGKCQYRCSSS

SEQ ID NO: 28575 - protein, 219 aa, Synechococcus sp. WH 8108
NSRLCMSSAVAGYTRSLGSDGPPCSYEDLDHCTVAFLIGTNTAECHPVLFQRLLKRKRKNPGSVKIVVVDPRRTDTAKAADIHLPIAPSSDLALLHGIAHLVLRENGQDPAFIDDHTENYDAFFDVAARWTPRRVALFCNIPEKRLREVAALFHRREKVLSLWSMGVNQRRKGTAVVQGLINLHLLTGQIGKQGAGPFSLTGQPNAMGGREAGGLAHLL

SEQ ID NO: 28576 - protein, 296 aa, Anabaena cylindrica PCC 7122
NSRLCMSSAVSGYIQSFGADGPPCCYDDLELTDCAFLIGTNTAECHPIVFNRLAKYHKKNRHVKMVVVDPRRTPTAEAADLHLAIRPGTDIDLLNGIAHLLMKWNYIDTLFMDECTSNFPTYAEVIRHYSPDVVSRQCGISIEDLETAAKYWGKSKSVLSLWSMGVNQSTEGTAKVRTIINLHLMTGQIGKPGAGPFSLTGQPNAMGGREAGGLAHLLPGYRLVKNDKHRAEVEDFWGLERGRISPVSGLTAWDMITSLESGNVGLLWIAATNPAVSMPDLERTKKALLKSPLTIY

SEQ ID NO: 28577 - protein, 142 aa, Brassica napus
MTNQNVIVSDRNPILGSKTITVSVSNSPLFSSPPTYFTFPRRKFLELLEAADKNNNNKNNLGAGKISSWVDSMRDSSPTRLRSSSRDSDSDNDEKTSWIVRFPSALNMFDKIMNAAKGKQIVMFLDYDGTLSPIVEDPDKAY

SEQ ID NO: 28578 - protein, 356 aa, Bacillus subtilis subsp. subtilis str. 168
MTIDHSVTNTEQLEQQNPAIKTKLKLKKLKDQVIVITGASSGIGLVTARMAAEKGAKVVAAARNEEALKELTDELKEKGHDAIWVKADVGKEEDVNRIAETAISTFGRFDTWVNNAAVSTFGHAMDVTVEDMKRMFDTNFWGPVYGTRAAVKHYTGRGVPGALINVGSLFGDRGTVIQSTYASAKFALHGWTESIRMELEKEQAPVSVTLIHPGRIDTPYNEHAHSYLDKQPAHYRSMIYPPEAVAEAILFAAEHPKRDMYIGSQAKAIAMLGALFPRLTDRLMEKIMYHSQHAERPSNPREESALYDAGCGMHDRGTNKGWMRSRSYYTKATKRPIVSAAVVAGLVAWAAAKRCR

SEQ ID NO: 28579 - protein, 307 aa, Zea mays
MAENFQLQGRHGKSRVRVSRVWRRPAAAGGDVIVEWNVAVSIVSDCLPSYTSSDNSAIVATDSIKNTVYVKAKECTEVVSMEEFAVILGRHFTSLYPQVSEATVTIVERPWERVTVDGKRHSHGFKVGVEKHSTEVIVKKSGSLRINSGIQGYSLLKTTQSGFEGFVTDRYRLLPDTRERIVATEVTAWWRYPFEHVSQLPSKPFCFTQRYQDVKKVLAETFFGPPDVGVYSPSVQNTLYLMAKEVLTRFPDISSVQLRMPNLHFLPVNLGSKEAPLVKFADDVYLPTDEPHGTIEATLISRPMSKL

SEQ ID NO: 28580 - protein, 547 aa, Haloarcula marismortui ATCC 43049
MSELGPGTPQKWVGAWSERRAALTPDREGLVDATTGERFTYAELDRRANRTARLLRRYGVGDSGESTGTVAVVSRNRPAVVDLFFASAKTGSRLAPLSHRLAPPELAELLDRVDPELLVVEASSAETVSTALETADTAAPQLIHLGTAADSASSAATLDSTPYASALPEDDTPVETATPAPSDTHLLLHTGGSTGTPKETELTHRGIVWNSLNTITAWGLREDDVTPMVFPMFHTGGWNVLTVPLWHMGGTVVIARAFDPSDVLEIIDSEGGTVLVAVPAILRMMANHDRWAETDLSSLRFAKSGGGPCRKSVMETWWDRGVDLSQGYGLTECGPNNFAMPEDWPHEKADSVGKPVLHVDARVVEPEDSDDEGSPAGSRDPVDPGTVGELQLRSPHAAAGYLDNPDATAETFGDGWVSTGDLARVDADGYYYIEGRTKHMFVSGGENVFPPEVEDAIADHPMVGEVVVIPVPDDRWGQVGKAVIEPASTAVTDGASDRPLTLDDLRTFLDDRLARYKHPHDIAFVEAMPTSGPDKIDRGAVSDRFGA

SEQ ID NO: 28581 - protein, 1064 aa, Shewanella sp. ANA-3
MEAITMFKASEVLAGRYDSANLDELFKAVTDNYIVDEEQYLSELIKLVPSSDEAIERVTRRAHELVNKVRQFDKKGLMVGIDAFLQQYSLETQEGIILMCLAEALLRIPDAATADALIEDKLSGAKWDEHLSKSDSVLVNASTWGLMLTGKIVKLDKKIDGTPSNLLSRLVNRLGEPVIRQAMMAAMKIMGKQFVLGRTMKEALKNSEDKRKLGYTHSYDMLGEAALTRKDAEKYFNDYANAITELGAQSYNENESPRPTISIKLSALHPRYEVANEDRVLTELYDTVIRLIKLARGLNIGISIDAEEVDRLELSLKLFQKLFNADATKGWGLLGIVVQAYSKRALPVLVWLTRLAKEQGDEIPVRLVKGAYWDSELKWAQQAGEAAYPLYTRKAGTDVSYLACARYLLSDATRGAIYPQFASHNAQTVAAISDMAGDRNHEFQRLHGMGQELYDTILSEAGAKAVRIYAPIGAHKDLLPYLVRRLLENGANTSFVHKLVDPKTPIESLVVHPLKTLTGYKTLANNKIVLPTDIFGSDRKNSKGLNMNIISEAEPFFAALDKFKSTQWQAGPLVNGQTLTGEHKTVVSPFDTTQTVGQVAFADKAAIEQAVASADAAFATWTRTPVEVRASALQKLADLLEENREELIALCTREAGKSIQDGIDEVREAVDFCRYYAVQAKKLMSKPELLPGPTGELNELFLQGRGVFVCISPWNFPLAIFLGQVSAALAAGNTVVAKPAEQTSIIGYRAVQLAHQAGIPTDVLQYLPGTGATVGNALTADERIGGVCFTGSTGTAKLINRTLANREGAIIPLIAETGGQNAMVVDSTSQPEQVVNDVVSSSFTSAGQRCSALRVLFLQEDIADRVIDVLQGAMDELVIGNPSSVKTDVGPVIDATAKANLDAHIDHIKQVGKLIKQMSLPAGTENGHFVSPTAVEIDSIKVLEKEHFGPILHVIRYKASELAHVIDEINSTGFGLTLGIHSRNEGHALEVADKVNVGNVYINRNQIGAVVGVQPFGGQGLSGTGPKAGGPHYLTRFVTEKTRTNNITAIGGNATLLSLGDSDA

SEQ ID NO: 28582 - protein, 122 aa, Anabaena variabilis ATCC 29413
MSSYNRMSETTETIFSKIIRREIPANIVYEDDLALAFTDVHPQAPVHILVIPKQPLAKLSDADSHDHALLGHLLLTAKRVAQKAGLENGYRVVINNGNDGGQTVYHLHLHILGGRLMAWPPG

SEQ ID NO: 28583 - protein, 209 aa, Ashbya gossypii ATCC 10895
MAYQTGGNIRKKLVIVGDGACGKTCLLVVFSKGQFPEIHVPTVFENYVADVDIDGRRVELALWDTAGQEDYDRLRPLSYPDSNVVLICFSVDLPDSLDNVQEKWVSEVLHFCQGVPILLVGCKVDLRNDPQVLQQLQAEGQRPVTAAEGSAVAGKIGAVAYLECSARTGQGVKEVFDTATRAALSGKPAASAGKKKVHGDKKKKKCLVL

SEQ ID NO: 28584 - protein, 207 aa, Ashbya gossypii ATCC 10895
MSQQMHNPSIRRKLVIVGDGACGKTCLLIVFAKGKFPQVYVPTVFDNYVADVEVDGRRVELALWDTAGQEDYDRLRPLSYPDSNVVLICYSIDLPDSLENVMEKWISEVLYFCQGVPIILVGCKADLRNDPQVIEQLRQQGQQPVSQAQAQEVADQIGAVEYIECSAKTGFGVREVFEAATRASLMGKQGKSKAKSDKKKKKKCVVL

SEQ ID NO: 28585 - protein, 375 aa, Oryza sativa (japonica cultivar-group)
MATAAGASLQYALHGRRLRLRQAQIRRARQERARGRGEEASADATAESKSGGHEVLLFEALREALIEEMKEDPTVCVFGEDVGHYGGSYKVTKGLAEMFGDLRVLDTPIAENSFAGMGVGAAMKGLRPIVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYICCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAATLEDATVVQPAQIVAAVEQICQ

SEQ ID NO: 28586 - protein, 298 aa, Glycine max
MGKKQSFRSKAAYFVSDLTTGLLNPISDNNNNNNKPPSLPPSGEEEKEDVGESKGGSDDVIIDGPDTSSFTAFLYSLLSTSDSGDKVGEADKKNDDEVAGDDSLLSDSATKESFVVKKSLFSRSKHSLGRAIHQMGGFSNRDSNYTDEGGVEMKRIVKEPLAVAVSGVGDHLPQISEPSMLVSEGVRNAVYASLPALIRGRKWFMLYSTWKHGISLSTLYRRSMLCPGMSLLVVGDRKGAVYGGLVEAPLRPSNKRKYQGTNNSFVFTNTSGCPVIYHPTGIYFSLSLNIPFFIKIND

SEQ ID NO: 28587 - protein, 461 aa, Mycobacterium avium 104
MAPGTADHLRRGIGTFQLTMFGVGSTIGTGIFFVMSQAVPEAGPAVIVSFLLAGVAAGLAAVCYAELASAVPVSGSSYSYAYTTLGEVVAMGVAACLLLEYGVATAAVSVNWSGYLNKLLSNVVGFQLPHALSAAPWDAQPGYVNLPAVMLIGMCALLLIRGASESAKVNAIMVMVKLGVLVVFGILAFTAFDMHHLDDFAPFGVAGVGTAAGTIFFSYIGLDAVSTAGDEVTNPQKTMPRALIAALLTVTGVYVFVALAALGTQPWQDFGGQQEAGLATILDHVTHGSWASTILAAGAVISIFSVTLVTMYGITRILFAMGRDGLLPPRFARVNPRTMTPVNNTVIVAVAAATLAAFIPLQNLADMVSIGTLTAFVVVSVGVIVLRVREPDLPRGFRVPGYPVTPVLSIMACGYILASLHWYTWIAFSGWVLLALIFYFVWGRHHSALNDAAVDPSGQER

SEQ ID NO: 28588 - protein, 643 aa, Mycobacterium avium 104
MCGLLAFVAARAGAVGADDAIARASHLMRHRGPDEPGTWAGADGSVVFGFNRLSIIDIAHSHQPLRWGPPETPDRYELVFNGEIYNYLELRDELAAHHGAVFATDGDGEAIVAGFHHWGTDVLTRLRGMFAFALWDTVTRELFCARDPFGIKPLFVATGTGGTAVASEKKCLLELAELIGFDTAIDERAVQHYTVLQYVPEPETLHRGVRRLESGCYARIRPGAAPDITRYFVPRFAAVPITRDTEQARYDEITAVLEDSVAKHMRADVTVGAFLSGGIDSTAIAALAIRHNPRLITFTTGFEREGFSEIDVAVASAEAIGARHIAKVVHPDEFVAALPEIVWYLDEPVADPALVPLFFVAREARKHVKVVLSGEGADELFGGYTIYREPLSLKPFDYLPRPVRRSMGKVSKPLPDGMRGKSLLHRGSLTLEERYYGNARSFSDAQLRDVLPGFRAEWTHTDVTAALYAQSIGWDPVARMQHIDLFTWLRGDILVKADKMTMANSLELRVPFLDPEVFAVASRLPVEAKITRTTTKYALRRALEPIVPAHVLHRPKLGFPVPIRHWLRAGELLEWAYSMVASSQAGHLVDLGAVRRMLDEHRNGVSDHSRRLWTVLIFMLWHAIFVEHSVVPQIGEPVYPVQL

SEQ ID NO: 28589 - protein, 392 aa, Propionibacterium acnes KPA171202
MSNDYYEILGVSHDASADEIKKAYRRKAMKLHPDVAGPGSEEEFKKVQEAYEILQDPQKRAVFDRGGDPNARMGGFGEGGFSSAGFDFTNLVDAMFGGSSPFGSGGGRGPRSRTRRGQDALVRMRLSLAEAVFGVTKSLEVDTAVVCPKCQGKGAQSGSEPVTCDTCQGRGEVITVQRSFLGDIRTSQPCPTCHGYGTVIPDPCQECSGEGRVRTTRTINVKIPAGVADGNRIHLDSRGEVGPGGGPAGDLYIEMTVSPHDVFTRHGDDLEMVVTIPMTAAALGTKVPMHTLEADREDFAEDTKTVTVEVPAGTQSGTRIVVSERGVPRLRRNGRGDLGVTFIVQTPTKLDSHQKDLLRQLAEAREETNASASVEKSGGRGMFSRIKEAFGG

SEQ ID NO: 28590 - protein, 348 aa, Propionibacterium acnes KPA171202
MKALRFHAPEDVRLEDVPEPECKSDEIKIKVRNCSTCGTDVKILHNGHQNITGVTIMGHEVAGEIVEIGSEVAGDWKIGDRVQSIAAVPCGQCHECRKGWMQVCQNQTSVGYQYDGGFAEYMIVPPQVLKVDGLNRIPDDVDFDEASAAEPFACAINAQEQLGIEKGDFLAIFGAGPIGCMHTRIARGVHKVGTIVMIDINAERLALSAAAVKPDITIDGSQEDVVAKVMELTNGRGADVIITATPANITQEQALSMAARNGRISFFGGLPKTNPTITCDSNLIHYRQLHIHGANGSAPEHNKRALQYIASGQVPVKDLITRHVKLDDVMTVFDIVAKGEAIKVTVEP

SEQ ID NO: 28591 - protein, 575 aa, Synechococcus elongatus PCC 7942
MGESSARKPNISVSGRWLVHPAIAAFSSAFPGCFCPLPSPAVTLQTEMEAALEVAALNREMLIILDFGSQYSELIARRIRETQVYSEVLSYRTTADQIRQLSPKGIILSGGPNSVYDDYAPVCDPEIWNLGIPVLGVCYGMQLMVQQLGGQVDRAERGEYGKAALVIDDPTDLLTNVEPGSTMWMSHGDSVKTMPEGFELLAHTDNTPCAAIADHQRKFYGVQFHPEVVHSVHGMALIRNFVYHICDCEPTWTTETFVEEAIREIRARVGDKRVLLALSGGVDSSTLAFLLHRAIGDQLTCMFIDQGFMRKGEPERLMEVFNEKFKIHVEYIQARDRFLQRLEGITDPEEKRKRIGHEFIRVFEEESRRLGPFDYLAQGTLYPDVIESADTNVDPKTGERVAVKIKSHHNVGGLPKDLQFKLVEPLRRLFKDEVRQVGRSLGLPEEIVKRHPFPGPGLAIRILGEVTAEKLNILRDADLIVRQEVNRQGYYDEFWQAFAVLLPVKSVGVMGDKRTYAYPVVLRFVSSEDGMTADWSRAPYDLLETISNRIVNEVKGVNRVVYDITSKPPGTIEWE

SEQ ID NO: 28592 - protein, 296 aa, Anabaena cylindrica PCC 7122
NSRLCMSSAVSGYIQSFGADGPPCCYDDLELTDCAFLIGTNTAECHPIVFNRLAKYHKKNRHVKMVVVDPRRTPTAEAADLHLAIRPGTDIDLLNGIAHLLMKWNYIDTLFMDECTSNFPAYAEVIRHYSPDVVSRQCGISIEDLETAAKYWGKSKSVLSLWSMGVNQSTEGTAKVRTIINLHLMTGQIGKPGAGPFSLTGQPNAMGGREAGGLAHLLPGYRLVKNDKHRAEVEDFWGLERGRISPVSGLTAWDMITSLESGNVGLLWIAATNPAVSMPDLERTKKALLKSPLTIY

SEQ ID NO: 28593 - protein, 296 aa, Oscillatoria sancta PCC 7515
NSRLCMSSAVSAYIQSFGSDGPPCCYDDLEQTDCAFLIGTNAAECHPIAFNRLRVHHKKNKKVKMVVVDPRYTQTAEAADLHLAIRPGTDIDLLNGIAHLLMRWGLLDPLFIDECTTGFSDYTDVIRHSPPELVARHCGIRLDELETAARYWGESKQVLSLWSMGMNQSSEGTAKVRTLINLHLMTGNIGKPGAGPFSLTGQPNAMGGREAGGLSHILPGYRVVKNPLHRAEVEKLWGLTPGQISAVPGRTAWEMITALERREIGCFWIAATNPAVSMPDLERTKAALLRSPFTVY

SEQ ID NO: 28594 - protein, 132 aa, Glycine max
MSEIQTLPGEIPSNERAGCEVIKSDDKLSHFENFCQSGLSHLGIKHSQDINLQGIWKEAEPFADLVGPYWSLRAALGPLLETLIILDRLLFLQEQGSALEACLLPIFDPKISPRNVAIIAKKIDKDLRSSCC

SEQ ID NO: 28595 - protein, 450 aa, Mycobacterium avium 104
MARGSRRGLLVGLTAASVGVIYGYDLSIIAGAQLFVTEDFGLSTRQQELLTTMAVIGQIGGALFAGVLANAIGRRRSVLLILSGYAVFALLAAFSVGLPMLLTARLLLGLTIGVTVVVVPVYVAESAPTAVRGALLTAYQLAIVSGLIVGYLSGYLLAGTHSWRWMLGLACVPAVLLLPLVFRMPDTARWYLLKGRVDDARRALLRVEPAARVDDELAEIGRAVSEEAASLPAMLAEMVRSPYRRATVFVVVLGFLIQITGINAIIYYSPRIFEAMGFTGNFALLALPALVQVAGLVAVGTALLLVDRVGRRPILLCGTAMMIVADVVLVAVFGRGPGGVIAGFAGVLLFIFGYTMGFGSLGWVYASESFPSRLRSIGSSTMLTSNLVANAIVAAVFLTLLHSLGGAGTFAVFAVLAVVAFAFVHRYAPETKGRQLEDIRHFWENGGRWD

SEQ ID NO: 28596 - protein, 242 aa, Nostoc sp. PCC 7120
MIVMKLFIPVTVIGLCLSSSQVLAQTLTLSPNLIGFNSNEGEKLLLTSRSREDFFPLSMQFVTQVNQAYCGVASIIMVLNSLGINAPETAQYSPYRVFTQDNFFSNEKTKAVIAPEVVARQGMTLDELGRLIASYGVKVKVNHASDTNIEDFRKQVAENLKQDGNFVIVNYLRKEIGQERGGHISPLAAYNEQTDRFLIMDVSRYKYPPVWVKTTDLWKAMNTVDSVSQKTRGFVFVSKTQD

SEQ ID NO: 28597 - protein, 296 aa, Oscillatoria sancta PCC 7515
NSRLCMSSAVSAYIQSFGSDGPPCCYDDLEQTDCAFLIGTNAAECHPIAFNRLRVHHKKNKKVKMIVVDPRYTQTAEAADLHLAIRPGTDIDLLNGIAHLLMRWGLLDPLFIDECTTGFSDYTDVIRHSPPELVARHCGIRLDELETAARYWGESKQVLSLWSMGMNQSSEGTAKVRTLINLHLMTGNIGKPGAGPFSLTGQPNAMGGREAGGLSHILPGYRVVKNPLHRAEVEKLWGLTPGQISAVPGRTAWEMITALERREIGCFWIAATNPAVSMPDLERTKAALLRSPFTVY

SEQ ID NO: 28598 - protein, 296 aa, Tolypothrix sp. PCC 7101
NSRLCMSSAVAGYIQSFGADGPPCCYEDLELTDCAFLIGTNTAECHPIIFNRLEKYRKKNRKVKLIVVDPRRTPTAENADLHLAIRPGTDIDLLNGIAHLLMRWNQIDVGFIDDCTSNFPAYAEVIRHYSPDVVAHRCGISVADLETAARYWGQSQRVLSMWSMGINQSSEGTAKVRTIINLHLMTGQIGKPGSGPFSLTGQPNAMGGREAGGLSHLLPGYRLVKNPQHRAEVENFWGLKPGQISSEQGMTAWDMITGLENGTVGLLWIAATNPAVSMPDLERTKKALLRSPFTIY

SEQ ID NO: 28599 - protein, 296 aa, Tolypothrix sp. PCC 7101
NSRLCMSSAVAGYIQSFGADGPPCCYEDLELTDCAFLIGTNTAECHPIIFNRLEKYRKKNRKVKLIVVDPRRTPTAENADLHLAIRPGTDIDLLNGIAHLLMRWNQIDVGFIDDCTSNFPAYAEVIRHYSPDVVAHRCGISVADLETAARYWGQSQRVLSMWSMGINQSSEGTAKVRTIINLHLMTGQIGKPGSGPFSLTGQPNAMGGREAGGLSHLLPGYRLVKNPQHRAEVENFWGLKPGQISSEQGMTAWDMITGLENGTVGLLWIAATNPAVSMPDLERPKKALLRSPFTIY

SEQ ID NO: 28600 - protein, 457 aa, Nostoc sp. PCC 7120
MRTEWVAKRRGQGNVTQMHYARQGVITEEMQYVARRENLPADLIREEVARGRMIIPANINHTNLEPMAIGIASKCKVNANIGASPNSSNLQEEVDKLNLAVKYGADTVMDLSTGGGNLDEIRTAIINASPVPIGTVPVYQALESVHGTIENLTPDDFLHIIEKHAQQGVDYQTIHAGILIEHLPLVRSRITGIVSRGGGILARWMLHHHKQNPLYTHFGDIIEIFKRYDVSFSLGDSLRPGCTHDASDDAQLAELKTLGQLTRKAWEHDVQVMVEGPGHVPMDQIEFNVKKQMEECSEAPFYVLGPLVTDIAPGYDHITSAIGAAMAGWYGTAMLCYVTPKEHLGLPNAEDVRNGLIAYKIAAHAADIARHRPGARDRDDELSKARYNFDWNRQFELSLDPERAKEYHDETLPADIYKTAEFCSMCGPKFCPMQTKVDADALTELEKFLAKEPVTQG

SEQ ID NO: 28601 - protein, 330 aa, Debaryomyces hansenii CBS767
MNVDTDIITLTRFILQEQQKEAPNATGELSLLLNSLQFAFKFIAHNIRRAELVNLIGISGSANSTGDVQKKLDVIGDEIFINAMKSSNNVKVLVSEEQEDLIVFEGGGRYAVCTDPIDGSSNIDAGVSVGTIFGIYRLKEDSQGSIKDVLRKGTEMVAAGYTMYGASAHLMLTTGQGVNGFTLDTQLGEFILTQPHLTIPKTRAIYSVNEGNSHYWADSAKQYIADLKKPQEDGKPYSARYIGSMVADIHRTILYGGIFAYPADSKLKNGKLRILYECFPMAMLMEQAGGAAINDKGERILEILPKGIHDKSGIWLGSTGEVDRYLTYLK

SEQ ID NO: 28602 - protein, 418 aa, Ralstonia metallidurans CH34
MPVFPISTGGACRPRPALIAMTSVLRLTDLISQGKISGKRVFIRADLNVPQDDAGNITEDTRIRASVPAIQACLEAGATVMVTSHLGRPTEGEFKPEDSLAPIATRLSELLGKPVKLVQNWVDGVEVAPGQIVLLENCRVNKGEKKNSDELAQKMAKLCDVYVNDAFGTAHRAEATTHGIAKFAPIACAGPLLAAEIDALGRALGQPARPLVAIVAGSKVSTKLTILKALADKVDNLIVGGGIANTFMLAAGLKIGKSLAEADLVGDAKTIIDIMAARGASVPIPVDVVCAKEFSATAAATVKDVKDVTDDDMILDIGPKTAAMLADQLKAAGTIVWNGPVGVFEFDQFGNGTKVLAEAIATSKAFSIAGGGDTLAAIAKYGIADRVGYISTGGGAFLEFLEGKKLPAFEVLEQRAAG

SEQ ID NO: 28603 - protein, 249 aa, Synechococcus sp. WH 8102
MTAQPLLVFDFDGVIVDGMAEYWWSAWMAAQRLNAEPQGLGSDAVPQGFRRLRPWVHHGWEMVLLAAEMPQLDPERWVVDYATEQDMALQRRGWSASLLQEALDQTRQQAVSSDRAAWLGLHQPFPGLVDRLQAFQEEGVDWAVLTTKTAAFTAELLESLGLRPWRLDGREAGPKPEVLLRLQRERVLAGFVEDRRATLETVRDTDGLQSLPCWLASWGYLKPSDREDLPRGIQLIDQDRLATPLAQWP

SEQ ID NO: 28604 - protein, 543 aa, Synechococcus sp. WH 8102
MTTQRITDDLERLLALLPDPVRDALRPPERRDQLLEVVLDLGRVPEARYPGQALALGEVALTRDDLDAMVARLGCFGADNRAGIERTLHRISAIRNRRGDVVGLTCRVGRAVFGTVALVRDLLDGGQSLLLMGRPGVGKTTALREIARVLADDLQRRVVVIDTSNEIAGDGDIPHPAIGRARRMQVARPEQQHQVMIEAVENHMPEVIVIDEIGTELEAQAARTIAERGVMLVATAHGNALANLIKNPTLSDLVGGIQSVTLGDDEARRRRSQKTVLERAAEPTFPVAVEMHSRQRWAVHTDVASTVDQLLRGLPPRIQERELAADGAVRLVDPPDERRPRLLAQPGLQSRPALAAVPMPPPAEPPLPDPEEEVDPASDDLQVLCCGITPQLVEESTRRHGWPVQVVEDLSDADVVLSIRQGLGRQPSLRRQARELKVPILVIKADTLPQVERALERLLSRREGMDQEEPGPVSGDGQDDELAGLEECRLAVEQVVMPQGRPVELLPRSERVRRMQADLVERYRLRSDVFGQAEQCRLRVFPP

SEQ ID NO: 28605 - protein, 408 aa, Wolinella succinogenes DSM 1740
MQIPNRLQPFYENLVFERHDNQMVINFGPQHPSAHGQLRLILELEGEKVTRAVPDVGYLHRGMEKMGENMIYNEFIPTTDRMDYIAASSNNHAFALTVEKLLGIEVPRRAKVIRMMIVELNRIISHLFWLATHALDVGAMSIFLYCFREREFAMDLMEDYCGARLTHSSIRIGGVPLDLPAGWLEKLKSFLEKMPENIALYEGLLSENRIWKMRLENVGIITPEMAKSWGCSGVALRGSGIQWDLRKEQPYELYDEVEFDIPVSDSGDSYGRYKLYMEEMRQTVKILHQLIEMYPSTSSEIMAHAPQYISAPKEQIMTQNYSLMQHFVLVTQGMRPPVGEVYCATESPKGELGFFIRSEGEPYPYRLKIRAPSFYHTGILQDLLPGGYIADVVTIIGNLNIVFGEIDR

SEQ ID NO: 28606 - protein, 929 aa, Mycobacterium avium 104
MTTEFVRHDLATNPTGPAEPDRVRVIREGVASYLPDIDPEETSEWLESFDELLERSGPSRARYLMLRLLERAGEQRVAIPSLTSTDYVNTIPTELEPWFPGDEDVERRYRAWIRWNAAIMVHRAQRPGVGVGGHISTYASSAALYEVGFNHFFRGKSHPGGGDQIFIQGHASPGIYARAFLEGRLTADQLDGFRQEHSHAGGGLPSYPHPRLMPDFWEFPTVSMGLGPLNAIYQARFNHYLHDRGIKDTSDQHVWCFLGDGEMDEPESRGLIQVAANEALDNLTFVINCNLQRLDGPVRGNGKIIQELESFFRGAGWNVIKVVWGREWDALLHADRDGALVNLMNTTPDGDYQTYKANDGAYVRDHFFGRDPRTKALVENMTDAEIWNLKRGGHDYRKVYAAYRAAVDHKGQPTVILAKTIKGYSLGAHFQGRNATHQMKKLALEDLKHFRDAMRIPISDAQLDENPYLPPYYHPGSDAPEIRYMLDRRRTLGGFLPERRTKAKALRLPGRDIYAALKKGSGTQEVATTMATVRTFKEVLRDKEIGPRIVPIIPDEARTFGMDSWFPSLKIYNRNGQLYTAVDAELMLAYKESEVGQILHEGINEAGSVGSFIAAGTSYATHNEPMIPIYIFYSMFGFQRTGDGLWAAADQMTRGFLLGATAGRTTLTGEGLQHADGHSLLLAATNPAVVAYDPAFAYEIAYIVESGLARMFGENPEDVYFYITVYNEPYVQPPEPENFDPEGLLRGLYRYHVATEQRANKAQILASGVAMPSALSAAKMLADEWDVAADVWSVTSWGELNRDGVAIDRARLRHPDRPAGVPYVTQALSDASGPVVAVSDWMRAVPEQIRPWVPGTYVTLGTDGFGFSDTRPAARRYFNTDAESQVVAVLEALARDGEIDPSVPVAAARQYRIDDVLAAPEQTSDPGVA

SEQ ID NO: 28607 - protein, 697 aa, Neurospora crassa
MAVFWSLTYSQGYEDGEVRRYGAGESYRPYNRDRSPRAIRSPLRDRGRTPPGASDSYVPSRSPRRRSRSGDRLVDRIGERGGDRLGDRLVDRMGDRVGDRLADRVGDRIGDRLGDRLGDRIRDRMGDRLGDRMGDRLPDRLGDRMGDRPGGMGDRYRRPRDRSREAENTWRRQDRSRSRPRSPPPRSPSPPRRSPPPRRSPPPRFASPRRDERPERARSPPRRDFEIRRRSRSPFDRDRGIRRNRSPLRRTPPVGPRGGSYRPRFRSPERRVRDQDDRYPAPAYRRPASPLPPRDSVNSSAITSRSASGKSSPRPGSRQRRDDRSRPQSPAPVAAPAPASVQAQTQTQTQTQAQAQTQAQAQTEAPTPAPRSPPQPAAPTPIPVRETPKQEQRPPAPEPAPTPTPVKSPPRGPAALRAPPTGPAAARNLAPPAAPSASPATRHPPQTPSGPSRPDTSSPPVPPSGPRGYVPPSRGGGFAPRGGRGGNSWPGISRHNSVTGNNANGPAASVSPSSGGPPTGPSNANNIPTGPRASAAANAASSVSASAGSGVVTSTSSPSPSLSSSAKPFNPPTGPAAHAHSHGHHGPRGHQQQSLTLAQSLMANMPPIIPGVGKLDPSIGSTMLTGVTKDLDPHHRKLMEDEERIREELNAKKEKLRRSLRMWSKMERESKAFELKSDLSERSLKNLAGEGLGGAAF

SEQ ID NO: 28608 - protein, 205 aa, Wolinella succinogenes DSM 1740
MDLKQKYIFIEGTNCPVTVRGRLLQVFRRSVSGELFKGLWLVLREMLRFNIHTTQYPKEKLPLSPRYRAIHELLRLLESGNERCIGCGLCEKICISNCIRMETSYGEDGRKKVHEYTINFGRCIFCGFCAEVCPELAIVHGGRYENASEQRAHFGLKEDMLTPMERFMNQGQKEFPGFGALSQDADSKVKKTPLAYFTPKGEENV

SEQ ID NO: 28609 - protein, 467 aa, Streptomyces tubercidicus
MTVPATVAELVRKFRANGRIVIVGASLAGLRAAEALRQEGFTGSLTIIGDEPYEPYDRPPLSKQVLKGWVPADHTKLPRLREVNAQWRLGVTATGLDRIAKQVRLADGEQIPYDRLLIATGTRARQWPNPEEAALDGVYSLRSRDDAAQLQEALATPPSRVVVIGAGFIGSEVTSVCRELDLPVTVVERGSAPLVGALGGVIGEIAAEIQRDHGVDLRCGLGVSSLEGDAGGHVRRAHLSDGTTIDADVVVASLGSIRNVEWLEGAGLASGFWGVGCDAGGRAFDINGVVTDSIYVAGDVARAPHVLYEYQFLAMEHWDNAVLGAEAAAHNMVNLEPHYRPHLLLPGFWSGQFGLNIKSVGVPPFGDEIVFTQGSVKERHFAAAYGRRGRIVAAVTFDHGKWLEYYGKLIEQSGPFPPPPPGWDQPPDMKPVPAEFPQPGVPTALPDVVLTGHDPGERGAEFRPRPR

SEQ ID NO: 28610 - protein, 227 aa, Synechococcus sp. WH 8101
NSRLCMSSAVAGYSRSLGSDGPPCCYDDLDHCSVAVLIGTNTAECHPVLFQRLLKRKKRDPKGLTIVVVDPRATDTSRIADYHLAIAPGTDLALLHGLARLIVQDNGFDSDFIDEATEGFAAYAKTIRAWTPAKVAALCGISEKELRQVARLWSRSQGVLSLWSMGVNQRREGTAVVSGIINLHLLTGQIGKPGAGPFSLTGQPNAMGARGRRPGPSASRLSLYGQE

SEQ ID NO: 28611 - protein, 271 aa, uncultured bacterium
NSRLCMSSAVAGYTQSLGSDGPPCCYDDLDHCKVAFLIGTNTAECHPVLFQRLLKRKKRNPGSLKIVVVDPRRTDTAKAADIHLPIAPGSDLALLHGIAHLILRENGQDPAFIDDHTENYEAFFDVVARWTPRRVARFCNLPEKRLREVAQPFHHRETVLSLWSMGVNQRREGTAVVSGLINLHLLTGQIGKEGAGPFSLTGQPNAMGGREAGGLSHLLPGYRLVANEQHRQVVEQAWNLPAGSIAAKPGLAAWQQIEAMERGELDLWWVA

SEQ ID NO: 28612 - protein, 989 aa, Arabidopsis thaliana
MALVSLLEISIAFFCFLIFRIFLISKKPHRSFLTNWPLLGMLPGLLTVLPRVYDFITEVLEDGNLNYLFIGPFLGGIDMLFTVDPANIHHIMSSNFANYPKGTEFKKLFDVLGDGIFNADSDLWKDLRKSSQSMMNHPDFQRFSLATSLSKLEKGLVPLLDHVAKEKLVVDLQDVFQRFTFDTTFVLATGYDPGCLSVEMPEIEFARALDDAEEAIFYRHFKPEVVWKMQRLIGVGAELKLKRAHAIFDRVCSKCIASKRDEISQGIDSSSSKDLLMSSINVDTTKYKLLNPSDDRFLRDTILSFMLAGRDTTGSALTWFFWLLCNNQEAMTKIRQEINTNLFPRNKTDDGSVSYDSDSFNPQEVKKLVYLHGAVCEALRLYPPVPFNHKSPAKPDVLPSGHKVKANSRILFCLYSLGRMKSVWGEDAMEFKPERWISESGRSVHEPSYKFLSFNAGPRTCLGKEVAMTQMKTVAVKIIQNYDINVVEGHKIKPAPSVILHMKHGLKVTVSKRCLLVEIHRVYDFITEILEVTNLTYPCTGPCFANLDMLVTVDPANIHHIMSSNFANYPKGPEFKKLFDILGDGIFNADSELWKDLRKSAQSMMMNPEFQKFSLATSLKKLEKGLVPLLDHVAKEKLAVDLQDMFQRFTFDTTFVLATGYDPGCLSVEMPEVEFARALDDAEEAIFFRHVKPEIFWRLQGLLGLGDEKKMTKARSTLDRVCSKYIAIKRDEVSRGTNNVDSHSKDLLTSYMNLDTTKYKLLNPSDERFLRDTILTFMLAGRDTTGSGLTWFFWLLIKNPEVIAKIRQEINTALFQRSKVDDDASNNNDSDSFSPQELKKLVYLHGAICESLRLYPPVPFQHKSPTKPDVLPSGHKVDANSKILFCLYSLGRMKSVWGEDALEFKPERWISESGNSVHEPSYKFLSFNAGPRTCLGKEVAMMQMKSVAVKIIQNYEMKIVEGQQIEPAPSVILHMKHGLKVTVTKRCLV

SEQ ID NO: 28613 - protein, 352 aa, Coprinopsis cinerea okayama7#130
MARDFPPFPDDIPTHPLLIVDYEKVKNRDQDEIEKLWEAATKLGFWYLRNHGCSEEADRMFDLGADVMALPLSEKMKYEQGNDGASAGYKAAGANAVDATGEPDLVEFLNVSKDDVLAWPRPGKRSYPKPATDRMDSTIIPFFRKCMEVNAVLLGVFEEKLGLPSGTLARRHLDDEPSGSEARITCTPPMKDTERVAIGGHTDFGSLTVLFNRLGGLQVLPPGSDHWQYVKPLAGHAICNVGDALTIFSGGILRSNLHRVLPPPGSQANSQRWSLAYFTRPGNSVLLQPLMDESSMISNAVNTVGETHGLVTGGQTAGEWFARRIKNQRLDNRKASRYSPSYRWDLIAWAGP

SEQ ID NO: 28614 - protein, 271 aa, uncultured bacterium
NSRLCMSSAVAGYTQSLGSDGPPCCYDDLDHCKVAFLIGTNTAECHPVLFQRLLKRKKRNPGSLKIVVVDPRRTDTAKAADIHLPIAPGSDLALLHGIAHLILRENGQDPAFIDDHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVANDQHRQVVEQAWNMPAGSIAAKPGLAAWQQIEAMERGELDLWWVA

SEQ ID NO: 28615 - protein, 422 aa, Oryza sativa
MSGEVECRVCHAKVQVPMAAAAVSKAYDIHRSSVSSRQRALNVLLVSGDCVLAGLQPILVYMCKVDGKFKFSPVSVNFLTEITKIIFAIIMLCIQARRLKVGEKPFLTVSTFMQAARNNVLLAVPALFYAINNYMKFVMQLYFNPATVKMLGNLKVLVIAVLLKVIMRRRFSTIQWEALALLLIGISVNQLKSLPEGSSTLGLPVAAGAYLYTLFFVTVPALASVYNEKALKSQFDTSIYLQNLFLYGYGAIFNFLGLVITAIIQGPSSFNILEGHSKATMFLICNNAAQGILSSFFFKYADTILKKYSSTIATIFTGVASAVLFGHTLTINFVLAISIVIISMHQYLSNQIKDEVPSSKIEMGDAHEHRSKESVVVNVSDSIATEAKHRHELPTDTIQLGSTPRRSSIHLTNTVLIREVES

SEQ ID NO: 28616 - protein, 616 aa, Candida albicans
ARASADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYMPAPEVISGKLYSSVQKLMIWSAGVILGMSCCVVDYHSMTSSIPALFKKISNGVYTLPNYLSAGAKHLLTRMLVVNPLNRITIHEIMEDDWFKQDMPDYLLPPDLSKNKNSKIDVDEDVIRALSVTMGYDRDCKIVNVIEKANKQVAAGNSSSQQSKSSNEILDAYLLMKENHRLVKDLKKSKSENIESFLSQSPPPSPFPNAGSTSSAPGVQQSLTYQTLATVPDLSTLPNSTIAILPTSLPSIHRAYMAETKQNGDPSQQHAPPPTKKSKTRWHFGIRLRSYPLDVMGEIYRALKNLGAEWAKPTEEELWTIRVRWKYDTSAQFECGSAPNLMKMQIQLFQLEPNNYLVSFKFSGWESAHGNAGTDSPQSHRQQDLDEVGSFSAYPFLHLATRLIMELAVNSQSG

SEQ ID NO: 28617 - protein, 126 aa, Prunus armeniaca
GTVNLMVWHCTIPGKTGTDWEGGFFPLTLHFSEDYPSKPPKCKFPPGFFHPNVYPSGTVCLSILNEDSGWRPAITVKQILVGIQDLLDQPNPADPAQTEGYHLFIQDATEYKKRVRQQAKQYPPLV

SEQ ID NO: 28618 - protein, 124 aa, Triticum aestivum
MRSRRRPSDSTTSARSLRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 28619 - protein, 218 aa, Vibrio vulnificus
MTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINGIPGVVTVGLFAHRGADVVITGTPEGAKIEE

SEQ ID NO: 28620 - protein, 383 aa, Arabidopsis thaliana
MPETEYSFGRSFLSLRRDQAHLMDPTSFSEPMTMEVELDSFQRQVAEKFIDLNASADEAEILSLEWIGKLLDSFLCCQEDFRVIIFNHKPQLLKQPMDRLIEEYFERSVKALDVCNAIRDGIEQIRQWQKLIEIVISALDTNQRQLGEGEIHRAKKALIDLAIGMLDEKDSSNTHRNRSFTRNKDHNQHIGYIRSLSWSVSRSWSASRQLQGIGNNLATPRASDVMATNGLALTVYTMTSILLFVTWVLVAAIPCQDRGLHVHFYFPRHFQWAVPVMSLHDKIMDESKKRDKKKKGCGLLREINQIERNSRMLSDLIDSDNFSLTDEKCTLEVKERVQELMNVCEAIKEGLDPFDRKVRDVFHQIVRTRTEALDSLGKLQNQE

SEQ ID NO: 28621 - protein, 443 aa, Medicago truncatula
MAASRRLRELQSEPSNKICVDCSQKNPQWASVSYGVFMCLECSGKHRGLGVHISFVRSVTMDSWSDLQIKKMEAGGNRNLNTFLSQYGISKETDIITKYNSNAASIYRDRIQAIAEGRSWRDPPVVKENASTRAGKGKPPLAAASNGGGWDDNWDNDDGDSYGYGSRGGGDIRRNQSTGDVIGFVGNGVTPSSRSKSTEDIYTRTQLEASAANKEGFFAKKMAENESRPEGLPPSQGGKYVGFGSSPGPAQRISPQNDYLSVVSEGIGKLSMVAQSATKEITAKVKDGGYDHKVNETVNIVTQKTSEIGQRTWGIMKGVMALASQKVEEFTKDYPDGNSDNWPRNENDRHDFNQENKGWNSSTSTREGQPSSGGQTNTYHSNSWDDWDNQDTRKEVPAKGSAPHNNDDWAGWDDAKDDDDEFDDKSFGNNGTSGSGWTGGGFH

SEQ ID NO: 28622 - protein, 361 aa, Saccharomyces cerevisiae
GMASMSVSTASTEMSVRKIAAHMKSNPNAKVIFMVGAGISTSCGIPDFRSPGTGLYHNLARLKLPYPEAVFDVDFFQSDPLPFYTLAKELYPGNFRPSKFHYLLKLFQDKDVLKRVYTQNIDTLERQAGVKDDLIIEAHGSFAHCHCIGCGKVYPPQVFKSKLAEHPIKDFVKCDVCGELVKPAIVFFGEDLPDSFSETWLNDSEWLREKITTSGKHPQQPLVIVVGTSLAVYPFASLPEEIPRKVKRVLCNLETVGDFKANKRPTDLIVHQYSDEFAEQLVEELGWQEDFEKILTAQGGMGDNSKEQLLEIVHDLENLSLDQSEHESADKKDKKLQRLNGHDSDEDGASNSSSSQKAAKE

SEQ ID NO: 28623 - protein, 432 aa, Propionibacterium acnes KPA171202
MTRQEWIVLAIAFIFTVLASLNVAMETALQHMSHSKAEELAADGKTAHQRVLDMVADPAPFINTAMLVRVISEVTATALVALLIFGHFDLPWQQVLVVVAIMVLVDFLAWGVAARTLGRQHDTAICTFWSRPWGVLAHVLGPIAALLILIGNALTPGKGYAEGPFTSEAELREMVDYAEASDLIEAGEREMIHSVFELGDTLTKEVMVPRTDVVYIPRTKNLRQAMSLALRSGFSRIPVVGEGFDDIRGVVYLKDLSQRVLDNPDGYATESVESIMRPAVLCPDSKPVDQVLREMQRDRNHLVIVVDEFGGTAGLVTIEDIVEEIVGEIVDEYDAEPTLTEEIEDGVFRISSRLPVDDLGELFDLKVDDDDVETVGGLMAKELSVVPIPGSVIIWEGLEITAEKATGRRHQVDTCLVKRAPEETPDQEYDDE

SEQ ID NO: 28624 - protein, 520 aa, Symbiobacterium thermophilum IAM 14863
MAVVPFQNEPLTDFSLPQNREAFRRALELVQSRFGREYPLIIGGERIMTRDRILSTNPANPKEVIGSVAKADRDLADKAMAAALAAFQDWSRVSPKARARILLKAAAIMRRRKHEFSATMVVEIGKSWVEADADTAEAIDFLEYYAREMYRLSEPQPLTRIPGEDNELYYIPLGVGLIIPPWNFPCAITVGMTASAIVAGNTVILKPSSLTPVVAALFAEVMEEAGLPPGVLNYLPGPGGSVGDYLVGHPQTRFISFTGSKEVGLRINEVAAKTAPGQRWIKRVVAEMGGKDAIVVDREADLDAAADGIVASAYGFQGQKCSACSRAIIHQDVYEEMIERIVERTKKLVQGDPRDPEVHQGPVADESAFKSILHYIEIGKQEGRLVLGGGPSPLASETGGYFIQPTIFADVDSRARIGQEEIFGPVLAIMKAKDFEDAIRIANDTEYGLTGSVYSRNRANLEYARRHFFVGNLYLNRKSTGALVGVHPFGGFNMSGTDSKTGGHDYLLLFLQAKAVSEKL

SEQ ID NO: 28625 - protein, 133 aa, Synechococcus elongatus PCC 7942
MSAVLSGGLNFPAKTLRRATRAAACSPFRLGLFLALRQTAVPLQDIAGTAGIAQGYSRRNLNELIAENELMWLMQVGLLRREVDGQGLTNRFRLTPLGQQLVLIWQQQGDRLPPAGLRDRFYNAVCRWLRLPF

SEQ ID NO: 28626 - protein, 150 aa, Brassica napus
AYSGRGDRADPTTWPEVEGPLKVILFEGWMLGFKPLPAEVVKAVDPQLEIVNKNLEAYYEAWDKYIDAWVVIKIKDPSYVYRWRLQAEIAMRQAGKAGMSDDEVNDFVSRYLPAYKAYLPTLYEEGPSGSEPERVLAIDIDEERNPILAT

SEQ ID NO: 28627 - protein, 271 aa, uncultured bacterium
NSRLCMSSAVAGYTQSLGSDGPPCCYDDLDHCKVAFLIGTNTAECHPVLFQRLLKRKKRNPGSLKIVVVDPRRTDTAKAADIHLPIAPGSDLALLHGIAHLILRENGQDPTFIDDHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVANDQHRQVVEHAWNLPAGSIAAKPGLAAWQQIEAMERGELDLWWVA

SEQ ID NO: 28628 - protein, 317 aa, Acetobacter pasteurianus
MPKSVVNPEFLPILEKMPSFDGLSSLSLPEVREVFLTSVRLIEGRPLPDVITREEYVPGLNNAPDVRVVVYTPREVQPNAPAMVYIHGGGLVSGHPEVDDPKCQKLASDLGFQIFSVDYRLAPEVKYPGAIEDCYAVLKWVHENASKLGISRDKVVVAGESAGGGLSAALSLMARDKKEYRLLSNCLSTPCWMIARQSTAIRRQFWRICLDTFANKYAWQAYLGDKAGGPQTPPYAAAGRATDLAGLPPTFIGVGSMDLFLKEDLDYATRLMAAAVPTEVMVVPGAYHVFDMYVPDAELSRRFMDAYCAALKRTLNL

SEQ ID NO: 28629 - protein, 271 aa, uncultured bacterium
NSRLCMSSAVAGYTRSLGSDGPPCSYEDLDHCTVAFLIGTNTAECHPVLFQRLLKRKKKHPGSVTIVVVDPRQTDTAKAADIHLAVAPGSDLALLHGIAHLVMRENRQDPTFIDDCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPAHRAEVEQTWGFPKGKITANPGLTAWQQVEAMERGELDLWWVA

SEQ ID NO: 28630 - protein, 271 aa, uncultured bacterium
NSRLCMSSAVAGYTRSLGSDGPPCCYEDLDHCSVAFLIGTNTAECHPVLFQRLLKRKKRNPGSLKIVVVDPRRTDTAKAADIHLPITPGSDLALLHGIAHLILRENGQDPTFIDDHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVANDQHRQVVEQAWNLPAGSIAAKPGLAAWQQIEAMERGELDLWWVA

SEQ ID NO: 28631 - protein, 271 aa, uncultured bacterium
NSRLCMSSAVAGYTRSLGSDGPPCSYEDLDHCTVAFLIGTNTAECHPVLFQRLLKRKKRHPGSVTIVVVDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPEHRAEVEQTWGFPQGKIAPDPGLTAWQQVEAMERGELDLWWVA

SEQ ID NO: 28632 - protein, 271 aa, uncultured bacterium
NSRLCMSSAVAGYTRSLGSDGPPCCYDDLDHCSVAFLIGTNTAECHPVLFQRLLKRKKRNPGSLKIVVVDPRRTDTAKAADIHLPIAPGSDLALLHGIAHLILRENGQDPTFIDDHTENYEAFFDVVARWTPRRVARFCNLPEKRLREVAQLCHHRETVLSLWSMGVNQRREGTAVVSGLINLHLLTGQIGKEGAGPFSLTGQPNAMGGREAGGLSHLLPGYRLVANEQHRQVVEQAWNLPAGSIAAEPGLAAWQQIEAMERGELDLWWVA

SEQ ID NO: 28633 - protein, 380 aa, Gluconobacter oxydans
MATRIDYYESLEVSRMASQDELKKAFRKQAMRYHPDRNPGDDAAEQKFKEINEAYDVLKDEQKRAAYDRYGHDAFEGGMGGMGGGFGGGFAGAGGLGDIFDQMFGDMMGGRRDGGRRTGADVQVQVEITLMEAFTGVTKDVEVRTRVTCEACHGSGSADPKAGSSTCPTCHGAGKVRAQQGFFLVERPCPTCHGSGRTVTNPCKVCHGTGTEAKTETISIDIPAGVEDGTRIRMAGKGEAGGEGVQPGDLYVHISVLSHDIFQRDGANIYCRVPLRMTQAALGTEVEVPVVDGGRSKVRIPAGTQTGETFRLRGEGFSVLRSSARGDMYIQVSVETPSHLTKRQRELLEEFEKEAGDDHAKGSPENSGFFAKVRDFLEGR

SEQ ID NO: 28634 - protein, 294 aa, Debaryomyces hansenii CBS767
MTQEFKVKAGLAQMLKGGVIMDVVTPEQAKIAEKAGACAVMALERIPADMRASGQVCRMSDPKMIKEIMATVSIPVMAKCRIGHFVEAQILEALEVDYIDESEVLTPADKLYHIKKDQFKVPFVCGARNLGEALRRVSEGAAMLRTKGEAGTGDISEAVSHINLIKQQIDHALSLKSEAEVAAYAEELRVPLITLQELIANKGKFPVVNFAAGGVATPADAALCMQLGCDGVFVGSGIFKSKNPELLAKAIVNAVTHYDDPKKVMEYSTDLGELMFGVSVDSLKASEKVSTRGW

SEQ ID NO: 28635 - protein, 757 aa, Saccharomyces cerevisiae
MMRGFKQRLIKKTTGSSSSSSSKKKDKEKEKEKSSTTSSTSKKPASASSSSHGTTHSSASSTGSKSTTEKGKQSGSVPSQGKHHSSSTSKTKTATTPSSSSSSSRSSSVSRSGSSSTKKTSSRKGQEQSKQSQQPSQSQKQGSSSSSAAIMNPTPVLTVTKDDKSTSGEDHAHPTLLGAVSAVPSSPISNASGTAVSSDVENGNSNNNNMNINTSNTQDANHASSQSIDIPRSSHSFERLPTPTKLNPDTDLELIKTPQRHSSSRFEPSRYTPLTKLPNFNEVSPEERIPLFIAKVDQCNTMFDFNDPSFDIQGKEIKRSTLDELIEFLVTNRFTYTNEMYAHVVNMFKINLFRPIPPPVNPVGDIYDPDEDEPVNELAWPHMQAVYEFFLRFVESPDFNHQIAKQYIDQDFILKLLELFDSEDIRERDCLKTTLHRIYGKFLSLRSFIRRSMNNIFLQFIYETEKFNGVAELLEILGSIINGFALPLKEEHKVFLVRILIPLHKVRCLSLYHPQLAYCIVQFLEKDPFLTEEVVMGLLRYWPKINSTKEIMFLNEIEDIFEVIEPLEFIKVEVPLFVQLRKCISSPHFQVAEKVLSYWNNEYFLNLCIENAEVILPIIFPALYELTSQLELDTANGEDSISDPYMLVEQAINSGSWNRAIHAMAFKALKIFLETNPVLYENCNALYLSSVKETQQRKVQREENWSKLEEYVKNLRINNDKDQYTIKNPELRNSFNTASENNTLNEENENDCDSEIQ

SEQ ID NO: 28636 - protein, 123 aa, Wolinella succinogenes DSM 1740
MKFISTDQAPAAIGPYSQAIVVNDMIFTSGQIALRPEGSMEEGDVEAQTRQVLTNLKGVLESEGSTLSKVIKTTVFLAHMEDFAKMNGVYAEFFGEHKPARSTVAVKTLPKNALVEIECIALK

SEQ ID NO: 28637 - protein, 164 aa, Zea mays
ASAHADDIADDFFPLCDIDGVIVHMYLPRDRWTGYSRGLYFVRDKDQDEAHKVDGRLDGRLVIMRQIMVHCAKAGPNAERIIMGPIMEPVARPRGRSTRRRPRQEYRDDYQDDYHDRHYRKRSRNQCRHGYSRDRYCHRDYRHRSLSPRLTTARSSRSHSRTRG

SEQ ID NO: 28638 - protein, 271 aa, uncultured bacterium
NSRLCMSSAVAGYTRSLGSDGPPCSYEDLDHCTVAFLIGTNTAECHPVLFQRLLKRKKRHPGSVTIVVVDPRQTDTAKAADIHLAVAPGSGLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPAHRAEVEQTWGFPQGKIAPEPGLTAWQQVEAMERGELDLWWVA

SEQ ID NO: 28639 - protein, 232 aa, Glycine max
  misc_feature (218)..(218): Xaa can be any naturally occurring amino acid
  unsure (1)..(232): unsure at all Xaa locations
TYSLCKPCFLYRGSDCPRESDGASIQMRLSYSPAAQFFLFLVQWTDCHLAGVLGLLRILIYKVYEDGKTTMSIYEKKASLKEFYGVVFPSLLQLHRGITDVDDRKQKHLCATKYKLKDLTSKGNLSEIDMERELECGICLEINSKVVLPNCNHSMCMKCYEDWHARSQSCPFCRDSLKRVNSDDLWICISSSEINDLASINKENFKRLFMYIESLPLXLPDPIFSMSYHHHQ

SEQ ID NO: 28640 - protein, 271 aa, uncultured bacterium
NSRLCMSSAVAGYTRSLGSDGPPCCYDDLDHCSVAFLIGTNTAECHPVLFQRLLKRKKRNPGSVTIVVVDPRRTDTAKAADIHLPIAPGSDLALLHGIAHLVLRENGQDPAFIDDHTDNYEAFFDVVARWTPRRVARFCNLPEKRLREVAQLFHRRERVLSLWSMGVNQRREGTAVVCGLINLHLLTGQIGKEGAGPFSLTGQPNAMGGREAGGLSHLLPGYRLVANDQHRQDVEQAWKFPAGSIAATPGLAAWQQIEAMERGELDLWWVA

SEQ ID NO: 28641 - protein, 322 aa, Zea mays
MSGHGDTATSAKMAKLKELLQKSENHICADCGASDPKWASANIGVFICVKCSGVHRSLGTHISKVLSVTLDKWSDSEVDSVIEVGGNSQANAIYEAFIPEGCQKPHSDSTQEEREKFIRSKYELQEFLKPSLRIVSHQPSDSGKHAGNASHSDGSKSQSRMIEFIGILNVKVIGGTNLAIRDMSSSDPYVVLTLGQQKAQTSVINGNLNPVWNEELKLSVPQQYGPLKLQVFDHDMVSKDDLMGEAEIDLQTMINAAAAFGDPELLGDIQIGRWLKSEDNALVRDSAVVVSGGKVKQGMALKLQHTESGELELEMEWMPLNV

SEQ ID NO: 28642 - protein, 271 aa, uncultured bacterium
NSRLCMSSAVAGYTLSLGSDGPPCSYEDLDHCTVAFLIGTNTAECHPVLFQRLLKRKKRHPGSATIVVVDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPEHRAEVEQTWGFPQGKIAPDPGLTAWQQVEAMERGELDLWWVA

SEQ ID NO: 28643 - protein, 271 aa, uncultured bacterium
NSRLCMSSAVAGYTLSLGSDGPPCSYEDLDHCTVAFLIGTNTAECHPVLFQRLLKRKKRHPGSVTIVVVDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPEHRAEVEQTWGFPQGKIAPDPGLTAWQQVEAMERGELDLWWVA

SEQ ID NO: 28644 - protein, 512 aa, Glycine max
  misc_feature (458)..(458): Xaa can be any naturally occurring amino acid
  unsure (1)..(512): unsure at all Xaa locations
QQPKIISILLSSKNLTGNIPLDITKLTGLVELRLDGNMLTGPIPDFTGCMDLKIIHLENNQLTGALSTSLANLPNLRELYVQNNMLSGTVPSDLLSKDLDLNYTGNTNLHKGSRKKSHLYVIIGSAVGAAVLLVATIISCLVMRKGKTKYYEQNSLVSHPSQSMDSSKSIGPSEVAHCFSFSEIENSTNNFEKKIGSGGFGVVYYGKLKDGKEIAVKVLTSNSYQGKREFSNEVTLLSRIHHRNLVQLLGYCREEGNSMLIYEFMHNGTLKEHLYGPLTHGRSINWMKRLEIAEDSAKGIEYLHTGCVPAVIHRDLKSSNILLDKHMRAKVSDFGLSKLAVDGASHVSSIVRGTVGYLDPEYYISQQLTDKSDIYSFGVILLELISGQEAISNDSFGANCRNIVQWAKLHIESGDIQGIIDPVLQNNYDLQSMWKIAEKALMCVQPHGHMRPSISEVXREIQDAIAIEREAEGNSDEPRNSVHSSINMGSMDLAATENYLSIDESIAQPIAR

SEQ ID NO: 28645 - protein, 199 aa, Triticum aestivum
HNFLSKEECEYLIGLAKPHMVKSTVVDSTTGKSKDSRVRTSSGMFLQRGRDKVIRAIEKRIADYTFIPADHGEGLQVLHYEVGQKYEPHFDYFLDEFNTKNGGQRMATLLMYLSDVEEGGETIFPDANVNASSLPWYNELSECAKRGLSVKPKMGDALLFWSMKPDATLDPLSLHGGCPVIRGNKWSSTKWMHIHEYKA

SEQ ID NO: 28646 - protein, 411 aa, Vitis vinifera
MNALAATNRNFKLAARLLGLDSKLEKSLLIPFREIKVECTIPKDDGTLASFVGFRVQHDQWRGPMKGGIRYQPEVDPDEVNALAQLMTWKTAVANIPYGGAKGGIGCNPGELSLSELERLTRVFTQKIHDLIGVSTDVPAPDMGTNSQTMAWILDEYSKFHGYSPAVVTGKPTDLGGSLGRDAATGRGVLFATEALLHEHGKSIAGQRFVVQGFGNVGSWAAQLISGHGGKIVAVSDITGAIKNSKGIDVPSLLKHSVEHRGVKGFNGADPIDPKSILVEDCDVLIPAALGGVINRENANEIKAKFIIEAANHPTDPEADEILSKKGVIILPDIYANSGGVTVSYFEWVQNIQGFMWDEEKVNNELRTYMTRGFKDVKEMCRTHNCDLRMGAFTLGVNRVARATVLRGWEA

SEQ ID NO: 28647 - protein, 211 aa, Schizosaccharomyces pombe 972h-
MTTEAAPNLLVLTRHGESEWNKLNLFTGWKDPALSETGIKEAKLGGERLKSRGYKFDIAFTSALQRAQKTCQIILEEVGEPNLETIKSEKLNERYYGDLQGLNKDDARKKWGAEQVQIWRRSYDIAPPNGESLKDTAERVLPYYKSTIVPHILKGEKVLIAAHGNSLRALIMDLEGLTGDQIVKRELATGVPIVYHLDKDGKYVSKELIDN

SEQ ID NO: 28648 - protein, 408 aa, Polaromonas sp. JS666
MELRVDTVARHLRAALADATQPLCAYVYDLEALRRHSQAVVAALPAGCELFYAIKANSDLPILRTLAPRVAGFEVSSGGELAWVREHFPSTPLIFSGPGKTDAELRLALDSDVEAIHVESLHELRRLAWLAEAAGRTAPVLLRVNLPLPGLAATTLMMGGKATPFGIAVDQLPACLASLREAPGLRLRGFHFHLLSHQLDAAAHVELIAAYLEQVERWCGAYGLDIDHVNVGGGIGVNYRQPQQQFDLAAFGAGLQRLRASRPGLPRLRFECGRYITAACGYYAMQVLDLKHTFGRDYVVARGGTHHFRTPYAQGHSHPFHVLPVEHWPYPWARPELRDATVHVVGQLCTPKDLLAFDAPVERVRVGDLLVFPYAGAYAWHISHHDFLRHPHPQHWYLPMEHADAADE

SEQ ID NO: 28649 - protein, 347 aa, Oryza sativa
  misc_feature (320)..(320): Xaa can be any naturally occurring amino acid
  unsure (1)..(347): unsure at all Xaa locations
MAATVVSNKRVILKRYVTGLVSEDDMEVVTVEAPPLAVPAGSKTVVVKNLYISCDPYMRNRMTYHEEPSYVPDFVLGEVLVNFGVMKVISSGHQDFKAGDLVWGITGWEEYTVINNPETLFKINHPELPLSYYTGILGMPGLTAYGGFFEVAKPKKGEYVFISSAFGAVGQIVGQLAKITGCYVVGSAGSDEKVNLLKTKFGFDDAFNYKKELDLEAALKRCFPDGIDIYFENVGGAMLDAVLPNMRVAGRIAACGMISQYNLEQPEGVYNMICIVTKRLRMQGFLVFDFYDMYYQIEEQIAGYLKEGKVAYTEDVVEGXLDAAPAALVKLFTSSSIGKQLVAVARE

SEQ ID NO: 28650 - protein, 372 aa, Arabidopsis thaliana
MSSPEKKRKKNQKSSPNPSLPEDLIVSILARVSRSYYTNLSVVSKTFRSILTSPELYKTRTLLGKPETFLYVCLRFPDEANPRWLILYRKPNQTLTKKKKKKEDSSVHLLAPIPILNSPTVEWSSLVAVGSYLYAITADIKDSPCSNVWYLDCRTHTWLDSPRLRLAHINSDFNGRTYFPGSSEKPDSLNCVEVYNTNTQTWNPVPPQKRKLKFGNMEGKIYIPPCQENHRKAVALNPKVLTWEAVGLGTNLDRGSFCMIGNIAYCYDPSGKFRWMNCNTAEGDWSRLEGLEGLPKFARYSTVKLAEYGGKLVVLWDKYVAASGYKEKMIWCAEISLEKRNSEEIWGKVEWFDAVLTVPKSYKFVCAKSATV

SEQ ID NO: 28651 - protein, 409 aa, Schizosaccharomyces pombe 972h-
MFRTCTKIGTVPKVLVNQKGLIDGLRRVTTDATTSRANPAHVPEEHDKPFPVKLDDSVFEGYKIDVPSTEIEVTKGELLGLYEKMVTIRRLELACDALYKAKKIRGFCHLSIGQEAVAAGIEGAITLDDSIITSYRCHGFAYTRGLSIRSIIGELMGRQCGASKGKGGSMHIFAKNFYGGNGIVGAQIPLGAGIGFAQKYLEKPTTTFALYGDGASNQGQAFEAFNMAKLWGLPVIFACENNKYGMGTSAERSSAMTEFYKRGQYIPGLLVNGMDVLAVLQASKFAKKYTVENSQPLLMEFVTYRYGGHSMSDPGTTYRSREEVQKVRAARDPIEGLKKHIMEWGVANANELKNIEKRIRGMVDEEVRIAEESPFPDPIEESLFSDVYVAGTEPAYARGRNSLEYHQYK

SEQ ID NO: 28652 - protein, 304 aa, Propionibacterium acnes KPA171202
MGSMSEHIPATNSTGTTRVKRGLADMLKGGVIMDVVTPEQAKIAEDAGACAVMALERVPADIRAQGGVARMSDPDLIEGIIEAVSIPVMAKARIGHFVEAQVLESLRVDFIDESEVLSPADYANHIDKWAFGVPFVCGATNLGEALRRITEGAAMIRSKGEAGTGDVSEAVRHLRTIRAEMARLSSMSPDELYVAAKELQAPYDLVAEVARTGELPVVLFVAGGVATPADAALVMQMGAQGVFVGSGIFKSGNPAARAAAIVKATTAYDDPDTIAEVSRGLGEAMVGINVADVPAPHRLAERGW

SEQ ID NO: 28653 - protein, 137 aa, Coprinopsis cinerea okayama7#130
MARTKQTARKSTGGKAPRKQLATKAARKTAQTATGGVKKPHRFRPGTVALREIRRYQKSTELLIRKLPFQRLVREIAQDFKTDLRFQSSAVMALQEAAEAYLVSLFEDTNLAAIHAKRVTIQPKDLALARRLRGERS

SEQ ID NO: 28654 - protein, 421 aa, Streptomyces tubercidicus
MVDAHQTFVIVGGGLAGAKAAETLRAEGFTGRVILICDERDHPYERPPLSKGFLLGKEERDSVFVHEPAWYAQAQIELHLGQPAVRLDPEGRTVRLGDGTLIAYDKLLLATGAEPRRLDIPGTGLAGVHHLRRLAHAERLRGVLASLGRDNGHLVIAGAGWIGLEVAAAARSYGAEVTVVEAAPTPLHGILGPELGGLFTDLHREHGVRFHFGARFTEIVGEGGMVLAVRTDDGEEHPAHDVLAAIGAAPRTALAEQAGLDLADPETGGGVAVDAALRTSDPYIYAAGDVAAADHPLLDTRLRVEHWANALNGGPAAARAMLGQDISYDRIPYFFSDQYDVGMEYSGYAPPGSYAQVVCRGDVAKREFIAFWLAADGRLLAGMNVNVWDVAESIQQLIRSGAPLEPGALADPQVPLAALLP

SEQ ID NO: 28655 - protein, 437 aa, Streptomyces tubercidicus
MPAARRRLRPPHRSGDLPARPPGRAHPPRDRPGRHDLRPSRRGGGHRRMKSVAVIGASLAGLYAARSLRSQGFDGRLVIVGDECHGPYDRPPLSKDFLTGATDPGRLALADAEEIAELDAEWLLGTRATGLDTGGRTVLLDGGRSLTTDGVVLATGAAPRLLPGPVPAGVHTLRTLDDAQALRADLAPAPVRVVVIGGGFIGAEVASSCAALGHDVTVVEAAPLPLVPQLGHAMAEICAALHADHGVTLLTGTGVARLRSEGDGRRVTGVELTDGRLLPADVVVVGIGVRPRTAWLTDSGLPLDDGVLCDAGCVTPLPAVVAVGDVARVDGARAEHWTSATEQAAVAARNLLAGSTVATHRSLPYFWSDQYGVRIQFAGHRLPTDTPRVLEGSPDDRSFLACYERDGRTTAVLALNRPRPFMRLRRELARTALSATT

SEQ ID NO: 28656 - protein, 410 aa, Streptomyces tubercidicus
MAQNTAFIIAGAGLAGAKAAETLRAEGFGGPVLLLGDERERPYERPPLSKGYLLGTSEREKAYVHPPQWYAEHDVDLRLGNAVTALDPAGHEVTLADGSRLGYAKLLLATGSTPRRLPVPGADLDGVHTLRYLADSDRLKDLFRSASRIVVIGGGWIGLETTAAARAAGVEVTVLESAPLPLLGVLGREVAQVFADLHTEHGVALRCDTQVTEITGTNGAVDGVRLADGTRIAADAVIVGVGITPNSETAAAAGLKVDNGVVVDERLCSSHPDIYAAGDVANAYHPLLGKHLRVEHWANALHQPKTAARAMLGGEAGYDRLPYFFTDQYDLGMEYTGHVEPGGYDRVVFRGDTGAREFIAFWLSGGRVLAGMNVNVWDVTDPIRALVASGRAVDPERLADADVPLADLVP

SEQ ID NO: 28657 - protein, 126 aa, Oryza sativa (japonica cultivar-group)
MAFWQARDFLFCGVCGTLLKFDSVRSASCPLCGFKRKAKDIEGKETRYTVTAEDIRRELKLDPYVILETTLKEEDVIVERATVNKECEKCKNPELQYYTKQLRSADEGQTVFYKCANCRHEFNENQ

SEQ ID NO: 28658 - protein, 222 aa, Dehalococcoides ethenogenes 195
MKNPPVCCVITRLPEAESLKKSEGAAFYELRLDLLGESWREAAAMLDKPFMATCRRSAEGGSFSGSEEERIGLLEKAAAAGAFMLDIEYSTPHLGEVLKRLRTQSKCLVSHHNFADTPSAGDLKTLVKDMLNYPADIYKVITTATSINDNIKLLNLIKEIPDKKIVAFAMGNLGILSRILCPLAGSPFTYASLNDSNQSASGQMTLAQMIEIYRSVNYENHT

SEQ ID NO: 28659 - protein, 286 aa, Dehalococcoides ethenogenes 195
MKTIPDALFGLIGFPVSHSVSPAMQNAAFKHCKLDYLYLTIAAKPEELQNVIASMGPLNIRGLNVTIPHKIEVIKYIDSLDPAAEKIGAVNTIVNENGRLKGYNTDFGGFVRLLEHNRIAPAKQRFTLLGAGGSAHAIALAVCNLGGHLTVLARQEEKAKDLAGKMCLRLSGKTQGLELNDTNLEEALADTDVIVNCTPVGMGNLAGQSLVPPRLLRPDLTVIDAIYNPCKTRLLEDAEKRGARIINGLEMLVWQGAMSFEIWTNQKAPFRLMMKEAELALDENKK

SEQ ID NO: 28660 - protein, 325 aa, Aspergillus oryzae
MAAPTAPPILDFSPFYGGDNEAKAKLVEEVRKCCHYNGFFQITGHQRTLADLVDLNTFNRGYELLRSQMLEAGTGPELKEGLYIGEEIPEDHPYYVQKKLNSGPNQWPQTVPDKAEFQKTTMEYYHAVFELAKDVLSVVALTLGVDSTFFEPLTDGAVATMRYLHYPAQPKDQDEKLNRGIGAHTDFGCVTLLLQDDVDGLQVLDVPTGQWLDVKPVEGAYVVNLGDLFMRMANDKYKSNIHRVINKSGRERYSIPFFFSGNPDYLCECLPNCREPGESAKYPPITVQDRVTEAYKESYGRAEKYKKELEMQSLASTPAVASVGG

SEQ ID NO: 28661 - protein, 532 aa, Arabidopsis thaliana
MDHVSSLPDEVLYHILSFLTTKEAALTSILSKRWRNLFTFVPNLDIDDSVFLHPQEGKEDRYEIQKSFMKFVDRVLALQGNSPIKKLSLKLRTGFDSHRVDGWISNALARGVTELDLLIILYTADYYLLSSKYFRNLVTLKLNSVRVDWLAAGDIFLPMLKTLVLHSVRLCVDKYFFSALPALEELVLVSVNWGGKDVNVSNASLKILTVNYNICLGTFSVDTPSLVYFCFTEYVAIDYPVVIMQNLFEARISLLVTQDQIERARAPNIDWVEDDVVLRLVNMEKLIKGIRNVQYMYLSPNTLEVLSLCCESMPVFNNLKSLTLKSHKSRGWQAMPVLLRNCPHLETLVLEGILHHVTDKCGYACDCVSREEKGCSLTSCPVKVLEIKGFRGTIKEMHMIKHFVNYFPCLMETNIYIEESGPPKLRVPQVCEFIAEMMEHYGKSSSFNVQLLVGAKWTKVQQKPNLKLTTAKLNMFKKPNEVYYGLSRFCSLELDVLCKWKPPGFIYENKPSYLENRLQLYNVTQALSSIVL

SEQ ID NO: 28662 - protein, 462 aa, Thermoplasma volcanium GSS1
MSYFKNKNINDECSYATMPEDVVEKTLKKLDQDKVEFLQMQFTDIVGNVKSLTVPKNRFENALTEGVVFDGSSVAGYAQIEESDMRAIPNLDSYTLLPDEFGKSRVVRFVCNVYSPDGSRFPGDPRYVLEKLLEKVHKEGNEFFVGPEFEFFLFKRDANGNPTTEPSDYGGYFDNTPLDSASDIRQQIVRELYELGYQPEAAHHEVAYGQQEIDLRYAPALKMADRIVMLKSIIKNVAERNGLYASFMPKPINGVNGSGMHIHQSIMSFDEKVNRFYDKNAKYGLSDYAMHYLGGILSHINEGSAILASTVNSYKRLIPGYEAPVYISWANKNRSALIRIPAGEGTRKRMELRCPDPAGNPYLQFAVILGMGLDGIEKKIDPPEPIEKDIFHMTKEERLQEGITSMPESLGEALHHLRNSKLMRDILGDHVYENFLTVKQREWDQFRSYVGEWEIKKYLPTL

SEQ ID NO: 28663 - protein, 536 aa, Oryza sativa (japonica cultivar-group)
MAFSSILQLTLCFLCFSVFYYYHIKSKRKNPAIPVCWPLVGMLPDLLVNRHQLHDWITSFLTASQLNFRFIGPTMSSNMRFFFTCDSANVRHIFTSNFANYPKGPDFAEIFDDTLGDGIFNVDGDSWRRQRAKTQLLMYNHRFQSFVSRCSSDKVENALLPLLSHFAGTGERCNLQDVFMRLTFDMSTMLASGEDPGCLAISLPMPKVPFVRAVDYTTRVLLVRHIIPLSLWKLARRLGVGFERKMAEALRTINQFIYETIVKRRAKKANEGIEDSEDLLSSYLKDDDENADTFLRDTTMTLIAAGRDTIGSALSWFFYLLTKNPHVASKILEELDSVERATTTPDGMVTFDPDELKSLVYLHAAVCESLRLYPPVPLDHKGVVAADVMPSGHKVRPGDKIVVSIYAMGRTESVWGSDCMEFRPERWISDDGKLRYVPSYKFTPFITGPRTCLGKDMALVQLKVVAATVVKNFEIEAVPGHIVEPKLSMVLHMKNGLMVRVKRSLLGPSFSSCLDLIGCTRALYLYLQKLFVRCNG

SEQ ID NO: 28664 - protein, 353 aa, Ashbya gossypii ATCC 10895
MSSSMQQAVVLREKGAIVYEHRPVPVIEDPHYVKVKIEKTGICGSDVHYYLHGSIGPFVVRSPMVLGHESSGTVVEVGSDVTRVRIGDRVAIEPGVPSRYSEETKSGHYNLCREMRFAATPPYDGTLVKYYISPEDFLVKLPDSVSLEEGALCEPLAVAVHANRLAGTQFPSRVVVFGAGPVGLLTASVAKAFGATTVAIVDISKHKLCVAPALGVTHPVDSSDCSSPEALANKLRAELRSDVDIAFDCSGAEICIAAAVLICRPGGTHVQVGSSRDYVSFPLAEATVKQLRILGSFRYAAGDYATAVELLASKRVDAARLVTHRFPFDRAVEAYKFNATADEHIIKTIIEGP

SEQ ID NO: 28665 - protein, 475 aa, Mycoplasma gallisepticum R
MAKTNSTSKNNKLEIKSVFAYQAFDSRGFPTVACEVVLNDGSKGLSMVSSGASTGEKEALELRDGGTKYHGKGVTKAVNNINKKIGPKILGVDATLQTQIDEFMIELDGTKTKAKLGANAILAVSMAVCRAAAKSLNLPLYQYIAKKVAKVKGADFILPVPMLNVINGGAHADNTIDFQEFMIMPVGAKTMAKALQMASEVFHSLQKLLKAKKFNTNKGDEGGFAPNLKSAEEALDLMSQAVVDAGYALGKDVAFALDCAASEFYSKEKQAYVFKKAVKAGILSEEKGTKTTEQLISYLEDLTKKYPIVSIEDGLDENDWKGMESLTKKIGKKVQIVGDDTYCTNPELTSKGVSLSATNSVLIKLNQIGTLTETIQTINIAKKANWTAVVSHRSGETEDAFIADLAVALSTGQIKTGSMSRSERIAKYNRLLAIEMQLGNKAKYLGSKTFYNLSTPAATPKKSPAKKTTKAKSKK

SEQ ID NO: 28666 - protein, 380 aa, Zea mays
  misc_feature (185)..(185): Xaa can be any naturally occurring amino acid
  misc_feature (187)..(187): Xaa can be any naturally occurring amino acid
  unsure (1)..(380): unsure at all Xaa locations
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGXFXRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 28667 - protein, 313 aa, Ashbya gossypii ATCC 10895
MKIKVTVSSFGEQVLEVGADASLNELLTLVKEAYGGEVPLKSMRFGYPPQQVELCGHDGKEELGELGISGGERIVFACESGGLDARESRIPPNLDGALSPPNKITMQPGMTLEIHEVPDDNSCLFHAISYALYKDTATSQQLREVVAREVEADPVAYSDSIVGRPNREYAAWIRKRDSWGGAIEIAILSKYLATAMFVLDIDAGRYEKFNEDKYNEFIVLVFSGIHYDTLQLSIAGAAVPQTVFDSSEPDSDVLLVRASEVASKMKKAGLSFNTYRERIRCNQCGTVLLGDRKVSQHAKQNRHIEFGQVSAYQ

SEQ ID NO: 28668 - protein, 369 aa, Yarrowia lipolytica CLIB122
MLNLRTALRAVRPVTLTRSYATSVASFTGQKNSNGKYTVSLIEGDGIGTEISKAVKDIYHAAKVPIDWEVVDVTPTLVNGKTTIPDSAIESINRNKVALKGPLATPIGKGHVSMNLTLRRTFNLFANVRPCKSVVGYKTPYENVDTLLIRENTEGEYSGIEHTVVPGVVQSIKLITREASERVIRYAYEYALSRGMKKVLVVHKASIMKVSDGLFLEVARELAKEYPSIDLSVELIDNTCLRMVQDPALYRDVVMVMPNLYGDILSDLASGLIGGLGLTPSGNMGDEVSIFEAVHGSAPDIAGKGLANPTALLLSSVMMLRHMGLNDNATNIEQAVFGTIASGPENRTKDLKGTATTSHFAEQIIKRLK

SEQ ID NO: 28669 - protein, 386 aa, Candidatus Protochlamydia amoebophila UWE25
MSEVLFEITKESLETGLRGYPVGYCTTSSVDPVKGLFYAGHPVSEIDQWEPEQVIYLLYHGYVGKPEEVSRFSQDLLIRANCSTALIESIEKLPRNIHPMKLFSIALLLASGFEGKNDYHEDYLNLIAKVPEIAATVINHHAGWGKTKQSQPQLGYMENFTQMLNVPDANQQELARAFKFFNVLHYDHGGGNLSAFVGKAVASGLEDLYGSMSAAMCALAGPRHGKANQDCLTFVHQLVEELGEHSTEEELERLIRAHLDKGELIFGFGHAVLRVEDPRATLLYEVTNQYYASHALVKMAQLLRKVGSKVLQNNPKISDPYPNVDAISGILLTAAGFPCSEYYTVLFGLARVVGIGRQIVYERKEAREGKGTPIVRPKYFFKENKQ

SEQ ID NO: 28670 - protein, 418 aa, Oryza sativa (indica cultivar-group)
MAVDDADDDQLASMSTEDIVRATRLLDNETRVLKDELQRTNLEVESYKEKIKENQEKIKLNKQLPYLVGNIVEILEMNPEDEAEEDGANIDLDSQRKGKCVVLKTSTRQTIFLPVIGLVDPEKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 28671 - protein, 517 aa, Lactobacillus sakei subsp. sakei 23K
MAQKDMQDFDKIIVLDYGSQYNQLITRRIREFGIFSELLPNTTTAAEIKKIAPKGIIFSGGPMSVYDGGAFSVDPEIFELGIPILGICYGMQLISFKNGGNVEASTEREYGKAEITVTDKDSDLFKGLPEKQTVWMSHGDKVTAIPEGYVTVAESDNTPFTAIENRDKHIYGIQFHTEVQNTEFGNDILKNFAFGVCGAQDNWTMNDFIDMQIEKIREQVGDKKVLLGLSGGVDSSVVGVLLHRAIGDQLVSIFVDHGLLRKGEVEQVMESLGGKFGLNIIQVDAKERFMSKLAGVSDPEKKRKIIGNEFIQVFDEEATKLNGIDFLAQGTLYTDIIESGTSTATTIKSHHNVGGLPEDMQFSLIEPLNTLFKDEVRDLGEKLGMPYELVWRQPFPGPGLGIRVLGEVTEDKLKIVRDSDLILREEFALAGLDKTVWQYFTVLPGIRSVGVMGDGRTYDYTVGIRAVNSIDGMTADFSRIPWDILQKVSVRIVNEVDHVNRIVYDITSKPPSTVEWE

SEQ ID NO: 28672 - protein, 411 aa, Xylella fastidiosa Ann-1
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWAAAQGRLPEHRTIVTFRGSFHGRTLGAVTATAQPKYQEGYEPLPGGFRYVDFNHIEALEAAMVGGDVAAVMLEPIQGEGGVMPVVSGYLAQVRALCDRYGALLVLDEIQCGMGRTGALFAYWQEKVVPDIVTLAKGLGGGFPIGAMLAGPKVAEVMQFGAHGTTFGGNPMAAAVARVALRKLASVEIAANVQRQSVALRAGLEEISEAFGGVFTQVRGRGLMLGAVLAPLYAGQASAILEVAAEHGVLLLQAGPDVLRFVPALNVSDEELADGLVRLRAALGDYVSRFGG

SEQ ID NO: 28673 - protein, 114 aa, Medicago truncatula
MELDFDLDFEDYFPSMVASLGAEAFIGELCYGFHLLMDVNKGLITFESLKMNCFMLGMEVKDDELVYMLMEGDLDGDGALNPMEFCILMFRLSPCLMEGPKMCTNPQGVNPMLM

SEQ ID NO: 28674 - protein, 186 aa, Glycine max
LGPGRRIRTAPNQTGVNQQNDYLSVVSQGFGKLSLAAANVVQAGTKEFSAKVKEGGYDYKVNETVNVVSQKTSEIGQRTWGIMKGVMALASQKVEEFARDNPNWMSDNWQRNESDRNGFYQEFNRENNGRNSSTREGQHSSGGQTNTFHSSSWDDWGHNDSRKEETAKGSAPQSSGWKDNNITQAL

SEQ ID NO: 28675 - protein, 219 aa, Xylella fastidiosa Ann-1
MPPNAQHSPQTCDPKQMSSPLECAKYLLSAHTIHQLPSDDGSEVAFAGRSNAGKSSVLNTLTRQNALARVSKTPGRTQQLVYFTVTPQRYLVDLPGYGYAKVPKELQIHWQAFIDTYFHHRQSLRGLVVVMDIRHPLKEYDLQMLAYARQRGLPAQALLTKADKLGRGQQAQTLQKVRNELTKHFADHINIQTFSSKSRQGVEQLHTVIETWLGLARSG

SEQ ID NO: 28676 - protein, 332 aa, Triticum aestivum
  misc_feature (277)..(277): Xaa can be any naturally occurring amino acid
  unsure (1)..(332): unsure at all Xaa locations
MASAAVCSPKQQQQRQEEDGGVVKIGRVDDVQELQRACVDDVPERYVRDGDDRPGGANVCAHAEIPVIDAGELRRGGGDGDELEKLRQACEEWGFFQVVNHGIDGELLDEMERLSREFFMLPLEEKERYPMAPGGIQGYGHAFVFSEDQKLDWCNMLALGVSPAFIRQPMLWPTTPAAFTDTLERYSAEVRALCHRLLEHIAQTLGLAPGTFAGMFGDAVQAVRMTFYPPCPRPDLVLGLSAHSDGSAVTVLQQDAGRAGLQVLRDGAWVPVHPVPXALVVNLGDSLEVLTNGRYRTVEHRAVDQGRAGTAGPSGSSYAPALEVGARPNARS

SEQ ID NO: 28677 - protein, 112 aa, Synechococcus elongatus PCC 7942
MGRWLVLGLLVIGLSVVNPARAIAADLQVGARLFQSNCTTCHLNGGNVINGQKTLRQEALRRYGMDSVAAIQKQVTYGKNAMPAFGQRLSPEQIEAVATYVFDRAERGWTAL

SEQ ID NO: 28678 - protein, 333 aa, Thermoanaerobacter tengcongensis MB4
MKLKGGRIVTMEFSKEKLLWMYKKMVQIRQFELKTDELYKKNMIWGTYHLYVGEEAAAVGACAALEPTDYITSTHRGHGHTIAKGADLKRMMAELLGKETGHCKGRGGSMHIADIFTGHLGANGIVAGGIPIATGAALASKLRGDKRVTLCFFGDGAANTGAFNESLNMAAIWQLPVVYFCENNQYAMSAPVNKFTAVKNIADRAASYNMPGVIVDGNDVLEVYKAVKEAVDRARKGEGPTLIEAKTYRWFGHSKSDPRVYRTREEEEEWKKKDPIKRFAEKLLSEGVATEEELKKIDEEVAKEIEEAYQFAVESPEPKVEDLAKYVYAEEGE

SEQ ID NO: 28679 - protein, 326 aa, Thermoanaerobacter tengcongensis MB4
MAEKLYIEALAEAIKEEFERDPNVFMMGEDIGIYGGAFGVTKGMYPKYKDKLIETPISEASIVGAGVGAALVGMRPIVEIMFSDFMMDAMEWIVNQAAKLRYMTGGQLKVPLVIRSPMGSGTGAAAQHSQSLPAMFAHIPGLKVVMPATPYDVKGLFKAAVRDDNPVIFFEHKLLYWTKGEVPEGDYIVPIGKADVKREGKDITIIAGSITVIRSLEAAEKLKGEGIDVEVIDVRSLSPLDTETIVNSVIKTGKVLIVEDDNKSYGWGAEVLSRIVESDAFDYLDYPIQRLGGKDVPIPYNPKLERAAVPQVEDIIEAVKAIFGKE

SEQ ID NO: 28680 - protein, 369 aa, Arabidopsis thaliana
MTNHNALISDAKGSIGVAVRVPNQSLFSPGGGRYISIPRKKLVQKLEADPSQTRIHTWIEAMRASSPTRTRPGNISPLPESDEEDEYSSWMAQHPSALTMFEEIAEASKGKQIVMFLDYDGTLSPIVENPDRAYMSEEMREAVKGVARYFPTAIVTGRCRDKVRRFVKLPGLYYAGSHGMDIKGPSKRNKHNKNNKGVLFQAANEFLPMIDKVSKCLVEKMRDIEGANVENNKFCVSVHYRCVDQKDWGLVAEHVTSILSEYPKLRLTQGRKVLEIRPTIKWDKGKALEFLLESLGFANSNDVLPIYIGDDRTDEDAFKVLRNKGQGFGILVSKIPKETSATYSLQEPSEVGEFLQRLVEWKQMSLRGR

SEQ ID NO: 28681 - protein, 394 aa, Staphylococcus epidermidis RP62A
MKLSLNSSSKFLRAPSIRQFSNRIKAIDDCVNLTIGQPDFPMPDVVKNAYIKAIKNDKTSYSHNKGLFETREAISQYFKRKYNFLYSEEEIIVTNGASEALDTSLRSIIEPGDDILIPGPIYAGYIPLVETLGGNPVYIDTTQSDFKVTPELIESHLTHKTKAILLNYPTNPTGVILERSEVKNIVDTLVNKHIFIISDEIYAENTFKGQHTSFAEFPEIRDQLLLIGGLSKSHSATGIRIGFLLGPEYLIEKLTFMHAYNCICANVPAQIACTTALNEGINAPLYMNRDYIERRNYLKEKLESLGFELTAQPEGAFYIFPSIKRFTENDFEFCVDVLEKAHLAMVPGSSFTDIGKGYIRISYAYDMETLKKGMHRLENYLQQHYPEQMTTPTK

SEQ ID NO: 28682 - protein, 414 aa, Thermoanaerobacter tengcongensis MB4
MANVKLMPKLGMTMTAGKVVRWLKKEGEKVEAGEPLLEIETDKVTMEEEAGYTGTLLKILVREGEEVPINQPIAIIGGEGEDIEEILKTLKVSEGVEEEKKEEKIKVKIEEKPEEVKREEISKPRATPAARKIAREHGIDLSEVIGSGAHGRIHRKDVEEYIRKRTEIVPSQVTVEQKVEKKEEIPSYRVIPFTGMRKIIAEKMQKSINTAPHFYVTMEVKMREILKLRETLNSKLKEDEAKISLNTLLMKAAGIAIKDYPIFNSYVEEGQIILRNEINIGLAVALDEGLIVPVIREVDKKGLKEIAREEKALIQKAREGKLTPDEYTGGSFTISNLGMFDVVRFAAIINPPEVAILAVGKIREIPVVEEGQIEIEPIMEMTLSSDHRVIDGALAAKFLRRIKEILEDPLQFML

SEQ ID NO: 28683 - protein, 667 aa, Thermoanaerobacter tengcongensis MB4
MAKRIEQLAINAIRVLSIDAIEKAKSGHPGMPMGAAPMAYVLWTEFMNHNPLNSKWFNRDRFVLSAGHASMLLYALLHLSGYKVSMEDIKNFRQWGSKTPGHPEYGLTDGVEATTGPLGQGLGMAVGMAMAERFLANKYNRGSYNIIDHYTYVIASDGDLMEGISHEAGSLAGHLKLGKLIVLYDSNDVTLDGDRHLSFTESVADRFKAYGWQVLRVDDGNDLDAIRNAISEAKKNTEQPTLIEVKTVLGYGAPNKAGKSDAHGAPLGEEEARLAKEYYKWEYEPFFIPEEIYEHYRAKVLERGKKAEEEWNKLFEAYKKEYPELAKELEDAINGNLPEGWDKDMPSYDKGAYATRDVSGEMINALAKNIPYFIGGSADLASSNKTAIKGEQPFGPTSNYTGRNIWFGVREFGMATALNGMALHGGLKVYGGTFLVFSDYLRPALRLSALMGVPVTYVFTHDSIAVGEDGPTHQPVEHLAAFRAMPNVSVIRPADGNETRAAWKLAVQSKNKPTVLILTRQKLPILPTTKEKVEEGVAKGAYIVSDGEKEIPDILLLASGSEVSLAVEAQKKLKEEGIDARVISMPSWDRFEEQDKSYKDYILPPNVKKRLAIEAAAPLGWERYVGDEGKVLGVNTFGASAPGEKLMEEYGFTVDRIVKEAKELLRK

SEQ ID NO: 28684 - protein, 111 aa, Triticum aestivum
  misc_feature (104)..(104): Xaa can be any naturally occurring amino acid
  unsure (1)..(111): unsure at all Xaa locations
MEPASASLVSLRASTATSRSCFSCRQRATPKTRMLPAMASKSGAKLVASGCKTCRGKGAVECEGCKGTGRNKKNGNIFERWKCFDCQGFGMRKCPTCGKGGLTXPEQRGER

SEQ ID NO: 28685 - protein, 321 aa, Yarrowia lipolytica CLIB122
MGFTPRGGRGGGRGGFGGGDRGGRGGRGGFGGRGGGRGGFGGDRGGRGGARGGRGGARGGARGGARGGRGGARGGAKGGAKVIVEPHRHGGVFIARGKEDLLVTKNLTPGESVYGEKRVSVDVPATTPDGEATKVEYRVWNPFRSKLAAGILGGLDELFIGPGSKVLYLGAASGTSVSHVADVVGPTGTVYAVEFSHRSGRDLIGMAKKRPNVIPIIEDARHPQKYRMLVGMVDAVFADVAQPDQARIIALNAHLFLKDQGGVIISIKANCIDSTVEAETVFAREVQKLREERIKPLEQLTLEPYERDHCIVIGKYIRANK

SEQ ID NO: 28686 - protein, 529 aa, Nicotiana plumbaginifolia
MAGLYTSLRPQPPSSSSSSQQSFFSKVLLLLTILPLSLAVFAFVLQWRGGGVDDPISRWSPEESHKFPGMDSSPLSTVAHSSSHSSDCSLLAHSNTLSFPYYKDWKFKLHSDLKPKICITTSTSAGLEQILPWMFYHKVIGVTSFLLFVEGKAASPDVSKVLESIPGVKVIYRTRELEEQQAKSRIWNETWLSSFFYKPCNYELFVKQSLNMEMAIVMARDGGMDWIIHLDTDELLHPAGAREYSLRQLLLDVPSNVDMVIFPNYESSVERDDIKDPFTEVSMFKKNYDHLTKDTYFGMYKEATRGNPNYFLTYGNGKAAARIQDHLRPNGAHRWHNYMKTPKEIKLEEAAVLHYTYSKFSDLTSRRDRCGCKPTKEDVKRCFMLEFDRSAFIIASTATEDEMLNWYREHVVWTDKAVNLKLLRKGILTRIYAPMVIVQGLRESGVFSSIVSSAHKSLSKDKFLASIESSNSSKAAASETLPSRKIGRNQHSQATRRVLEESASHFEFHEEAVPPRPPPGIYEDVITEA

SEQ ID NO: 28687 - protein, 227 aa, Ashbya gossypii ATCC 10895
MTPATPPRSRSRRADQDEMATPRRAVTGGGLLTPGTVGCKGEAGVARPRTPEGEVRSPEQTPRRAGRRAGALDELGTTARVLFPAAREGGAPGRQGARRGDARPARRKAARQEPGTPSSRIVTFELAEAWHNQSGCGSSDDEGEEDVRPLRLENPFLARGVAGADERRERARQLEAADPSIGHAVTLVDKRGRPVHQRELTPEEQELFKPRMLFARELEDGRPGDGM

SEQ ID NO: 28688 - protein, 207 aa, Zea mays
  misc_feature (173)..(173): Xaa can be any naturally occurring amino acid
  misc_feature (182)..(182): Xaa can be any naturally occurring amino acid
  misc_feature (186)..(186): Xaa can be any naturally occurring amino acid
  unsure (1)..(207): unsure at all Xaa locations
MQAVIRSFVSGGNVVRSSLLQHLRVVNPAIQPSVLSTRYESTQPARMEEHGFESTTISDVMNAKGKSADGSWLWCTTDDTVYDAVKSMTQHNVGALVVVKPGEQQSLAGIITEKDYLRKIIVQGRSSKSTKVGDIMTEENKLITVTPETKVLVAMQLMTDNRIRHIPVIKDKXGMIGMVPLXDVVXRAVDEHREELQRLNAYIQGGY

SEQ ID NO: 28689 - protein, 503 aa, Oryza sativa (indica cultivar-group)
MALATSTLPFAPSNPSPSSRSAAAAFSPRGGVHFAAARSGLPLACAAPRHRGRPPPRRRRGGCLVVWASADYYATLGVPRSASNKDIKAAYRKLARQCSGFPFRVRTPLSLVLAVLTLTPSTLKIPMPSSVDEWRERAMLEQPTLVPVAATLYHPDVNKEPGATDKFKEISAAYEVLSDEKKRALYDQYGEAGVRSAVGGSAGAYTSNPFDLFETFFGASMGGFSGMDQGTFRTRRRSTAVQGEDIRYDVNLGFSEAIFGTEKDIILSHLETCDACAGSGSKIGSKMRICSTCGGRGQVMRTEQTPFGLFSQVSICPTCAGEGEVISEYCKKCAGEGRVRVRKEIKVKIPPGVSKGSTLRVRGEGDAGPKGGPPGDLFVCLDIEEPADIKRDGINLYSTVSVSYIEAILGTVKKVRTVDGNSELRIPPSGREKELLEELASLSNGGFARAPVKPKSIRQENETTVAQENSDQPDEGEGDWLKKLQDFAGSIANGAAKWLKDNL

SEQ ID NO: 28690 - protein, 272 aa, Synechococcus elongatus PCC 6301
MRKLIEGLRHFRTSYYPSHRDLFEQFAKGQHPRVLFITCSDSRIDPNLITQSGMGELFVIRNAGNLIPPFGAANGGEGASIEYAIAALNIEHVVVCGHSHCGAMKGLLKLNQLQEDMPLVYDWLQHAQATRRLVLDNYSGYETDDLVEFLVAENVLTQIENLKTYPIVRSRLFQGKLQIFGWIYEVESGEVLQISRTSSDDTGIDECPVRLPGSQEKAILGRCVVPLTEEVAVAPPEPEPVIAAVAAPPANYSSRGWLAPEQQQRIYRGNAS

SEQ ID NO: 28691 - protein, 113 aa, Dehalococcoides ethenogenes 195
MSCIFCQIVKGEIPAQIVYKDEDLVAFKDINPQSPVHILIIPRRHITNLTELDEADTELAGKMILLAGKLAREMDIAESGYRLVINSGREGGQVVNHLHLHLLGGRQLGGQLG

SEQ ID NO: 28692 - protein, 1061 aa, Yarrowia lipolytica CLIB122
MKVYVYENPRSLALVSEKYALVFRYATPTDDKNRPRCIVEFAPIEKIDFRKHRALSPLDCHGFLGLINISSDVFLCVITAKSLVASPRPGETINRVVGVEFHCLNRNTWDFVTLDLNGYPIDLHDQASSSGITEHPCTQLRKMLTNSSFYYSTDFDLTSSMQTRGTAQPASMRNPAGQVISTLESSDASFLWNSYMMTELVKFRDNLPDFERSELDKCGFLTTLIRGFAETVNTRIGNYDENPISCRLTIVSKQSCRMAGTRFLARGIDDDGFVANFVETETILYTERGQAQIVCAFLQVRGSVPFFWEQDSQLLSNKVQITRSIDAAQPAFERHMDYLCNKYGSIHVVNLLSREKSHENELTQRYHGHIKKLNEAGGSHSTDPASGSSRGGLVAVTDFDFHHEVSKQGYSAATRVLNRVIDAMEEYGFYSADSSSPNVTLQNGVFRTNCLDCLDRTNMIQQVISRQALQIFLDRNHLGCNPDFWSKHNILWADNGDQLSQIYAGTNALKTSYTRSGKMNLAGALADVTKSVGRLYINNFTDKTKQNTTDVLLGRLSDQEGILLYDPINDFVVKELERRKLEFSSTTNIKVFAGTFNLNGELSDADLAGWFFPPKSAKELSGGAGFDVHDDLPSIVLVGFQEIVQLTPGQILNADPGKKEFWEKRVEAVLNTRDEYVLLRSHQLVGTALLLFVRKAEVGFVKNIEGAIKKTGLGGMAGNKGGVAVSFSYANTRFCFITAHLAAGTSNIEERHHDFKTLNTGLRFSRGLTIKDHDCVIWLGDFNYRIDMDGDVVRQIVAKKEYGLLFEHDQLNRQMVLGETFPYYNEMEINFPPTYKFDNGTATYDTSEKFRTPSWTDRVLYKGTGLRGINYGCVSDLLFSDHRPVYAEFNAQILIVDQKRKAALGKELYDKRRSEMGGSNDLISLSDLNEVTLTHGLPPPSTDARKWWISGGQTAKVPIVPPAKGMILNPKKINPFEGDLPDFVDKPALPPRRKPIGSPPVKPMPKPKPSSLRSASAVSATAPQLPIPELSQTSLLDMPIGPIESQSSAGQSSSTEKSLLD

SEQ ID NO: 28693 - protein, 319 aa, Candidatus Protochlamydia amoebophila UWE25
MLKEILDKQHLYTNHYFETLDLIAIEKLVELLLETEKSIFFTGVGKSGLVAKKIALTMVSTGTKALYLSPTDAVHGDIGIVSQDDIFIMLSKSGESDELLNLVPPIRNKGGILVAVVCNPQSRLAAACHYVITLPFQEELCPFDMAPTMSTIFQGLFGDLVTAALMRRKNFSLNDYALNHPSGRIGKRMTLKVKDIMLTGEKVPICYPQDQLTNVLVELSNKRCGCILVVDRDHRLLGIFTDGDLRRMLQKVGGKVLESSMIEIMTPNPRSIESELLAYEAMKLMEADYCKRISVFPVLNLEQQVIGLLHIHDLIQTGL

SEQ ID NO: 28694 - protein, 402 aa, Bacillus cereus G9241
MHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYDGRPTGMNPVKDEVAKYTNKNRIEGSLADVVQGADVFIGVSAEGALTEEMVRTMNDDAIIFAMANPVPEIMPELAKAAGAAVVGTGRSDFANQVNNVLAFPGIFRGALDVHATQINEEMKMAAVQAIAELVAEDELNADYIIPAPFDARVAPQVAAYVAKAAMETGVARRQVDPNEVAEKTKQLALIGKE

SEQ ID NO: 28695 - protein, 455 aa, Xanthomonas axonopodis pv. citri str. 306
MDPSVLKALQQLDAAHHLHPFNDNAALAQKGTRILTRGEGVYVWDADGNQLLDAFGGLWCVNVGYGRKELAQAAARQMEQLAYYNSFFQCTTEPTIQLAAKLAELAPGDLNHAFFANSGSEANDTILRLVRHFWAVQGQPQKRIFIGRHDGYHGTTMAGASLGGMRGMHQQGGLPIADIHHVAPPYHFGDGGEMDPEEYGLLAARRLEDKILELGPDNVAAFIGEPIMGATGVYIPPRSYWPEIERICRRYDVLLVADEVICGFGRTGEWFGAEYFGFQPDVMTLAKGITSGYIPLAAAMFNDRVAGVLKTQGGELAHGGTYAGHPVCAAVALENLRLLQDEGIVETARTQVAPYLAQRWAALGEHRLVGEARIAGLVGALELVPDKQRRGAYFPRRGRVGAMCRDFALRRGLILRATYDAMLLSPPLIITPAQVDELFDKAWAALDDTAQALGR

SEQ ID NO: 28696 - protein, 461 aa, Xanthomonas axonopodis pv. citri str. 306
MSIRTRSRKTTSTQPESALRRWLKERSITEVECLVPDITGNARGKIIPADKFSHDYGTRLPEGIFATTVTGDFPDDYYALTSPSDSDMHLRPDASTVRMVPWAADPTAQVIHDCYTKDGQPHELAPRNVLRRVLDAYAQAELQPVVAPELEFFLVQKNTDPDFPLLPPAGRSGRPETARQSYSIDAVNEFDPILDLMYDYCDAMELDVDTLIHESGAAQLEVNFTHADPMSRADQVFLFKRTMREAALRHGVYATFLAKPMETEPGSAMHIHQSLLHAGTGKNVFSGKREGGFSDTFAHYLGGLQKYIPMAMGLLAPNVNSYRRLMFGEVSPSNVLWGFDNRTCGLRVPIDVPQNMRVESRFAGSDANPYLAMAATLACGLLGIGEKLEPTAPISSNGKEQGYDLPRSLGEALDELEGCQALQEMLGRRFVRAYISVKRKEYETFFRVISSWEREFLLLNV

SEQ ID NO: 28697 - protein, 114 aa, Medicago truncatula
MDLDFYMDFEDYFPSMVASLGAEGFIGELYNGFHLLMDANKGLITFESLKMNCFMLGLEVRDEELVYMLMEGDLDGDGALNQMEFCILMFRLSPCLMDGPKIYTTHQGVDPMLM

SEQ ID NO: 28698 - protein, 110 aa, Medicago truncatula
MELDFEDYFPSMISRLGAEGFIGELCNGFRLLMDVNKGLITFESLKMNCFMLGLEVRDEELVYMLMEGDLDGDGALNQMEFCILMFRLSPCLMDGPKLCTTRQGVDPMLL

SEQ ID NO: 28699 - protein, 497 aa, Streptomyces nodosus
MTPQPPPPKADNGQAGRTGPTSPAEHGSGLQAGLKNRHLSMIAIGGVIGAGLFVGSSSGIATAGPGILLSYALVGTLVVLVMRMLGEMSAANPTSGSFSAHADRALGSWAGFSIGWLYWFFWVVVLAVEATAGAAILSSWVPAVPQWGWALIVMIVLTATNLISVGSYGEFEFWFAGIKVVAISIFIVIGLLAVFGVLPGVHADKAGLGNLTDHGGFLPHGLSAIFTGVLLVVFSFMGSEIATLAAGESEDPQRAVTKATNSIIWRIGVFYLGSVFVVVTLLPWNDKAIAEKGSYVAALDSLGIAHAGEIMKFIVLTSVLSCLNSGLYTASRMAFSLGERGDAPKAFARTNSRGVPMAAILSSVVFGFVAVFFNYRFPDSVFLFLVNSSGAVALFVWLVICFSQLRLRRIIQSEAPEKLIVKMWLYPYLTWAAAFLIILVFGYMLTDTEHDGRETVLLSMLVAVIVLAVAFIKQRVEGGRAKATEPAAAEAEKVSAG

SEQ ID NO: 28700 - protein, 262 aa, Oryza sativa
  misc_feature (23)..(23): Xaa can be any naturally occurring amino acid
  misc_feature (36)..(36): Xaa can be any naturally occurring amino acid
  misc_feature (49)..(49): Xaa can be any naturally occurring amino acid
  misc_feature (52)..(52): Xaa can be any naturally occurring amino acid
  misc_feature (92)..(92): Xaa can be any naturally occurring amino acid
  misc_feature (156)..(156): Xaa can be any naturally occurring amino acid
  unsure (1)..(262): unsure at all Xaa locations
ALCWSGNRPLWPGSGDEVSRRSXERRGGAIPFLQAXIDVARRRSDLFRXPSXAVSRVTSMASAARAVVEAEERKDSMEVDKKEERHVWYRRXAIAAGGLDLEKYSWIQQLPEVTITVPVPQGTKSRFVVCDIKKNHLKVGLKGQPPIIDGELFQPXVKVDDRFWSIEDGKSLSILLTKPNPMEWWKSVVKGDPEVDTQKVEPENSKLADLDPETRQTVEKMMFDQRQKQMGLPTSDEMQKQDMLKKFMAQHPEMDFSNAKIA

SEQ ID NO: 28701 - protein, 306 aa, Thermoanaerobacter tengcongensis MB4
MRKIVVVGSINMDIVIRVPRIPVVGETVIAYDLKNYGGGKGANQAVSIARLGGNVSMIGRVGNDEYGQKLYRDLKSNGVGVEGIEFDSETPTGTAYINVSEKGENNIVVYQGANKRLNMTQIKRYEHFFDEAEICLLQLEIPIETVKFVVDLCYSRGIKVILNPAPAYELPDTVLEKVYILTPNETELAFLSKSKIETIEDIRKASKYLLDKGVQNVITTIGEKGSYFINKNTEKLFDAIKVTAVDTTAAGDSFTGALAFALSKGEKIEDAIRFATFVAALTVTKEGAQTSLPYKEEVEKFIKERS

SEQ ID NO: 28702 - protein, 433 aa, Prochlorococcus marinus str. NATL2A
MADSLELVIDTIMAREVLDSRGNPTVEAEVLLEGGAIGRSIVPSGASTGAHEAHELRDGGKRYLGKGVLQAVNHIEENIAPALCGLSSLDQATVDSVMKQLDDTDNKSNLGANSILAVSMATARAAANGLGLPLYRYLGGPMSSLLPVPLMNVINGGEHAANNLDFQEFMLVPHGAESFREALRMGAEVFHTLKDLLSQKGLSTAVGDEGGFAPNLESNKAAGDLLMQAIEQAGFKPGEQVSLALDVASTEFYAEGQYCYGGNSYSSEQMVEELAGLVNAFPIVSIEDGLAEDDWDGWRLLTKKLGKNVQLVGDDLFVTNTLRLQRGIDENIANSILIKVNQIGSLTETLEAIELASRSSYTTVISHRSGETEDTTIADLSVATKSGQIKTGSLSRSERVAKYNQLLRIEDELGSQATYAGLVGLGPRGSLKG

SEQ ID NO: 28703 - protein, 726 aa, Zea mays
  misc_feature (58)..(58): Xaa can be any naturally occurring amino acid
  unsure (1)..(726): unsure at all Xaa locations
GSGPQAGLSRYTQGYLQGVRHTDGLVALMSLFVAAAVPTVTGGAADYVATGPLVVTSXVLHFLRGLVMLWAPSVYILLLARLIDGFGIGLAVTLVPLYISETAPTDIRGLLNTLPQFSGSGGMFLSYCMVFGMSLMPKPDWRLMLGVLSIPSLIYFGLTVFYLPESPRWLVSKGRMAEAKRVLQRLRGREDVSGEMALLVEGLGVGKDTRIEEYIIGPDDELADEGLAPDPEKIKLYGPEEGLSWVARPVRGQSALGSALGLISRHGSMAASQGKPLVDPMVTLFGSVHEKMPEIMGSMRSTLFPNFGSMFSVADQQQVKADWDAESQREGEDYASDHGGDDIEDNLQSPLISRQATSVEGKEIAAPHGSILGAVGRSSSLQGGEAVSSMGIGGGWQLAWKWTEREGEDGQKEGGFQRIYLHEEGVQGNRGSILSLPGGDVPPGGEFIQAAALVSQPALYSKELLEQRAAGPAMMHPSEAVTKGPRWADLFEPGVKHALFVGIGIQILQQFAGINGVLYYTPQILEQAGVGVLLSNLGLNASSASILISALTTLLMLPSIGIAMRLMDMSGRRFLLLATIPVLIVALLVLVVSNIVDVGDVAHAALSTASVIVYFCFFVMGFGPVPNILCAEIFPTTVRGVCIAICALAFWVGDIIVTYTLPVMLNVVGLAGVFGVYAVVCVLALAFVFVKVPETKGMPLEVITEFFSVGAKQAKEEEEEEEAREG

SEQ ID NO: 28704 - protein, 227 aa, Brassica napus
CLLNKLIRFIFSLFINFFFKKACNEAMFPCRSPPNWWTEELCILNIDFFSDVLASMKQRGLKPSSLASAIITYTERSLRDLVRDHSGRGVKFSDPENNDSEERSQQRDLVESIVSLLPSDKGLFPINFLCSLLRCAVFLEASLASKNELEKRISVVLEHVTVDDLLIPSFTYDGERLLDLDSVRRIISTFVEKEKNVGVFNGGDFNKGLFSASLQRVARTVDSYLAE

SEQ ID NO: 28705 - protein, 2259 aa, Oryza sativa
MAVAAMELPAVRAYDALGINETSVKSMPFENLATLMQSPATLQATKAVLDRFEKLLPLLSSPVINIDHLLKHLGSPKKKKTPPPAAAASASRYSLRVVLCSYMILAHPGAVLSGQGEKEKLLMDSAGSFVKEFELLVKTVLEKQSTDAAAGQKMFSAQLADFDRAWCAYLYCFVVWKLKDAKSLEDDLVRAACKLELSMMQTCKLSSDGQSHNGLSHDMKAIQKQVADDQKLLREKVHQLSGDAGIERMNSALSDTRSKFFEAKENGNPLAASVANPTDNEQMLNEMLHEDDVSFGGNSDNVSSAEKEFQAKVKSTMEKAFWDLVTDSMKGDKPDYTQLINLVKEVRDSLHELASKELKEEILENIDLEILSQVLESGSQDTRYLGQIMHYSLDMIRKLSAPAKEDDMKRSHEKLLNELAASSEVNDNGISSFVIAVIKGLRFTLEEIKQLQSEVSKARIQLMQPIIKGSAGVEYLQKAFADRYGPPANASASLPITKQWVSATKSIVEQEWSSHLESLQALPADHAQRVVVPALRAGHGAPMAQASSSAASGSGLPECKGEKIDKLTRVGLLQLISNVEGLNMQSTPETFQINLPRLRAVQDQFQKVIVIATSILVLHQVLVSKVAAPELQNAISELYDALVKLLDSNPDASTEEIVEAMASSLATVGSLSLPEKQAQATAELATKMLLKSLQAGDVVFGKVSRTVYCAFRGVVLGGGGVKGKKLAEAPLRRLAAAKLADRVVKAGEMLINMAVISEKDAELAAAEERRRATAQTAAAAARAARLAAAELAAARAEAEAEAAEDAARAAEVEVETLRSSINGSIAGDITADRELEELARGRARERAERWAAAHLHGGGGGPRDRAPADGNPDGRGRAGGSPEPARGPRRRHGSLSPDRRHGHHGVQTVVRDFGPGGGWPTLTKTNYIEWAAVMRVRLQVRHMWEAVRYGDVDYDEDRRALDALIAAVPPEMQFSLSQKRTAKEAWDAIAAARIGSDRARKSTLQALRKEWENLAFKPGEDVDDFALRLNTLLQKMVQYGDDTYDEERAVEKLFRCVPEKYRQIARSIESLLDLSTMSIEEALGRLKVVDGDEPRPLSGPITIGGKLHLTREQWEASQGDRRKGESSSPTGGHKPRKARGGVQLRWARRRAEGGARRGAQGVATGNHKPARDDTCRNCGKLGHWAKDCRQPRRGQAHVARVEEEEPALLLAHASIELPPAAPAAAAFLHLDEPKVLVSLCDGSSNDKADGWYLDTGATHHMTGRREFFTEFDSSVRGTVKFGDASGVEIKGVGSVTFTAKSGEHRLLTGVYYIPALRNSIISVGQLDENGSRVAQVAHPVCLAARRDDEAWQWHERFGHLHFEALKQLSAKEMVRGMPCLDHVEQLCDVCVVTKQRRLPFPQQTSFRAKERLGLVHGDLCGPVTPATPGGRRYFLLLVDDLSRYMWVMVLGSKGEAADAIRHAQAAAEAECGRKLRVLRTDNGGEFTAAEFASYCADEGIQRHYTAPYSPQQNGVVERRNQTVVGMARALLKQRGMPAIFWGEAVVTAAYILNRSPTKALDGRTPYEAWHGRKPAVSHLRVFGCLAFAKELGHIGKLDDRSTPGVFIGYAEGSKAYRILDPETQRVRITRDVVFDEGRGQLFFTERVYPSPRASTDSNTNTPSGHDFDYDELFVDTTPAARVERSPVEFVTPLSHDGERIDAYHDGEQLRYRTMEDLLGDQPVPGLVPRNLEAQLHLACDDGEPRSFAEAEKHAAWRAAMQSEMDAVQENRTWELADLPRGHRAITLKWVFKLKRDEAGAIVKHKARLVARGFVQQEGIDYDDAFAPVARMESVRLLLALAAQEGWGVHHMDVKSAFLNGDLKEEVYVHQPPGFVIPGKEGKVLRLHKALYGLRQAPRAWNAKLDSTLKGMGFEQSPHEAAIYRRGNGGNALLVGVYVDDLVITGTKDAEVAAFKEEMKATFQMSDLGPLSFYLGIEVHQDNSGITLRQTAYAKRVVELAGLTDCNPALTPMEERLKLSRDSTAEEVDATQYRRLVGSLRYLTHTRPDLAFSVGYVSRFMQRPTTEHQQAVKRIIRYVAGTLDHGLYYPRCPGKAHFVGYSDSDHAGDIDTSKSTSGILFFLDECLVSWQSIKQQVVALSSCEAEYMAASAASTQALWLARLLSDLLGRDTGAVELRVDSKSALALAKNPVFHERSKHIRVRYHFIRSYLEEGSIKASYINTKDQLADLLTKPLGRIKFLELCSRIGMAQLSHKTAHKT

SEQ ID NO: 28706 - protein, 356 aa, Methanosarcina acetivorans C2A
MNNMKGFAMLEIGKVGWIDAERPSAGPYDAIVRPLAVAPCTSDVHTVWEGALGERKNMILGHEAVGVIDEIGSEVKDFKPDDKVIIPAVTPDWRSMEAQDEIPMHSNGMLGGWKFSNFKNGVFAEYFHVNDADMNLALLPKGMPLEQAVMLSDMATTGIQGAEMANIKTGSTVAVIGIGPVGLMAVAGASILGAGRLIAVGSRKVTVDLALEYGASEVVDYRKGGLVGQILEKTNGKGVDSVIIAGGNENTISDAVKIVKPGGTVSNVNYYGTGDTLPIPRIEWGSGMAHKDIRGGLTTGGRLRMERMAALCTYGRIKPEKMATHVFEGFDKIEEALMLMKDKPRDLIKPVVLLEE

SEQ ID NO: 28707 - protein, 165 aa, Triticum aestivum
  misc_feature (54)..(54): Xaa can be any naturally occurring amino acid
  unsure (1)..(165): unsure at all Xaa locations
KDDESLRRWKEQLLGSVDLNSVGETLEPDVKIMSLSIQSPGRPDIFLPLPVEPXSGKGVWFTLKEGSPYKLKFTFSVSNNIVSGLRYTNTVWKTGIKVDSAKEMLGTFSPQPEPYAYVTPEETTPSGMFARGSYSAKTKFLDDDRKCYLQINYTFDIRREWPSSG

SEQ ID NO: 28708 - protein, 99 aa, Rumex obtusifolius
MATIGGIKQVEGSANSLEVESLAKFAVEDHNKKQNAMLEFSKVVNTKEQVVAGTMYYITLEATDGGKKKVYEAKVWVKPWMNFKQVQEFKLLGDQGSTS

SEQ ID NO: 28709 - protein, 402 aa, Aspergillus oryzae
MIMNSSHYPVALLAGAPARTTVNRYIFTTDGDHWAQSRAMIRPNFVKDQVAHLDIFEELMADLLALIPTDGTTVDLQDLFFCYTIDSATEFLFGHSVQSLKKRLSGVKLDDNDFASSFNYAQDAIAKNTRLGPLRHFFRDTKAEHCNQVCHELVEQFVEKALKYRANYDEEKAATDDDKKQRYLFLQGLAQQTGDPKRIRDELMNVLLAGRDTTASLLSNMFFMLAKNPHIWNKLREEVASLEGRAPTYEQLRNLTYLKYCMNESLRLHPVVPSNARFAINDTVLPVGGGPDGNAPVFVPKGSIVAYSVYSMHRREDFYGPDANEYRPERWADLRPSWEYLPFNGGPRICVGQQYALTEAGYVTVRLAQQFSVLESRDPGPWEENLTLTLCSRNGTKVALRH

SEQ ID NO: 28710 - protein, 890 aa, Ashbya gossypii ATCC 10895
MSKISEGVGDPPSYGSRSPSLSSHDKEKEKYNAGAEEQVTAEVLTDEQLVYLISRMGYDHPRDLSDVPASVRYLESKLAELDIEKCLRIIDLSFEIHNEDFNLKTDDWNDLVRFSKRDFDPEDPQHVFELKTVAGIFEYYSPYVEVRAVASPVDDPTIPVETFRAYFLATFWVVVGSALTMFFSERQPSIALSISAVQMLVYPCGLLWARLMPCWGFNVYGRRIALNIDSPWTEKEQMFVTLLYGITTGSFYANYNILTQHIHYRSPMPYAYQLLLSIPLQFLGFGLAGIMRKYVVYPATAMWPSIMTTIALNKAMMSDEHSGGFGRKKMFYLTFAIIFVYNWFPTYLFEALSTFNWITWIKPDNFNLATVTGGINGVGLNPLSTLDWTNIGVGGFYLPFRVTLTMYMGGLLAALITLGVYYMNYSECQFLPIFTQSLYNNKAKVYQVEEILTEDRLLDEQKFQKYGFPYYTAGNMVAYGCFMCVYTALVVSSILQQGAFYMRVYKAWILDLWSLRTRSGLREAFSNEKHVLDEFHDPHCRMMRKYKEVPEWWYMSIFVVSIVIGVIVVTTFKTNTPVWGLFLAVGLNFILLLPITLLQATRGVTIGLNLLLQMISGLALPGNPYALMFIKAFGYNIDGQTDNYLSNMKMAHYAKIPPIPLFRGQLLMVLIQVFVNLGVINWQLHNVENYCDPKQRFKFTCPGVRTYFNASVMWGAIGPRRIFEHVYPIMKWCWLIGACVGLFFGIWKRLSIMYDKIPYPRRFSPVIFIIGMLSFGPPYNLQYSTSGLYVGFISMFYLKRYHLRIWERYNYVIAAAITCGVVFSAILMFFSVQWKDIELNWWGNSISYAGLDYARVPLLNVTETREDTLDQSLATFRNSLSANFYKLSII

SEQ ID NO: 28711 - protein, 457 aa, Arabidopsis thaliana
MDRISNLPDEIICHIGSFLSAREAAFTTVLSKRWHNLFTIVPDLHFDSSVKDGESLTDFVDRVMALPASSRVNKLSLKWWFDEDTDSAQFDEDTEPEDTEPAQFDQINRSLRVVLKRGVADFYLWVHGKQGYTLPFEVFTCETVTKLSLGSGFAIDFLPENALLPALKTLSLYHVRFYEFGRCAFKTLLASSPVLEELTVCGVNWELWKWSRTVSSSSLKRLTIMRKQWDAFDDSDFKSISFDTPSLAYLYYSDYVPKEYLSVNLDSLVETKLYLCPEENYMWGKGDEKRFNPINLLHGLKNVETLNLYTIMTAEMFYVFREALPVFQKLSHLSVNLSNFCWSSMPMLIKKAPNLKTLNIDGPLHYESYYRCAGDIFCECVSEYSFLVSCPLEVLKITEYYGSFRELMQMKHFLEKLSCLELVEVHSQATGERKLKLIADLERLPRASSKCKFEVVS

SEQ ID NO: 28712 - protein, 371 aa, Pseudomonas putida KT2440
MKAFADKQETPFVLIDTQMISQAYDDLRAGFEFAKVYYAVKANPAVEIIDLLKEKGSSFDIASIYELDKVMGRGVSADRISYGNTIKKSKDIRYFYEKGVRLYATDSEADLRNIAKAAPGSKVYVRILTEGSTTADWPLSRKFGCQTDMAMDLLILARDLGLVPYGISFHVGSQQRDISVWDAAIAKVKVIFERLKEEDGIELKLINMGGGFPANYITRTNSLETYAEEIIRFLKEDFGDELPEIILEPGRSLIANAGILVSEVVLVARKSRTAVERWIYTDVGKFSGLIETMDEAIKFPIWTEKKGEAEEVVIAGPTCDSADIMYENYKYGLPLNLAIGDRLYWLSTGAYTTSYSAVEFNGFPPLKAYYL

SEQ ID NO: 28713 - protein, 469 aa, Pseudomonas syringae pv. syringae B728a
MSETTSPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPDIPGWVSAAAFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDTAAHILNFVVLTAALSVYNSGTYCNSRMLVGMAEQGDAPRALAQVDKRGVPVKAIFASAAVTLVAVLLNYFVPQQALELLMSLVVATLVINWAMISYSHLKFRQHMNRTAQVPLFKALWYPYGNYVCLAFVVFILGIMLMIPGIQISVYAIPVWLAVMWVCYRAKNRRSVVVPAESGK

SEQ ID NO: 28714 - protein, 146 aa, Prochlorococcus marinus str. MIT 9303
MPCREPLRQRASICNQTVHGFHAPAVPSSDCDSMAGDTIFGQMLRGEIPCDEVYRDERCLAFRDIQPQAPVHVLVIPRKPLESLRAADSTDSELLGHLLLVAARVAKQEGLDDFRTVINSGLEAGQTVFHLHVHVIGGRPLAWPPG

SEQ ID NO: 28715 - protein, 482 aa, Pisum sativum
MVVEKNASKNHHHQTFDVSIDQQLDSKFFDDDGRVKRTGTSWTASAHVITAVIGSGVLSLAWAIAQLGWIAGPVVMILFAWVTYYTSVLLAECYRNGDPVNGKRNYTYMEVVHSNLGGLQVQFCGFIQYLNLIGVAIGYTVASAISMMAIERSNCYHRSGGKDPCHMNSNAYMIAFGAVQIIVSQIPDFDQLWWLSIVAAVMSFTYSTIGLGLGIGKVMENKKFAGTITGVNDVTKAQKTWGSLQALGDIAFAYSFSMILIEIQDTVKAPPPSESKTMKKATLISVIVTTFFYMLCGCLGYAAFGNSSPGNLLTGFGFYNPFWLLDIANAAIVIHLIGAYQVYCQPLYAFVENYMVKRFPDNYFLNKNIKIPIPGLDMYKLNLFKLVWRTVFVILTTLVSMLLPFFNDIVGLLGALGFWPLTVYFPVEMYIIQKKIPKWSTKWTCLQLLSGACLIITIAASVGSIAGIYLDLKVFKPFKTIY

SEQ ID NO: 28716 - protein, 450 aa, Xanthomonas axonopodis pv. citri str. 306
MPDHLPSDAADALQAPTQLDAFWMPFTANRQFKARPRLLASAQGMYYRDVQGRQILDGTAGLWCCNAGHSRERIVAAIRDQAGTLDFAPTFQMGSPLPFVLAQRLAAIAPPGLGHVFFTNSGSEAVDSAMKIVLAYHRLRGEGQRTRFIGREKAYHGVGFGGMSIGGLPNNRKWFGPLLAGTDHLPHTLDLQHNAYARGLPVHGAELADDLERLITLHDASTIAAVFVEPVSGSAGVILPPEGYLQRLRAICDRHGIVLVFDEVITGFGRVGDAFAAQRFGVIPDIITAAKGLTSGTVPMGAVLVADAIHDAFMHGPQNAIELFHGYTYSGHPLACAAAIATLDTYAEEELFTRAITLGPQWEDALHGLRGSPHVIDIRNIGLIGAIELAPRDGAPGARGYDVFERCFHEGGLLVRVTGDVIALSPPLIVTPEQIGQMVETLGKILRQVD

SEQ ID NO: 28717 - protein, 481 aa, Propionibacterium acnes KPA171202
MASNGHARVEMKPGDSGSAGATRNSQTSRAVFIAVTAAALGITYGYDISNTAAALQFVQRDFGIYSAINTASVVGQIAGAILGGPMANAIGRKKSMLVIAAGYTIFAILTAISPSAGLFLAMRVLLGITIGLSITVVPVFIAESAPASRRGGLATAYQVTCVVGIILGYLVGYSLLPTDTWRWILGVAAVPAFIVLLMLVRTQETPSWYMLKGREDEARRAMERIEVAELVEPSLDEIRNSLSSRPSGSVWGRLREMFHGGMARATIFAIVLGFSIQITGINATIYYAPGIYSRMGFTDTATTYLVPSLVQFLSLISVVISMLVIDKVGRRFVLITGISTMIVATIVLIVTYLASGFEGAVAGIIGLVGMSLFTMGFTFGFGSIVWVYAGEIFPARYRSLGASLVLTADLIANAITAQLGAAMLDGIGLAGTFGVYGGLLVVALLFLLRYAPETSGRSLEEIQDYWNNGARWPKADSPSMG

SEQ ID NO: 28718 - protein, 311 aa, Zea mays
MADAKQQQQQQQQPQQAAAAATGVWKTVKPFVNGGASGMLATCVIQPIDMVKVRIQLGEGSAGQVTRNMLANEGVRSFYNGLSAGLLRQATYTTARLGSFRVLTNKAVEKNEGKPLPLFQKAFIGLTAGAIGACFGSPADLALIRMQADSTLPVAQRRNYKNAFHALYRISGDEGVLALWKGAGPTVVRAMALNMGMLASYDQSVELFRDKFGAGEISTVVGASAVSGFFASACSLPFDYVKTQIQKMQPDANGKYPYTGSLDCAVKTFKSGGPFKFYTGFPVYCVRIAPHVMMTWIFLNQIQKFEKKIGI

SEQ ID NO: 28719 - protein, 468 aa, Pisum sativum
GTSIEGAVASHNDSKLFDDDDRLKRTGTVWTTSSHIITAVVGSGVLSLAWAIAQLGWVIGPSVMLFFSLITWYTSSLLAECYRIGDPHSGKRNYTFMEAVHTILGGFNDTLCGIVQYSNLYGTAIGYTIAAAISMMAIKRSGCFHSSGGKDGCHISSNPYMISFGVIQIFFSQIPDFHKMWWLSIVAAIMSFTYSLIGLGLAIAKVAENGSFKGSLTGVTIGMVTEAQKVWGVFQALGNIAFAYSYSQILIEIQDTIKNPPSEVKTMKQATRISIGVTTIFYMLCGGMGYAAFGDTSPGNLLTGFGFYNPYWLIDIANAAIVIHLVGAYQVYAQPLFAFVEKIMIKRWPKINKEYIVTIPGFHPYHLNLFRLIWRTIFVITTTVISMLIPFFNDVLGLIGAVGFWPLTVYFPVEMYIKQKKIPKWNYKWICMQTLSVICFVVSVVATVGSVASIVLDLKKYKPFTTDY

SEQ ID NO: 28720 - protein, 917 aa, Propionibacterium acnes KPA171202
MIPREERGPVLNGLPTTLPDVDPEETQEWIESLDKMVETDGPNRARIVLLKMLERARSHSRLGLSALTSTDYINTIAAEDEEEYPGDAEIERNIRRLLRWNSAITVHRAQRPGIGVGGHISTYASAVTLYEVGQNHFWRGQDAPGGGDQVFFQGHAAPGMYARAFLEGRLSEDDLDGFRQEKSKAGHGLPSYPHPRMLPDFWQFPTVSMGLGPMNSIYQASMNKYLTNRGVKDCADQHVWAFLGDGEMDEPESRGFLQVAANEELDNLTFVINCNLQRLDGPVRGNGKIVQELEAVFRGAGWNVIKVIWGSGWDPLLQADRDGALVDIMNNTRDGDYQTFKANDGAYVREHFFGRDPRTAKMVDKWTDEQIWALRRGGHDYRKIYNAYKAATQFKGAPTVVLACTIKGYDLGTHFAGRNATHQMKKLALEDLKQFRDRLEIPISDKVLEADPYRAPYFHPGADDERIQYLMERRRALGGFVPERRTRHTPLPIPAQKAFDGVKRGSGKQEVATTMAFVRLLKDLMRDKNFAPHVVPIIPDEARTFGMDSFFPTIKIYNPHGQNYTPVDHELMLSYREAKNGQIIHTGINEAGSAAAFIAAGSAYSTQGVPMVPIYLFYSMFGFQRTGDSFWAAGDQMTRGFIIGATAGRTTLTGEGTQHMDGHSPVLAATNPAVISYDPAYSYEISHIVQAGLEHMYGENAEDVMYYLTVYNEPIVQPAEPEGVDAEGIVKGMYLLSKGSFEGVGEDARRVQLLASGVAVPWAIEAQQLLKGDFGVVADVWSVTSWNNLRRDAMEAEEQTFLHPEQGRRTPYITQCLADAPGPVVATTDYTCQVPDQIAQWVPGDYASLGADGFGFSDTRAAARRFFHIDGPSMTVRALQMLVERGEVPEDWPAKAAEKYDLLNVNAGASGNAGGDA

SEQ ID NO: 28721 - protein, 152 aa, Crocosphaera watsonii WH 8501
MQDFEAIFQNKILLVSLIACFSAQGLKLIIELIRHRKINFRYLVSTGGMPSAHSALVGALATGVGLTKGWESPEFAIACLFAVIVMYDAAGVRQAAGKQARILNQLLDEFLQDSHQLNTEERLKELLGHTPFQVLIGLTWGISVSILTISVL

SEQ ID NO: 28722 - protein, 334 aa, Xylella fastidiosa Ann-1
MIPTPTRDAPNIPSFLAADVGGTHVRVSVVAAAPTCASPPQLFDVRTYRCADYPSLSTILNDFLGTRSAVRDCVIASAGFQRSDGTVITTNLPWPLSPHRLRADLNLAEVCLVNDFEALAYATQDMEAAQLLHLTGPAKAQDGPRLLLGPGTGLGAALWIPNNGRPIVLPTEAGQAALPSTTELEMQLVRHMLNNRTHVPIEHALSGPGILNVYRALCALQSVLPQHASPDAISHAAAAGTDMLSSQTLEVFCDFLGSIVGDLVMMYGAQGGVYLAGGILPQLREPLLRSHFVERFLNKGPMGEALQHVPVRLIEHGQLGIVGAARWYLNKKAT

SEQ ID NO: 28723 - protein, 1075 aa, Desulfitobacterium hafniense Y51
MPKREDIKKIMIIGSGPIVIGQAAEFDYSGTQACKALKNLGYEVVLVNSNPATIMTDAGTADATYIEPLNVQRITEIIEKERPDALLPNLGGQSGLNLSSELAKAGVLDHYGVKVIGVQLDAIERGEDRIAFKETMERLGIDMPKSSPAYTVEEAEKIAQELGYPVVIRPAYTLGGTGGGLVYNVEELKTIVNRGISASMIGQVLVEESVLGWEELELEVVRDSKNQMITVCFIENIDAIGVHTGDSFCSAPMLTISQELQERLQKYAYSIVEAIEVIGGTNVQFAHDPKTDRVVIIEINPRTSRSSALASKATGFPIALISSLLAAGLTLDEIPYWREGTLDKYTPWGDYVVIKFARWAFEKFKGVEDKLGTQMRAVGEVMSIGKNYKEAFQKAIRSLEIGRYGLGFAKDFNTKTLPELLELLKTPTSERHFMMYEALRQGADPAELAAITYVKTWFIEQMKELVDLEEKILEYQGRELPAELLIQAKKDGFADRYLAQLLGISETQVRRQRLGLGLTQAWDAVPVSGVNNASYYYSTYNAPDKVTTSQREKVLILGGGPNRIGQGIEFDYCCVHAAFALKNLGYETIMINCNPETVSTDYDTSDKLYFEPLTVEDVLSIYEKERPIGAIVQFGGQTPLNIAAQLQEAGVRILGTVPEVIDQAEDRDQFRKMMEKLAIPMPQAGMASTLEEALAAAEMIGYPVMVRPSYVLGGRGMEIVFDEEQLREYVAAAVDITPERPILIDKFLENAIEAEADAVSDGTHAFVPAVMEHIELAGIHSGDSACVIPPLTIADRHLRTIIDYTQRIAQELHVVGLMNIQYAIAEDKVYVLEANPRASRTVPLVSKICNTPMARLATELILADYTGQKNDIATNFKPAQISHYGVKEAVFPFDKFPEVDPVLGPEMRSTGEVLGMANSFGLAYFKAQEATHSSLPFSGTVLMSIAEQDRSSGVIEIAQEFLKLGFKIKATQGTRKFLQDHSIDAEFIHKIEEGRPNITDGIMNGEIQLVINTPIGKRSLKDDSYIRKTAIKYKIPYITTTPAALASAKGIAASQEAAANKTVVKSLQEYHGEIM

SEQ ID NO: 28724 - protein, 447 aa, Thermoanaerobacter tengcongensis MB4
MFYNSIKVNSKGHLVIGGCDAVELAERFGTPLYVIDEDVLRANSRIFYNALKSHNPENEVVYAGKAFLTTAMCKIIQQEGLGLDVVSGGELYTALKAGFPTEKIYFHGNNKSEEELIMALQSEVGRIIIDNWDELELLEILAKKLNKEPAIYIRVTPGIEAHTHRYIMTGQIDSKFGFTISNGEAFKAVKRALTSGSLKFKGLHCHIGSQILESTPYKIAVKIMLELLKEIKDTLGRGVEELDLGGGFGIPYVEDDSYQPVEEMLRDILEELEAQVSLLKIKLPKIIVEPGRAIIGNTGITLYKVGGVKEIPGVRKYVFVDGGMSDNIRTALYGARYSAVIANRVYNGRLEKVTIAGKLCESGDVIIWDILLPEVKKGDIIAVLNTGAYGYSMASNYNRLPKPAVILVSKGKAEIIVKRETYEDVIKNDVIPERLEEKFQGREMQAI

SEQ ID NO: 28725 - protein, 359 aa, Dehalococcoides ethenogenes 195
MSHNVTLIPGDGIGPEISEATRRVLEATGVKFNWEIVNAGADVVAEYGTPLPDMVLESIRKNKVAIKGPVTTPVGSGFRSVNVGMRKALNLYTCLRPCKTYPGVPSRYDNVDIVIVRENMEDLYAGIEFEKGSPEALRLIEFIKENKKVEIRADSGISIKPISVFGTERIFRWAFKYARDNKRKRVTAVHKANIMKYSDGLFLAIGRKVAEEYPEIEFEDRIVDNMTMQLVKNPSQFDILVCPNLYGDILSDLCAGLVGGLGVAPGANIGDEYALFEPTHGSAPKYKGMNKVNPMAMMLSGVLMLRYLKEEKAADKLENAIAAVIAEGKSVTYDMLSPDKQAAAVGTSQVADAIIAKMK

SEQ ID NO: 28726 - protein, 491 aa, Escherichia coli CFT073
MMSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTDHPGIAKVSFTGGVASGKKVMANSAASSLKEVTMELGGKSPLIVFDDADLDLAADIAMMANFFSSGQVCTNGTRVFVPTKCKAAFEQKVLARVERIRAGDVFDPQTNFGPLVSFPHRDNVLRYIAKGKEEGARVLCGGNVLKGDSFDNGAWVAPTVFTDCSDDMTIVREEIFGPVMSILTYESEDEVIRRANDTDYGLAAGIVTADLNRAHRVIHQLEAGICWINTWGESPAEIPVGGYKHSGIGRENGVMTLQSYTQVKSIQVEMAKFQSIF

SEQ ID NO: 28727 - protein, 453 aa, Methylobacillus flagellatus KT
MKSPAEVTSIQNAMKDKGIKYCIGAYVDIHGVPKAKVVPIDHLPQMAAGSERYTGYALDGLGQAPSDDELTSIPDLDHIIQLPWEPKVAWMPADNGFQGQPYALNTRVALKNVLAQAAAMGFGMNLGIECEIYLLKQEADGKLAIPNPDDKLVKPCYDVRGFMDNFGWLDKMATAINSLGWDLYSFDHEDGNSQFEFDFNYSDVLTMCDRFTFFRYMAKHYAKEEGLLATMMPKPFADKTGTGAHFNMSLYDLDTGKNLFACDPKDDPRGLGLTPLGYHFIAGILKHGAALCAVFAPTVNSYKRLVRRGAMSYFSWAPVFNSYGSNNRTNSVRVPQGGGRCESRNADGAVNPYLAAALVLAAGLEGIREKLDPGAPNEDNLYAINDEEREKRGIHFLPQTLQEAVACFAADGLMEKTLGKELRDEFITYKSQEWDAYHLSISQWEVERYSYMF

SEQ ID NO: 28728 - protein, 305 aa, Prochlorococcus marinus str. NATL2A
MKQLQVLLVAGTHGNEINGIWLFDEWKKSSFLINTHGIKTFKVIGNPEAKKAGKRYIHHDLNRSFKEESFIKINPLNCERTRASELVNLYGEAGENPCQIALDFHTTTASMGSCIVVYGRRDADLALASLIQNQLGLPVYLHESDQKQTGFLVESWPCGLVVEIGPIGQGLLNSRIISQTKLILETLMEQIHEVKNLNLFFPNKLIIHRHIKSIDFPRDEEGNIDGYVHSLRQSKDWQELKKNDELFCKLNGEIIRFEEDEPYIPVFINEAAYVEKNIAMSFTKRELWNFKKEWKQALIDLIHQK

SEQ ID NO: 28729 - protein, 334 aa, Ashbya gossypii ATCC 10895
MVEPTLKKQRTGNSLAQLKATGTTVVADTGDFQAIAKYAPQDATTNPSLILAAARKEGYQALIDRAVEYGRSRDGSVEQQTEAAVDRLLVEFGKEILKVVPGRVSTEVDARLSFDKDATVRKALEIISLYEQQGVSKDRVLIKIASTWEGIQAARELESQHGIHVNCTLLFSFCQAVAAAEAGVTLISPFVGRILDWYKASTGKTYSGDEDPGVLSVRRIYNYFKKHDYPTIVMGASFRNLDEIKALAGVDFLTFWPASLNQLMTSADPVPQVLDPASAKAQGDDKVSYVEDEPAFRFALNDDAMATEKLAEGIRKFSEDIVTLFAMVEERIRA

SEQ ID NO: 28730 - protein, 475 aa, Dehalococcoides ethenogenes 195
MTSQIKFGTDGWRGIIAKDFTFDNVSVCAQATAAYLKNTSPRNLSLVIGYDTRFASADFARSAAEVMAANGIKVYFCSCPTPTPVISHGVVNLKAAGAVIITASHNPARWNGFKVKSADGASAPTQMITGIEAEIAKLGDKPPVLNLDFDTAVSRGLIEHVDLAPAYFEKIGGLVDIEKLRDAGFNIAIDSMHGAGIGYFKQLLDGGCNRLNEINAEPNPNFPGMLQPEPITPNLAKLMRLVKDIRSDIGLATDGDSDRLGVVDEMGNFLNQLQVFSLLALYMLEVKGLRGPLVKTITNSSMIDKLGELYNVPVFETKVGFKYVSPVMLEQNALIGGEESGGYAFTGHVPERDAILAGAYFLDFMITTGKSPAEMLEYLYSKVGPHYYNRVDYTFAEARREEIIKHLTDQKPASLGETKVVSTDKLDGFRYKLEDGSWLLIRFSGTEPLLRVYAESPSQAKTAALLEDGRQLSGI

SEQ ID NO: 28731 - protein, 332 aa, Polaromonas sp. JS666
MTIKVGINGFGRIGRNVFRSAVQSFSDIEIVGINDLLEPEYLAYMLQYDSVHGRFKGEVSVDGNTLIVNGKKIRLTQERDPANLKWNDVGAQVVIESTGLFLDKTSAEKHLAAGAKKVIISAPSKDDTPMFVFGVNDKTYKGEAVISNASCTTNCLAPVAKVLNDKWGIKRGLMTTVHAATATQKTVDGPSNKDWRGGRGILENIIPSSTGAAKAVGVVIPELNKKLTGMSFRVPTSDVSVVDLTCELSKEATLKEICAEMKAQSEGALKGVLGYTEDKVVATDFRGDARTSIFDADASIALDSTFIKVVAWYDNEWGYSNKCLEMVRVVAG

SEQ ID NO: 28732 - protein, 365 aa, Ashbya gossypii ATCC 10895
MPRTITFDIPSHYKLVDLIGEGAYGIVCSAIHKPTGTKVAIKKIQPFTRPMFVTRTLRELKLLKFFHSHENIISVLDIVRPTSYQDFEAVYLVQELMETDLQRIISQPNSFLSDDHIQYFTYQILRALKSLHSAQVIHRDLKPSNLLLNSSCDLKLCDFGLSRCLASSDRSRENMVGFMTEYVATRWYRAPEIMLSFQEYTTAMDIWSCGCILAEMISGKPLFPGRDYHHQLWIILEILGTPSFEDFEQIKSKRAKAYIANLPMRPKIPWNVALSTNDINPLAMDLLDKMLTFNPDKRISAADALKHPYLETYHDAEDEPDYELLNLQDNFWKVDNEARQKTEEEELSMDTLKAMLYEEVMKPLQ

SEQ ID NO: 28733 - protein, 269 aa, Bacillus clausii KSM-K16
MDPIETTIPSFDGTKLYFVKNLVDHARAAVVIVHGLCEHAGRYDYLTENLNARGFNVYRFDHRGHARSEGKRTFYSNFHQIIDDVNVMVDQALQESTNIPVFVIGHSMGGFASAAFGTKYPGKVKGIVLSGALTRYNTQVAGELPLALPTGTYLPNELGSGVCSDPEVVAAYANDPLVEKQISVDLFNCLGEGVAWLKQSAENFVDPVFVMHGANDGLVSEQDSRDFYGDIASADKSLKIYAHLMHEIFNEPSRDEVIAEAIAWLEKRI

SEQ ID NO: 28734 - protein, 296 aa, Lactobacillus sakei subsp. sakei 23K
MVKADLKDPRELYKVSGFEEQEQPAPALQGKMRPKPDCGEADYQGREQLMNRKVLITGGDSGIGRAVAIAFSREGADIALQYLPGEESDANEVAGLIESAGRKAVLIPADYKMQEAPQQVVAQAVAQLGGLDTVVLNAAQQIAHPTLEDLPIQQVRDSFEINVVAMYGIAKAAIAHIPAGGSILTTTSIQGFNPSSQLLDYAATKAAIRNFTINLAQQLADKGIRVNGVAPGPIWTPLQLAQGQLEGALPKFGQNTLLKRAGQPVEVAPVYVFLASNAASYITGQIYGVTGGESIN

SEQ ID NO: 28735 - protein, 118 aa, Wolinella succinogenes DSM 1740
MRNRYIESFEKAQIADKNIPQFKAGDTLRVGVKIQEGDKTRVQNFEGICISVRGTGTGKTFTIRKMGANNVGVERIFPLYSDSLESVTLLRVGRVRRAKLYYLRDRSGKSARIKELRK

SEQ ID NO: 28736 - protein, 534 aa, Oryza sativa (japonica cultivar-group)
MGNSCQNGTYGNNYQNSNRFQNDRFASRYVDGNDTEDCYSGSSRASLAGALRQGLNLKSPVLGYKTPNVRELYTLGRELGQGQFGKTYLCTEISTGCQYACKTILKSNLRCVSDIEDVRREIQIMHHLSGQKNIVTIKDTYEDEQAVHIVMELCAGGELFSKIQKRGHYSERKAAELIKIIVGIIETCHSHGVMHRDLKPENFLLLDADDEFSVKAIDFGLSVFFRPGQVFREVVGSPYYIAPEVLEKRYGPEADIWTAGVILYVLLTGVPPFWADTQSGIYEKVLDGRIDFKSNRWPRISDSAKDLIKKMLCPYPSERLKAHEVLKHPWICDNGVATNRALDPSVLPRLKQFSAMNRLKKLSLQIIAERLSEEEIVGLREMFKAMDTKNRSVVTFGELKGLKRYSSVFKDTEINDLMEAADDTTSTINWEEFIAAAVSLNKIEREKHLMAAFTYFDKDGSGFITVDKLQKACMERNMEDTFLEEMILEVDQNNDGQIDYAEFVTMMQSNNFGLGWQTVESSLNVALREAPQVY

SEQ ID NO: 28737 - protein, 838 aa, Xanthomonas axonopodis pv. citri str. 306
MSSPSPAPVTPDLVRLRASARDKDDAIAQAAQLLVAAGCVAPGYEASMRRREGLANTFLGHGLAIPHGVGEDRHLVRRDGIAVLQLPDGVEWNPGQITRLVVGIAAQSDTHITLLRRLTRLIQDPAQLEALFSTDDPSVIVAALTGDRAPETSAAPATDLAEAFEWTIAYPSGLHARPATRWAETARGFSARAQVRAGDQAADAKSLVGLLQLGLRAGDSITVSAEGSDAAELLKRLRAVMDSLTAQEKADAERAAQRRAAPVAGWTPPQAQPAIVGIGASPGVAIGIVHRLRAAQTEVADQPVGLGDGGAQLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPDQPCILLASDLSPSDTANLDTARVLGLATAQGGPTSHTAILSRTLGLPALVAAGGQLLEIEDGVTAIIDGSSGRLYIDPSEQDLDAARTHIAEQQAIREREAAQRALPAETTDGHHIDIGANVNLPDQVAMALTQGAEGVGLMRTEFLFLESGRTPSEDEQHATYLAMAQALDGRPLIVRALDIGGDKQVAHLELPHEENPFLGVRGARLLLRRPDLLEPQLRALYRAAKDGARLSIMFPMITSVPELVALRAICARIRADLDAPEVPIGIMIEVPAAAAQADVLARHADFFSIGTNDLTQYVLAIDRQNPELAAEADSLHPAVLRMIRSTIEGARMHDRWVGVCGGLAGDAFGASLLAGLGVQELSMTPNDIPAVKARLRGAALSQLQQLAEQALACETAEQVRALEAKREDKA

SEQ ID NO: 28738 - protein, 1068 aa, Propionibacterium acnes KPA171202
MPRRTDLHRILVIGSGPILIGQAAEFDYAGTQACLALKEEGYEVILVNSNPATIMTDRDVADKVYIEPITLEFVSSILRRERPDAIVPTLGGQTGLNMATELAKSGIPDELGIELLGTKLSAIEKAEDRDLFKQLMDELGQPVPASEVVHTVDEAVKVGNTIGYPLIVRPAYTLGGTGGGMCCDEAELVRIVGKGLELSPVTECLIEQSIAGFKEIEYEMMRDGADNTMVVCTMENFDPVGVHTGDSIVFAPTQTLTDVEHEMLRDASIEIVRTLGIEGGCNVQLALDPNSFQYYVIEVNPRVSRSSALASKATGYPIAKIAAKIAVGLTLDEIRNPVTGTTWSMFEPMLDYVVAKIPRWPFDKFAQADRRLGTQMKATGEVMALGRTIEESLLKAVRSLEIGVDHLALREVADLPDDILEERLLHARDDRLFCLTEAIRRGRTVQELHEQTRIDVFFLDKVAHILEIEERLRACPDDSEALWIAKRNGFSDPAIARIWGETPDDVRVRRVDNGIVPVYKMVDTCAGEFESSTPYFYSTYEMENESKKSQRPSVLVLGSGPIRIGQGIEFDYATVHSVKAIQAAGYEAIIMNSNPETVSTDFSISDKLYFEPLTFEDVMNVIDLEQPDGVIVQFGGQTAINLAGPLSAAGVPILGTQVADLDRAEDREGFESLLAELGIPQAPGGTARSSEEAFAVAEELGYPVLVRPSYVIGGRAMAIVTSAEELKRYMRDAVHASPDKPVLVDRYLNGLECEVDAICDGTDVLIPGIMEHIERAGVHSGDSMAVYPPQRMSQQVADRIIEVTTKLARGLKTKGILNIQFVVANDPATGEETVYVIEANPRASRTVPFLSKVTGVSMAEVATRIILGETLADLGLRPGLLPFSKRIHVKSPVFSFSKLDLVDSHLGPEMKSTGEVMGSDDTVEKALYKVFEAANLHVPEYGKILITVTDDAKPEALQLARRFDRIGFQLVGTMGTARFFDEGGLRIDVAEKIGSGEAGSTESVLDLISRNGCDAVINVMGNGQDTIIDGKQIRREAIARGIPLFTSLDTAAAICRVMESRVFSTESI

SEQ ID NO: 28739 - protein, 245 aa, Arabidopsis thaliana
MRTMVDLGKQRDHNYHHMQIITTPTSVDCSREFRHRRTLRSLIECMIPYCCTYQQQPYQNDTLSVSSTSSSSSSSDHSSSSQSSSTVSGTFFGHRRGRVSFCLQDATVGSSPLLLLELAVPTAALAKEMDEEGVLRIALECDRRRSSNSRSSSIFDVPVWSMFCNGRKMGFAVRRKVTENDAVFLRMMQSVSVGAGVVPSEEEDQMLYLRARFERVTGSSDSESFHMMNPGGSYGQELSIFLLRS

SEQ ID NO: 28740 - protein, 106 aa, Arabidopsis thaliana
FYYHPLCTNHRTKRQASSRHGVRSMRVMSCRKQKLPEENEGVIQRTLRRMISEAGKIGKNLKPEKKKGDVKDLMLMSLSFAVYVYISQLLVCAYFSWQHLSFPKSS

SEQ ID NO: 28741 - protein, 507 aa, Yarrowia lipolytica CLIB122
MSKRAAEDKQTPTKATKTSESADAASTATSGTPQELSEMEQLELKYGGMEDRYDDDGESEEEIFEAGDENDEEMDDVTEEEAKTRAMEAIAKDNAVKTAKSVFVPQLHELTPDMVMEPDMSVYEMIHSCRLKWPCLSFDILPDSLGSDRSTYPHTTYLACGTQAQKPKDNEILVLKISQLGKTQFNEDDDESEDEEDDSDPVMISKHIPTNSTVNRVRTSPFGNKTGEYLTASMMESSECHIWDLSPQIKSFDVPGSTISKQQLKPLYTIKQHKTEGYAVDWSPLVTGGELLTGDCDGNIYQTSRGQSGFTTSENPYSVGSSVEDLQWSTSEKTVFASGGVDGLIRIWDTRQKQNKAALEVRATNTDINVMSWNHKVSYLLASGHDDGTWGVWDLRSFQKPNPKPVAAFDFHKKPVTSIEFHPTEDSVVAVASEDSTVTLWDLAVEADDDEVKQQLKDNGDIAQIPPQLLFVHWQANPKEVRWNKQIPGQLVSTGSDGLNLWKSISV

SEQ ID NO: 28742 - protein, 267 aa, Prochlorococcus marinus str. NATL2A
MRFRPLLALMLAFCLTFTTLPSSASAALKGREQGNARFGNVVNTGQADACTVLPAGSSGSINADGQFKSLCLQPTEVSVKLPGNKRNKSDFAIAKIISPRFNTSLDEVYGDLSGGKFTEKGGIDFSLITVLAPNGEEFPFAFSVKEMVAESKKGKSIEPGAEFSGPTTTPSYRSADFLDPKSRAKSTGVEYAQALIARGGDDEDLARENVKDDLGGKGEITLTVDSVDADTNEFGGQFVAIQPSDNDLGSKDPVDIKIKGIFYGRKA

SEQ ID NO: 28743 - protein, 228 aa, Buchnera aphidicola (Baizongia pistaciae)
MYLVDTIDYQKICCIIKTFEDNILFQKNYHSTWFLKSIANIQKEKYNYGLEVAFVGYSNSGKSSIINALTNQKKLAKISRTPGRTRLINIFSVTSEIRLVDFPGYGYAQVSRSISKKWKEMIFQYLNIQKCLQGLVIITDIRCPIKEIDELVINLAVSLNIPILLLLNKMDKVTRSIQKSKLFSTREKMLNFSNNINVELFSSFKKIGIHKLQFVLNNWFSSDKKLCQ

SEQ ID NO: 28744 - protein, 674 aa, Polaromonas sp. JS666
MANSIRALAMDAVQQANSGHPGAPMGMADIAVALWGRHLKHSPHNPQWFDRDRFVLSNGHGSMLLYALLHLTGYKLPMSELKNFRQLHSKTPGHPEHGYTPGVETTTGPLGQGLTNAVGMALAEKLLAKEFNRDGHSVVDHHTYVFMGDGCLMEGISHEAAALAGAWKLGKLIALYDDNGISIDGPVTPWFIDNTPLRFAAYGWNVIGPLDGHDAQAVSAAIAEAKESTDKPTLIVCKTHIGKGSPNRANTAKAHGEPLGAEEIKLTRDELNWPHTPFEVPKESYDAWDAKAAGLAAEAAWDVKFTAYKAAHPELAAEFTRRMKGELPKRFSQLAVDTVIGAHTRAETVASRKASQIALESFTAGLPEMLGGSADLTGSNLTNTKSTPNLRFDPNGEVVQTEAANGSLVGGRHINYGVREFGMAAIMNGVALHGGFIPYGGTFLTFSDYSRNAIRMAALMKLRVVHVFTHDSIGLGEDGPTHQSIEHAASLRLIPNLDVWRPGDTAETAVAWAVALQNKNKPTALLLSRQNLPYAPKNDLGEISKGAYVLAEPAEVGLNKKAQAVIIATGSEVQLALKAQELLAGKKIAVRVVSMPSTTTFDKQSTAYKTSVLPAGIPRIAVEMGVTDGWWKYGCAAVVGIDTYGESAPAAALFKHFGFTPENVADTVRKVLKK

SEQ ID NO: 28745 - protein, 601 aa, Oryza sativa (japonica cultivar-group)
MGSAGGGGWDDDDDGDEQCATPPPPRSFSPMMMTEAGMKLVTPPWRRWRRWRGGCAESGRAVRAACVAAAVVLAVVVLSYYARWGGDQDEMPTSLFTTRGSEGATSANLTDDQLLGGLLTAAFSPQSCRSRYEFAGYHKRKPPHKPSPYLVAKLRSHEALQKRCGPGTAPYDKALRQLKSGDGAAAADGDDDCRYLVSISYNRGLGNRIIAIVSAFLYAVLTERALLVAPYNGDVAALFCEPFPGTTWLLPDGGRRFPLLHLRDLDGKSKESLGALLKSNGIVSVAAGVNGSTSSSWSGRPPPPYVYLHLDGGADYHDKLFYCDEQQRLLRGVPWLLMKTDSYLVPGLFLVPSLRGELERMFPEKDAVFHHLSRYLLHPANAVWHAITAYHRDHLAGAGHLVGIQIRVYHEETPPVSQVVLDQVLSCARRENLLPAAGNTSSSDQAVLVTSLSSWYYEKIRDELGGGGGGVHQPSHEGLQRMGDTAHDMRALSEMYLLSTCDALLTTGFSTFGYVAQGLAGLRPWIMPRRPWWEKEAATAVPDPPCARVATPEPCFHSPSYYECAARRNYDDIGKVVPYVRRCEDVSWGIQLVNGSSQSQW

SEQ ID NO: 28746 - protein, 236 aa, Myxococcus xanthus DK 1622
MSQQGDGAATARYKQAAAEWAVDGFLQPGMVVGLGTGSTAAFAVQRLAALRAQGRLLDIVGVPTSRATEALARSLGVPVSTLDAHPVLDVTLDGADEVAPDLSLIKGGGGALLREKIVAQASRRVVIVVDAGKLSPVLGTHWPVPVEVMSFGWRSQARFLESLGARVTVRQGAGGEPFLTDQGNLVLDCAFGPIDAPAALAASLGARAGIMGHGLFLNLATDLVVAGPEGVEHRAR

SEQ ID NO: 28747 - protein, 264 aa, Triticum aestivum
  misc_feature (140)..(140): Xaa can be any naturally occurring amino acid
  misc_feature (225)..(225): Xaa can be any naturally occurring amino acid
  unsure (1)..(264): unsure at all Xaa locations
MSKLFHSACKGARAFLASSSAPAAAPRAASSVLADGRNAALATLANLGRNSTLPAAYAHHLHTNAAASSHGYAWIAAIPAAVYMLQDQEVHAAEMERTFIAIKPDGVQRGLISEIVSRFERKGYKLVAIKLVVPSKQFAXKHYHDLKERPFFNGLCDFLSSGPVLAMVWEGEGVIKYGRKLIGATDPSKSEPGTIRGDLAVVVGRNIIHGSDGPETAKDEIALWXFQPKELVSYTSNEEKWIYGVKLTAASSSRKSQRSSSPFP

SEQ ID NO: 28748 - protein, 236 aa, Brassica napus
  misc_feature (232)..(232): Xaa can be any naturally occurring amino acid
  unsure (1)..(236): unsure at all Xaa locations
MANVEEIQCGSMLFRQEELQEMSGVNVGGGYVEVMCGCTSHRYGDAIAKLRVFPNGNLEITCECTPGCDEDKLTPAAFEKHSGRETAKKWKNNVWVINGGEKVPLSKTVLLKYYNEALKECKRSTKSQGTKVFHRDEFVGCIECGKERRFRLRSRDECLLHHNAMVDPNWKCSDFPYDKITCEAEEERGSRKVYRGCTRSPTCKGCTSCVCFGCELCRFPDCTCQMCVDFTXHVKA

SEQ ID NO: 28749 - protein, 414 aa, Candidatus Protochlamydia amoebophila UWE25
MRKIIVVGGGFGGLNTVRSLKNAQVEILLIDRTNHHVFQPLLYQVATAALSVENITTPLREILKNQSNVRVLMAEIEKINLENQYIQAVDGQQFYYDDLILAPGARHTYFGHDNWEHFAPGLKTVADAFRIREKMLMAFEKAERCENREAVQSSLSFVIIGAGPTGVEMAGSMAEFAHRTLFKNFRSINPANSKIYLIEEGQQILPSFPGELANRALEDLKQLGVEVLLNTFVTQVTDQGVYMNEKFLPAFTVVWAAGNEASPLVKSLGVSLDKQSRVKVQPDLTIPGFTNVFVIGDAAAVVSSKNEFLPGIAPVAIQQGHYVANLIKKNILPSNRKPFLYWDKGMIATIGRGRAVAILGNFKFSGFLAWLIWCFIHILYLVSFGHRLLVMIQWIFLYLFNRRQARVIIRPIQE

SEQ ID NO: 28750 - protein, 389 aa, Escherichia coli CFT073
MSDTTILQNSTHVIKPKKSVALSGVPAGNTALCTVGKSGNDLHYRGYDILDLAEHCEFEEVAHLLIHGKLPTRDELAAYKTKLKALRGLPANVRTVLEALPAASHPMDVMRTGVSALGCTLPEKEGHTVSGARDIADKLLASLSSILLYWYHYSHNGERIQPETDDDSIGGHFLHLLHGEKPSQSWEKAMHISLVLYAEHEFNASTFTSRVIAGTGSDMYSAIIGAIGALRGPKHGGANEVSLEIQQRYETPGEAEADIRKRVENKEVVIGFGHPVYTIADPRHQVIKRVAKQLSQEGGSLKMYNIADRLETVMWESKKMFPNLDWFSAVSYNMMGVPTEMFTPLFVIARVTGWAAHIIEQRQDNKIIRPSANYVGPEDRQFVALDKRQ

SEQ ID NO: 28751 - protein, 651 aa, Wolinella succinogenes DSM 1740
MNALLQEQDLPVLELMAKTVRFLAADMVQAANSGHPGAPMGLADVVSVLSFHLRHSPKNPQWLNRDRLVFSGGHASAMIYSLLHLWGYDLPLEELKRFRQKDSKTPGHPEFGHTAGVEITTGPLGQGVANAVGFAMASKYAAHLLNSEETTLIDHKVYCLCGDGDLEEGISYEACSLAGHHQLDNLILIYDSNNITIEGELSLAFSEDVKGRFEAQGWEVFEVCGHDVLAIHKVFSEAKRADKPVLIIAKTTIAKGCKTMEGYAKTHGAPLGEEEIRASKEKNGFDPSEKFYIPEAALLRFRNALEMGETMENLWNEKLQKAPKEKKQLLEQLLSPDFSAVDFPVFEEGKKIATRSSNGEILNRLSSALPGFIGGSADLAPSNNTDLKGAGNFPMGKNFHFGIREHSMAAITNAIANYGLFMPFCATFFVFSDYMAPSVRVASIMGAKNYFIWTHDSIGVGEDGATHQPIEQLTHFRAMPGLYLFRPADANENVACWQVALRLKAPCAFVLSRQNLPVLPRVESEKVAKGAYTIRACENPAIVLLATGSEVSLALETAEVLAKEGVSVNVVSAPCFDLLVAQDKRYLRSLFPEGAKVIAIEASRGLEWYRFADEVIGMDSFGASAPGDELFAHFGFTVENLLSKAKELLGR

SEQ ID NO: 28752 - protein, 528 aa, Zea mays
MESFGVPPAPVAAPEKRKKPLDLKDPVPAAAAAAANGGGATKASPAAKWAEKKKLVGGDAGYVLEDVPHLTDYLPQLPTYPNPLQDNPAYSVVKQYFVNPDDTVTQKIVVHKTSARGTHFRRAGPRQRVYFQPDEVNAAIVTCGGLCPGLNTVIRELVCGLYDMYGVTSVVGIEGGYKGFYSKNTVALTPRSVNGIHKRGGTVLGTSRGGHDTAKIVDCLQDRGINQVYIIGGDGTQKGASVIYEEVRRRGLKCAVVGVPKTIDNDIAVIDKSFGFDTAVEEAQRAINAAHVEAESAENGIGVVKLMGRNSGFIAMYATLASRDVDCCLIPESPFYLEGKGGLLEFVERRLKDNGHMVIVVAEGAGQDLIAKSMNSVDTQDASGNKLLLDVGLWLSQKIKDHFKKKPRFPITLKYIDPTYMIRAVSSNASDNVYCTLLAHSALHGAMAGYTGFIVAPVNGRHAYIPFYRITEKQNKVVITDRMWARVLCSTNQPCFLSHEDVENMKHDDDEHHLHNTLLLDSPENSSK

SEQ ID NO: 28753 - protein, 64 aa, Hortaea werneckii
MTKCIYCGFCQESCPVDAIVEGPNAEYATETREELLYNKEKLLANGDKWEPELAAIARADAPYR

SEQ ID NO: 28754 - protein, 849 aa, Oryza sativa (japonica cultivar-group)
MVLPPRLLLFFLLLIGVHASVSHGSPSLPPTYDPSICSNLDGSKQTPFIQLNGENYTILEIIYDSRTIVLADTDALRGSCPRVRHNVTFGQAYPWLQYTGSRDNLTFFFGCKLNLPPPIDPGLVSLADKHQINCKDFSNWPDSGDSFVFTSGELEAPVESELARCCSQVIVVPVNGSVLNSSNQSALPSGGYGQVLKMGFDLAWNSSKDEQCYKCEQSKGHCSYSQNRAFLGCLCSDGKLAMLLSLCLRLLPLLLVLVAASHGDASGDTYDTSMCLQKPTTCGNVSISYPFYFATKTKDINGSSNSYCGYPGLAIDCDDGKPILQLNGTEKYKVNYINYGSITNVSLADLEVVDDSSGCPRVDHNVTIPQISWLFFSGISVDYLVFFLRCSFTTFAPKPANFNPIACGSFINLTRPSFVFPDELVPPGNWSQLCEETFEVPVLKYQLMEMDSNGNAWNNSGYAQPNLLYPYQYSGYAVMDKTRYSILMPFSVPNFLHANIIAGTSSVLLLCLLSFACLFGLKKSRYRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHGSKRVLIYEYMPNGSLERYAFRNNSEGEHSLTWEKLFDVVVGIARGLEYLHRGCNTRIVHFDIKPHNILLDQEFCPKISDFGMAKLCSNKESIISIAGARGTIGYIAPEVYSKQFGAISSKSDVYSYGMMILEMVGARERNIDANSESSSHYFPQWIYEHLDEYCINSSEIDGETTELVRKMVVVALWCIQVVPTNRPTMTRVVEMLEGSTSGLELPPKVLLSW

SEQ ID NO: 28755 - protein, 342 aa, Mycobacterium sp. KMS
MSQYVGRVRTPATVVAGVDFGDAAFAADVRAGVARIEDLMSTELGKADELMAEAVQHLFQAGGKRFRPLFTVLSARLGPEPDAWQVTVAGAVIELVHLATLYHDDVMDEAQVRRGAPSANARWGNNIAILAGDYLFATASRLVSRLGPEAVRIIADTFAQLVTGQMRETRGAVEGVDEIEHYLKVVYEKTACLIAASGRFGATFSGADETQIERLARLGGIVGTAFQISDDIIDIDSDPDESGKVPGTDLREGVHTLPVLYALRESGPDTDRLRELLARPVDNDDDLAEALRLLRRSPGMEQAKATVARYAQQARDELAALPDMPGRQALASLVDYTITRHG

SEQ ID NO: 28756 - protein, 807 aa, Cryptococcus neoformans var. neoformans B-3501A
MTSPSAQPMIPRSQPPRPSHTQSSPAINSTGIKPNGSPSVIRRAPSVPVNPSTAAASGSLSSLLKSENTAQAVSRSSPPTEPNDLPRPIEPTPMLPITGLPNSSSSSSNARHGSSSSISRGPSVTGTLTPATTALGAPIEPTPPQTGASKMAAAAKRGLDGSAGNNVKVYEEGHPLNEETLKQRGYQTLNILNHPFHLPDRWKLLRPLGQGAYGLVIQVQDAETEIPIAVKCVTRVFDKVILARRALREITLLRHFGEHDNLTGLVDMDNVWDGYNEIYLYMEPMEADLHQIIRSGQPLGNAHIQFFIYQLLRGMKYIHSANVIHRDLKPGNLLVNSGCELKICDFGLARGFNPVRGEEPQGEEGKLTEYVATRWYRAPEIMLSNRRYTTAIDVWSIGCILAELLGLKPVFKGKDYIEQMTLILETLGTPDEETMARVASEKALTFLKTLPTYEKKDLGSIFPDADPLAVDLTDKLLEFDPTRRIDVPSALTHAYVERYHDPEDEPSCDKIFDKWEEVESLSTIEELKEAITREIQGFREEVRMAAEEDDEDEEWAEGEYLDDENVFHDSPGPALASTLEKFTYPDHIAPSSSILPSAARLAPIIHQSPKGSKSPHVKSAHLPSVPSSANSSKPSSTAGSAPRTREHSPTTTFITPAEDYFTAQHGFGGPNGRASRRSSSHSTSGRRPASFLFSPFGAGMTQIVPTPNAYPRSHAQASPELTTAEKTPRDRRSSGLWRTRSRAQSQSGNLVLERLSSLEINDHKDGEKNRIDALHAVVGLGGDGEVPPMTVSPSDAPPSEVPKSFGY

SEQ ID NO: 28757 - protein, 204 aa, Glycine max
MASAGDLFRHGLPEVGGAGKLHVLAVDDSHVDRKVIERLLKISSCKVTVVESGSRALQYLGLDGEKSSIGFDSVDVNLIMTDYSMPGMTGYELLKKIKESSVFREVPVVVMSSENILTRIDSCLEEGAEEFLLKPVKLSDVKRVTDFIMRGEGMKGVKRSKKRSRSDDCIPSLSTAFASVSHPCDLSSPPSPCVSQSKKSRLSI

SEQ ID NO: 28758 - protein, 469 aa, Pseudomonas syringae pv. tomato str. DC3000
MSETTAPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPHIPSWVSAAVFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDAAAHILNFVVLTAALSVYNSGTYCNSRMLVGMAEQGDAPKLLAQVDKRGVPVKAIFASAAVTLVAVLLNYFVPQQALELLMSLVVATLVINWAMISYSHLKFRQHMNRTGQVPLFKALWYPYGNYVCLAFVVFILGIMLMIPGIQISVYAIPVWLAVMWVCYRAKNRRSVVVNAETGK

SEQ ID NO: 28759 - protein, 729 aa, Triticum aestivum
  misc_feature (336)..(336): Xaa can be any naturally occurring amino acid
  unsure (1)..(729): unsure at all Xaa locations
MAQLQETYACSPATERGRGILLAGDAKTETIAYCSGRSVIFRRLDAPLDAWAYTEHAYPTTVARFSPNGEWVASADASGCVRVWGRNGDRALKAEFRPITGRVDDLRWSPDGMRIVVSGDGKGKSLVRAFMWDSGSTVGEFDGHSKRVLSCDFKPTRPFRIVTCGEDFLANYYEGPPFKFKHSIRDHTNFVNCIRYSPDGTKFITVSSDKKGLIYDGKTGDKIGELSSEGSHTGSIYAVSWSPDSKQVLTVSADKTAKVWDISEDGSGTLNRTLVCTGIGGVDDMLVGCLWQNDNLVTISLGGTFNVFSASNPDKEPVSFAGHLKTASALALFPQXNPRTMLSTSYDGVILKWIQGVGYGGRLIRKNNTQIKCFVATEEELITSGYDNKVFRIPVNGDQCGDAESADVGGQPNALNIALQQPEFALVTTDSAIVLLNKSNVTSTTKVSYTITSSAVSPDGTEAIVGAQDGKLRIYSISGDTVTEEAVLEKHRGPITTIHYSPDVSMFCSADSNREAVAWDRATREVKLKNMLFHTARVNCLAWSPDSRFVATGSLDTCAIIYDVDKPAASRTTIKGAHLGGVHGISFADNDTLVTAGEDACIRVWKLGAAVGAQAHPHSSVSMAAYQNKHRYGRPLFPCFPQAAVAALSSLCFFFLCDVILSCAPGRKNPTVIVSFPRIVWFCGVLRIQGVMVCCDILSVCSLEWLYFFCVCSLHWLLITETIFVLAFS

SEQ ID NO: 28760 - protein, 331 aa, Vibrio angustum S14
MTIKVGINGFGRIGRFVFRAAQERNDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMFVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYETICAAMKEASEGALKGVLGYTEDQVVSQDFIGETQTSVFDAKAGIALTDNFVKVVSWYDNEIGYSNKVLDLIAHISK

SEQ ID NO: 28761 - protein, 290 aa, Vibrio angustum S14
MNLRQLSTVNALSDNVTACEYQGINIIRVIHPLAEAGISLHGGHLLWFKPQGEKDIIWLSEKAIFDQSKAVRGGIPICWPWFGQAGTPSHGFARTSQWSLLEHRENENGVIVSLALEDNEETYAIWPHKFKNVLTFEIGQELKVSLTSTNTDNQPWSYSGALHTYFDIANINDIDITGMGPNYLDSTQQGKVCEGGSKLTFNNETDRVYTQPEAVITINDKNNNREILVTNEGHNAAVIWNPWQALSISMGDMADNSYETMVCVESTIHQPSVELAPGQSHTLATTISSL

SEQ ID NO: 28762 - protein, 71 aa, Cucumis sativus
SWRILSSIEQKEEAKGNETNAKRIKEYRQKVESELSGICNDIMMVIDEHLIPSASAGESTVFYYKMKGDYY

SEQ ID NO: 28763 - protein, 113 aa, Brassica napus
  misc_feature (36)..(36): Xaa can be any naturally occurring amino acid
  misc_feature (67)..(67): Xaa can be any naturally occurring amino acid
  misc_feature (89)..(89): Xaa can be any naturally occurring amino acid
  unsure (1)..(113): unsure at all Xaa locations
GPGPAQAHAHEKKDEHPRRAKADEETETGGKKRKEXHKTEDEGPRTEPHGTDHRATSPTAEEAKKTXQAARDGPKANTATGERGHTGTXRNQSEDKRRKNTPEGKKAGEHRKN

SEQ ID NO: 28764 - protein, 130 aa, Zea mays
  misc_feature (18)..(18): Xaa can be any naturally occurring amino acid
  misc_feature (64)..(64): Xaa can be any naturally occurring amino acid
  unsure (1)..(130): unsure at all Xaa locations
LHACSRTQDCDIIACYHXRWPFGQTGSSHCSPMGGYHAGQDMVLIWYVARFKYPPHRVPLQLLXEAMNTTDGLTGLLKGLMLISRKVATPSLLHTVSGRDENWKNMSSFCVEDLPSLLKVSAVNPVHSLL

SEQ ID NO: 28765 - protein, 590 aa, Schizosaccharomyces pombe 972h-
MQTENQVNDLYPIAVLIDELKHDEITYRLNALERLSTIALALGPERTRDELIPFLDESIDDEDEVLSALADQLGNFVDYVGGPEYAHVLLSPLENLAATEETVVRDKAVDSLNKVCICLSQEQLEQYFVPLVQRLSTAEWFTSRASSAGLYCAAYSQSENPAVKVSLRQSFSHLCHDEAPMVRRPAATNCAKFVFLVTKQEAIDEFIPLFNSLSNDDQDSVRLLSFDIMVSLAEVLKSDSEIRHYLLQPLRSFVSDSSWRTRYMVAANFVKLAKVVGPSLIKDELIKPFVLLMKDTEQEVRRAIATQIPGFCELLDKRIVLEEIIPVIQELINDPAQHVRAALGMNIGALAPQLGKEKTTEYLLPMFLELLKDENPEVRLNIISKLEVVNKVVGIELLSQSLLPAIVTLAEDKQWRVRLAIIDYIPLLAQQLGVEFFNEKMGNLCMSWLEDHVYSIREAAIKNLRKLTEIFGLEWATETIIPKFLAMRSHPNYLYRMTTIFAISEIAPALNAEVIEKQILPTLEQLVNDPIPNIRFNVAKAFEVLKPVLAAGGDSTVYEQQIIPLLEQLTKDNDPDVQYFATQALEQTND

SEQ ID NO: 28766 - protein, 333 aa, Pseudomonas aeruginosa PAO1
MNERNGEAKRLALLEAVNLALHRAMAEDETVVVLGEDVGVNGGVFRATLGLRERFGFKRVLDTPLAENMIAGLSIGMAAQGLKPVMEIQFMGFIYAAMEQLVSHASRLRNRTRGRLACPLVLRTPMGAGIRAPEHHSEATEAMFAHIPGVRVLVPSSPARAYGLLLAAIDDPDPVIFLEPTRLYRMNPQPLADDARRLPLDSCFTLREGGDLTLVSWGASVHETQQAAERLAQRGIEAEVIDVACLKPLDLDTLEASVRKTGRCVIVHEAPKSGGLGGEIAASLYERVLFDLRAPIQRVAAADIPPPLYRLEPLYMPAVEDILAACDTVLGYA

SEQ ID NO: 28767 - protein, 196 aa, Oryza sativa (indica cultivar-group)
MKGLLKGLRYISQIFDPSVKEPEMQIGNPTDVKHVAHIGWDNASVTAPSWVIAAALLLPPDRAISHVSNCSDHWSQMNEFKPTAGGTEGSEAEENQGGGGGRADQAERPRRAGRGKERRDGGSEGSRRPPKTEVGENNCEGEAAAGAALKQRRRKARASGGTSSGRSKSSSVGGGGGPSAAARPAAAGDDDGDKCF

SEQ ID NO: 28768 - protein, 349 aa, Arabidopsis thaliana
  misc_feature (279)..(279): Xaa can be any naturally occurring amino acid
  misc_feature (288)..(288): Xaa can be any naturally occurring amino acid
  unsure (1)..(349): unsure at all Xaa locations
MAVTLRLTNSLAFSSHPLTSSVLFRGSKSIGTITKIASTIRTVKMAAFAGSDSETTSSTSRVIDSHLHIWASPQEAETYPYFPGQEPTLTGDVNFLLKNMEEARVDGALIVQPINHKFDHSLFLIDSVLKRYPSKFVGCCLANPAEDGSGITHLENLVLESNYRAVRFNPYLWPSGQKMTNAVGKALFSKAGELCVPVGFMCMKGLDLHIAEIEELCTEFPKTTVLLDHAGFCKVPESGEAKLAYSQLMKLSRFPQVYVKFSALFRISRTGFPYQDLSXPLLAQLVSXFGANRVMWGSDFPFVVLECGYKEAKEAVTIIAKEASLSSSEMDWILGKTLMQLFPGQWVLP

SEQ ID NO: 28769 - protein, 459 aa, Xanthomonas axonopodis pv. citri str. 306
MMAGRASIYALLAAIATTSIHASAADRAAEPNTQVPAGSMHYVADGFPDRIVATPAQDAATGFAVAWRTDASVERPWLELVVAGDSPDVGTPRRIRASTLTLASENGSSHHHRADVDGLQPDTMYAYRVQGQGTWGAWNHFRTAATATTPLTLLYFGDTQNKNLSLVSRVIRQAWRSAPDARLALFAGDLVSGKDGQDDNEWAEWFEAGRWLLEGTAVAPAPGNHEYHEEGEDTPQATRILGSHWPVTFALPRNGPSAAARTSYWFDYQGVRVAVLDGTSALDLGTGPAQAQWLDKVLADNPHPWSIVLIHQPFFSPRADRENEKLVEQVLPVIRRHKVDLVLQGHDHTYGRRGDAAGQATPVFVVSVAGPKQYRLSDMARTTMRPVGEDTQLYQVLRLDSQHLVYESRTATGRLYDAFELQRDSNGSKRLIEREAGRIAPRNCPRSATLKGRADRCWE

SEQ ID NO: 28770 - protein, 376 aa, Oryza sativa (japonica cultivar-group)
MLGAARRQLGSGPMLGQVLRRLRPATAAAADAARAYSAAAKEMTVREALNSALDEEMSADPSVFLMGEEVGEYQGAYKISKGLLDKYGPERVLDTPITEAGFTGIAVGAAYQGLRPVVEFMTFNFSMQAIDHIINSAAKSNYMSAGQISVPIVFRGPNGAAAGVGAQHSQCYAAWYAHVPGLKVLVPYSAEDARGLLKAAIRDPDPVVFLENELLYGESFPISAEVLDSSFALPIGKAKIEREGKDVTITAYSKMVGYALQAADILSKEGISAEVINLRSIRPLDRATINASVRKTNRLVTIEESFPQHGIGAEICMSVVEESFEYLDAPVERIAGADVPMPYAANLERMAVPQVDDIVRAAKRACYRAVPMAATA

SEQ ID NO: 28771 - protein, 463 aa, Lactobacillus sakei subsp. sakei 23K
MGLGTRLFRKESLERYLQQDQRLAKTLTAKDLIALGVGAVIGTGIFILPGTIAALHSGPAITLSFMIAAVVCAVAAMCYAEFSSALPVAGSAYSYGNIIFGELIGWLLGWALFLEYMLSVAAVSTGWSAYFVSFIEGFGVHIPKAITGSFDPAHGTYINLFAVLIVTLISVLLMSGTRSSTRINNLMVMIKIGVVLLFLVVGIFYVKSSNWQPFMPFGVSGVFKGASLVFFAYLGFDCVSASAAEVKNPQKNLPIGIIGTLVICTLLYILVAFVLTGMVSYRELNVANPVAFALQVVHQNWFAGLLSLGALAGMFTMMLTMTYSSSRLVYSIGRDGLLPKMLGKIETRHQTPINSVRVVTVIIATLGGLVSLDQLTNLVNIGTLIAFFFMSIGVIPLRKRKDIPNKDGFKVPLYPWLPLLSGLLCLFMLFELPAVTWMAAGIWFILGLIIYFSYGLKHSRLND

SEQ ID NO: 28772 - protein, 87 aa, Oryza sativa (japonica cultivar-group)
MGCDDKCGCAVPCPGGTGCRCASSARSGGGDHTTCSCGDHCGCNPCRCGRESQPTGRENRRAGCSCGDSCTCASCGSTTTTAPAATT

SEQ ID NO: 28773 - protein, 335 aa, Antirrhinum majus
MEGERVQAIASLSKYADTIPSEFIRSENEQPAATTLRGVVLEVPVIDLSDDFNEKILVKNISEASRDWGIFQVVNHGISNEVISKLQKVGKEFFELPKEEKEFVAKTPESGIEGYGTILQKEVEGKKGWVDHLFHKIWPPSAINYKFWPKNPPSYREANEEYTKKIRDVSDKLTNWLSLGLGIKGHELKAAMGGDDTIFLMKINYYPPCPRPDLALGVVAHTDMSFLTILVPNEVQGLQVFRDEHWYDVKYIPNALIVHIGDQIEILSNGKYKAVFHRTTVNKKNTRMSWPVFLEPHPEFEVGPIPELVSEESPSKYKTKKYKDYVYCKLNKIPQ

SEQ ID NO: 28774 - protein, 409 aa, Photobacterium profundum SS9
MTSLYCHRIKSSQSNNVKYKESVMSAIAVTDSQKDKKALNGAGLRGQSAGTTSLCTVGQSGTGLTYRGYDITDLAHHAEFEEVAYLLLKGQLPTQRELDNYKQALQTARGLPSALCLVLEAIPASAHPMDVMRTGCSMLGNLDQEYDFSEQGDKTDTLLALLPAIICYWYRYSHHGVRINTANSTQDSIGGYFLEMLTDEAPSELYKKVMHCSLVLYAEHEFNASTFTARVCASTLSDLHSCITAAIGSLRGPLHGGANEAAMAMIEQWQSAEQAEAGTLEMLANKDKIMGFGHAIYRESDPRNALIKEWSRKLSQDVNDTHLFEVSEKVEQIMKREKGLFPNADFFHASAYHFMGIPTKLFTPIFVMSRVTGWAAHVFEQRENNRIIRPSADYQGPEHQDWLPIEQRL

SEQ ID NO: 28775 - protein, 520 aa, Antirrhinum majus
MQHQYYSLITMDDISITSLLVPCTFILGFLLLYSFLNRKVKPLPPGPKPWPIVGNLPHLGPKPHQSMAALARVHGPLIHLKMGFVHVVVASSASVAEKFLKVHDANFSSRPPNSGAKHVAYNYQDLVFAPYGPRWRMLRKICALHLFSAKALNDFTHVRQDEVGILTRVLADAGETPLKLGQMMNTCATNAIARVMLGRRVVGHADSKAEEFKAMVVELMVLAGVFNLGDFIPPLEKLDLQGVIAKMKKLHLRFDSFLSKILEDHKINSSDETKGHSDLLNMLISLKDADDAEGGRLTDVEIKALLLNLFAAGTDTTSSTVEWCIAELVRHPEILAQVQKELDSVVGKNRVVKEADLAGLPFLQAVVKENFRLHPSTPLSLPRIAHESCEVNGYLIPKGSTLLVNVWAIARDPNVWDEPLEFRPERFLKGGEKPNVDVRGNDFELIPFGAGRRICAGMSLGIRMVQLLTATLIHAFDFDLADGQLPESLNMEEAYGLTLQRADPLVVHPKPRLAPHVYQT

SEQ ID NO: 28776 - protein, 293 aa, Zea diploperennis
IIESVGEGVTDVAPGDHVLPVFTGECKECAHCKSAESNMCDLLRINTDRGVMISDGKSRFSINGKPIYHFVGTSTFSEYTVMHVGCVAKINPQAPLDKVCVLSCGISTGLGASINVAKPPKVSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTRPMNFLNERTLKGTFFGNYKPRTDLPNVVELYMKKELEVEKFITHSVPFAEINKAFDLMA

SEQ ID NO: 28777 - protein, 371 aa, Oryza sativa (indica cultivar-group)
MQRLGDFRLPPFFNYPPYFTFVSVEPFSCFHLLAFYDIHNHNLLDYSTEKPLTSVKTFFNNSPVRETREKQVQLWKDLILDYCRSQKLYIISLEEDFPLFSNPKIERSLSHEAKEVFLAALVYEGRAEWMDKGHKKCLILWLRIQDWANYILNFVKDNGLEDSVMTVEEIRSGIETRGTELAGIDRGVLMRALKLLEQKGKAAIFKGTSADDEDRKRKSKGELGMASKRIQKELKDLQKDPPTSCSAGPVGEDMFHWQATIMGPSDSPYAGGVFLVTIHFPPDYPFKPPKVAFRTKVFHPNINSNGSICLDILKDQWSPALTISKVLLSICSLLTDPNPDDPLVPEIAHMYKTDRHKYENTARTWTQSDFE

SEQ ID NO: 28778 - protein, 455 aa, Bacillus anthracis str. A2012
MIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 28779 - protein, 369 aa, Escherichia coli CFT073
  misc_feature (91)..(91): Xaa can be any naturally occurring amino acid
  unsure (1)..(369): unsure at all Xaa locations
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTEXCGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFELARRFGATDCINPNDYDKPIKDVLLDINKWGIDHTFECIGNVNVMRAALESAHRGWGQSVIIGVAGSGQEISTRPFQLVTGRVWKGSAFGGVKGRSQLPGMVEDAMKGDIDLEPFVTHTMSLDEINDAFDLMHEGKSIRTVIRY

SEQ ID NO: 28780 - protein, 333 aa, Glycine max
  misc_feature (119)..(119): Xaa can be any naturally occurring amino acid
  misc_feature (140)..(140): Xaa can be any naturally occurring amino acid
  misc_feature (143)..(143): Xaa can be any naturally occurring amino acid
  misc_feature (145)..(145): Xaa can be any naturally occurring amino acid
  misc_feature (149)..(152): Xaa can be any naturally occurring amino acid
  misc_feature (155)..(157): Xaa can be any naturally occurring amino acid
  misc_feature (159)..(159): Xaa can be any naturally occurring amino acid
  misc_feature (163)..(163): Xaa can be any naturally occurring amino acid
  misc_feature (165)..(166): Xaa can be any naturally occurring amino acid
  misc_feature (172)..(173): Xaa can be any naturally occurring amino acid
  misc_feature (177)..(178): Xaa can be any naturally occurring amino acid
  misc_feature (180)..(180): Xaa can be any naturally occurring amino acid
  misc_feature (182)..(182): Xaa can be any naturally occurring amino acid
  misc_feature (186)..(187): Xaa can be any naturally occurring amino acid
  misc_feature (191)..(191): Xaa can be any naturally occurring amino acid
  misc_feature (193)..(197): Xaa can be any naturally occurring amino acid
  misc_feature (199)..(199): Xaa can be any naturally occurring amino acid
  misc_feature (201)..(204): Xaa can be any naturally occurring amino acid
  misc_feature (216)..(216): Xaa can be any naturally occurring amino acid
  misc_feature (224)..(224): Xaa can be any naturally occurring amino acid
  unsure (1)..(333): unsure at all Xaa locations
MATEMEELVSFLSSTSPQITKAAVDIVRGLTGSMEGLQSLANYSNALLPALSRLLTLPKEVSEAAAEALVNLSQNSSLAEAMVGIGLVKTTMDVLYKPECSIARLLVMLLVNLTQLEAXAASLLQTEDEKVHGLYVMKLXRSXCXTSHXXXXDPXXXVXKYLXTXXNSGKGXXLYLXXKXCXKRKXXYMLXSXXXXXNXGXXXXISDRSFESENQXHNLGLGSXYLWPASFVLSCNESEHDRTKMPLELGTALSIERELVNDPEIRIQALEAIYLIILQEAGRRAFWSVNGPRIVQIGYEDEEDPKVMEAYEQLGSLLVHSSSAEEPSSQTTK

SEQ ID NO: 28781 - protein, 220 aa, Bacillus anthracis str. A2012
MEPTGDPFNSIIKLETTSPSKPLNPMINAGALAITSMLAGKDNEEKMERILHFVREITDNPTINYSSKVANSELETAYLNRSLCYYMKQNGIIDCDIEELMDLYTRQCAVEVNCIDLARIGLIFAMDGYDPYKKKQIIPKHITKICKTFMVTCGMYNESGEFAIRVGIPAKSGVAGGIFGCVKGEMGIGIFGPALDANGNSIAGFKILELLSAQEGWSIF

SEQ ID NO: 28782 - protein, 575 aa, Saccharomyces cerevisiae
MQCRSIVHRLYSKISHVTTPIFYPNAKPHLGHLYSSLLSDVYHRWQLFKGNLSFFTTGTDEHGLKIQCASESNGFDQPKKFVDKLYPEFVQLDKIYGINYTRFIRTTDPDHIENVMKLWELCLKNGYIYMGEHKGWYSISDETFYPESKVIKDPKNDGKYLNTESKNEVVYQSETNYFFRLSLFNKKIVDHIRKNPDFIFPASKRDQILKELETGGTLPDLSISRPSARLKWGIPTPNDPSQKVYVWFDALCNYLSSIGGIPSILSNATEVVSRHYSDKSNVKGQLLIPYPKEVQRNTIHVIGKDIAKFHTVYWPSFLLAAGLPLPRQIVVHGHWLCNGMKMSKSLGNVVDPIDMARYYGADIVRWFLLENSKLEEDGDFQEAKLYETRELLVSKWGNLINRCCGSKFNIERAVMKFSDKANFQFQEIFQNEPIVSERIENLAKLLNKSQEVFDEKIAIFQYPQLLRHVWSIINDANTLVQNSKPWERELDQQDNIIFLAMETSRILSILCQSIIPSLSQSFLDRIDVSKEKRTINYARLGSDKTYGKQSNKKGREVPLKKIPFRLQEEQTNMRS

SEQ ID NO: 28783 - protein, 104 aa, Zea mays
  misc_feature (17)..(17): Xaa can be any naturally occurring amino acid
  misc_feature (53)..(53): Xaa can be any naturally occurring amino acid
  misc_feature (64)..(64): Xaa can be any naturally occurring amino acid
  misc_feature (72)..(72): Xaa can be any naturally occurring amino acid
  unsure (1)..(104): unsure at all Xaa locations
MSARAKGGKGLGKGGSXRHRKVLRDNIHGITKPAIRALAHRGGMKRICGLIYXETRSVLKIYLXENVIRDTXTYTEHARRKTVTAMDVVYALKRQGRTLYCFSR

SEQ ID NO: 28784 - protein, 769 aa, Oryza sativa (japonica cultivar-group)
MERFKVCEKETKTKAFSKEGLGQQPKTDPKEKAKAETRDWLNNVVSDLENQIDNFEAEVEGLSIKKGKQRPPRLVHLEKSITRHKAHIKKLESILRLLDNDELSPEQVNDVKDFLDDYVERNQEDFDEFSDVEELYSTLPMEKVEALEDMVSLAPSSLVKGVASVSTTAVLSTKSSVATSPTQATVSAAPSLSVSQDQAEETASQESNPESAPQTPPSKVGSQPSVPVVPTTISTSTAAVSVSAETISSPVRPIVPTTTAAVLPASVTARSAPENIPAVTSAPANSSSTLKDDDNMSFPSRRSSPAVTEIGLGRGITRGLTSQGLGSAPISIGPVSGNGSVSALTDLSKRNMLNTDERINSGGISQQLISPLGNKAQPQQVLRTTDTISSDSSNTNESTVLGGRIFSPPVVSGVQWRPQNTAGLQNQSEAGQFCGRPEISADQREKYLQRLQQVQQQGSLLNVSHITGISQKQFPSQQPNPLLQQFNSQSSSISSQAGIGLGQVQVPESGHTKSEEQQQSFAEDVSVESVATAGANKHMSEDDTKIPFSNPSASITEGTQLSRDPDLPAGQPLQPGMSSSGVGVIGRRSVSDLGAIGDNLSVASASTSHDLLYNLQMLEAAFHRLPQPKDSERVKNYIPKHPAVTPASFPQIQAPVVSNPAFWERMGGDSLSTDLLFFAFYYQQNTYQQFLSARELKKQSWRFHRKYNTWFQRHVEPQVTTDEYERGSYVYFDFHVIDDGTGSGWCQRIKNDFTFEYNFLEDELSVQTN

SEQ ID NO: 28785 - protein, 488 aa, Arabidopsis thaliana
MSSPRSNKPKIVNGPGGYILQDVPHLIDYLPDLPTYPNPLQDNPAYSVVKQYFVHADDSVPEKVVVHKDGPRGVHFRRAGPRQKVYFESDEVHACIVTCGGLCPGLNTVIREVVSSLSYMYGVKRILGIDVSLGGYRGFYAKNTIPLNSKVVNDIHKRGGTIIGTSRGGHDTNKIVDSIQDRGINQVYIIGGDGTQRGASVIFEEIRRRRLKVAVVGIPKTIDNDIPVIDKSFGFDTAVEEAQRAINAAHVEAESNENGIGFVKLMGRYSGYIAMYATLASRDVDCCLIPESPFYLEGEGGLFEFIERRLKDHGHMVIVLAEGAGQDLMCKSMESTPMDASGNKLLKDVGLWLSQSIKDHFKKNKMVMNLKYIDPTYMIRAVPSNASDNVYCTLLAQSAVHGAMAGYTGYTSGLVNGRQTYIPFYRITETQNNVVITDRMWARLLSSTNQPSFLGPKDTSEEKKELPETPLLDDGAVDIPPVTKEVTK

SEQ ID NO: 28786 - protein, 233 aa, Triticum aestivum
  misc_feature (170)..(170): Xaa can be any naturally occurring amino acid
  unsure (1)..(233): unsure at all Xaa locations
MKKLYQGKGRRVHPAPAPGPDAPAVALAMLPATLLALVAALTAEEQEVLAYLLSGGAGGAAAGAGGGRCRRLNGPHQPEMGCGCFGCYKSFWARWDASPNRHLIHRIIDAVEEGNGGGGEGAPKGAGGPGGATRRGPRRRRRGRRRAVRHPRRPSRTPDPRKAPGRVPRXDHPRPRGCCASDGGEDGDYEGDEDDGADSLYGGEEALTDDSDCAGASNSAEKSAVGKLVRFIG

SEQ ID NO: 28787 - protein, 172 aa, Lolium perenne
FAMAYYVINYSKLRIWEFVEYEKMVYLDADIQVFDNIDYLFDLEAGSFYAVKDCFCEKTWSHTPQYKIGYCQQCPDRVAWPEHDLGVPPPPLYFNAGMFVHEPSLATAKALLEKLVVTDPTPFAEQDFLNMFFRDVYKPISNVHNLVLAMLWRHPENVELGKVKAVHYCAAA

SEQ ID NO: 28788 - protein, 356 aa, Zea mays
MEKAGSLPVPSVQAMVAAGRHAPVPPRYLRPDLAADVVVADDATTIPIIDFQRLLLVDPEESARLHAACQDWGFFQLINHGVPDDVMEAMKASTQSFFALPAEAKQQYRQQAGQLEGYGQLFVVSEDQKLDWADVLYLNTQPPEHRNLSFWPAGESFRQTLDTYSAAVKHVADRLLGAMYMNLGLLSSMDMDPERGAGIQSVRMNYYPPCAEAADKVLGFSPHSDSDLLTLVLQVNQLQGLQIKRPPDGGGAWAWLPVTPLQGAFVVNVGDVLEIFTNGRYRSVEHRALVNAHTERLSIAAFHSPSIHATIGPLPELLGDQEVPKYKTLDHQSFITLFFSAKLQGKSFLERMKKLS

SEQ ID NO: 28789 - protein, 172 aa, Lolium perenne
FAMAYYVINYSKLRIWEFVEYEKMVYLDADIQVFDNIDYLFDLEAGSFYAVKDCFCEKTWSHTPQYKIGYCQQCPDRVAWPEHDLGVPPPPLYFNAGMFVHEPSLATAKALLEKLVVTDPTPFAEQDFLNMFFRDVYKPISNVHNLVLAMLWKHPENVELGKVKAVHYCAAA

SEQ ID NO: 28790 - protein, 334 aa, Triticum aestivum
  misc_feature (159)..(159): Xaa can be any naturally occurring amino acid
  misc_feature (183)..(183): Xaa can be any naturally occurring amino acid
  unsure (1)..(334): unsure at all Xaa locations
SPTFYHRLRPNQLRPLHTTRALASFAASSPRAPPARRGTRAMASQKFPPQQQDCQPGKEHAMDPRPETLIKNYKSANKLQGKVALVTGGDSGIGRAVCLCFALEGATVNFTYVKGHEDKDAEETLQALRDIKSRTGAGEPKALAGDLGYEENCRRVVEXVASAHGGRVDILVNNRGGAVRPGXITEISEQDLERVFRTNIFSYFLMAKFAVKHMGPGSSIINTTSVNAYKGNATLLDYTATKGAIVAFTRALSMQLAEKGIRVNGVAPGPIWTPLIPASFPEEKVKQFGSEVPMKRAGQPSEVAPSFVFLASEQDSSYISGQVIHPNGGTIVNS

SEQ ID NO: 28791 - protein, 432 aa, Prochlorococcus marinus str. MIT 9303
MASSDDAKLRPLPNTAALSGVLEAFAFFRDPAFAQKRFKRHGNVFETSLLGQPMVFIQGGQAISDLLAQPNAVEGWWPESVRKLLGSHSLANRNGASHRARRRVIGQLFSASALQRYSAGIISMVKDLADELQAATTALPLAERMRRFAFSVIATTVLGLEGTDRDELFVDFEIWTRALFSIPIALPGSSFAKALKARERLLKRLQKVLLKASNGNGGLDLLAGGLDEAGIPLTDEDVVEQLLLLLFAGYETTASSLSCLMRELLLNPQVETWLREEIDGLDWPPAPEQATTAYDQVNAPKLDAVVSEIMRLTPAVGGFFRRTKCALVIDGVEVPKNRVVQVALAASNRHGAGDLEAFRPQRHLDDGCSATLLPFGGGERVCLGKPLAELEIRLMVVGLFHQLRLHLIPDQDLTLQMLPSPTPRDGLLTKVL

SEQ ID NO: 28792 - protein, 125 aa, Photobacterium profundum SS9
MVETINTNNAPAAVGPYVQAKKFGNMLYTSGQLPLNPETGKMPEDVAEQTKQSLANVEAIVNEAGLTKADIVKATVFVKDLNDFGTVNEVYAAFFGENCPARSCVEVARLPLDAKVEIEVIAVAQ

SEQ ID NO: 28793 - protein, 400 aa, Nostoc punctiforme PCC 73102
MQFAKRLQPLQSNVFADMDRAKAIALAAGQEVIDLSLGSSDLPVEAHVIEAIAQSLHDRSTHGYLLFNGTLGFREAAANWYEQKFGIKVDPQTEVLPLIGSQEGTAHLPLALLNPGDFALLLDPGYPSHAGGVHLASGQIYPMPLRAENAFLPVFADIPAPVLAQSRMMVLSYPHNPTSAIAPLSFFQEAVAFCQQHNLILVHDFPYVDLVFQETGEWADSSPNPKSLVPSILQADPEKSVSIEFFTLSKSYNMGGFRIGYAIGNAELINALRQVKAAVDFNQYRGILNGAIAALTGPQAGVKSAVAIFQQRRDAFITALHSIGWNVPTPKATMYIWAKLPSAWSQNSIEFCTQLVKQTGVAASPGAGFGKSGEGYVRFALVHEPPLLETAVERIAQFLY

SEQ ID NO: 28794 - protein, 497 aa, Spinacia oleracea
MAFPIPARQLFIDGEWREPIKKNRIPVINPSTEEVIGDIPAATAEDVEVAVVAARRAFRRNNWSATSGAHRATYLRAIAAKITEKKDHFVKLETIDSGKPFDEAVLDIDDVASRFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFSNDLERCERITKALEVGAVWVNCSQPCFVQAPWGGIKRSGFGRELGEWGIQNYLNIKQVTQDISDEPWGWYKSP

SEQ ID NO: 28795 - protein, 574 aa, Fusobacterium nucleatum subsp. vincentii ATCC 49256
MAFMKIKGIPASPGIAIGKAFLYKENKLEIVEKSNLSKEEEIERLVKGREIAKKQLEEIKENTLKKLGKDKADIFEGHITLLEDEELFSEIDSKISQKKCTAEFALNEAIDEYATMLANLEDTYFKERAGDLRDIGKRWLYGVMNEQIVDLSKLKPETIIVAKELNPSDTAQINLDNVLAFVTEIGGKTAHSSIMARSLELPAVVGVGEVLDKLEDNQILIVDALKGEVIVSPDVETLQIYKEKREKFLKEKEELKALKDKEAISKDGIKVDVWGNIGSPNDVKGIISNGGFGVGLYRTEFLFMEKDSFPSEDEQFEAYKIVAEELKAYPVTIRTMDIGGDKSLPYMELPKEDNPFLGWRAIRVCLDREEILRTQFKALLRASKYGQIKIMLPMIMDIVEVRKARAILEECKKELQEKGIDFDKNIMLGIMVETPAVAFRAKYFAKECDFFSIGTNDLTQYTLAVDRGNEKIANLYDTYNPGVLQAIKMLIDGAHEGGIKISMCGEFAGDENAVALLFGMGLDAFSMSGISIPRVKRIIMKLDRKECENLVEKVLTLSTASEIKEEVKKFMKKI

SEQ ID NO: 28796 - protein, 424 aa, Crocosphaera watsonii WH 8501
MRIKRIIASEMLDSRGNPTVEAQVMLEDGTVGSALVPSGASTGEKEAVEMRDGDKSRYKGKGVLKAVENANNHLAPALIGMDVTQQRAIDQTMIDLDGTPNKAKMGANAILAISLAAARTAANYLKMPLYRYLGGTNASLLPVPCMNVINGGSHADNTVDFQEFMIAPHNAPSFAEAIRMGAETFHTLKGLLKDKGLSTGIGDEGGFAPNLKSNEDAIEFIIEAIEAAGYKPGEDISICLDPATSELWKDGKYLFFKSDNSTKTPSEMVALWQDWMNKYPIVSLEDGMGENDWDGWKELTDKIGDKVELVGDDLFCTNPTILAEGIEKGVANSVLIKVNQIGSLTETLDTIELAKKHNYKCFVSHRSGETEDTTIADLVVATSAGQIKTGSGCRGERIAKFNQLLRIERDLGKAARFAGKAAFL

SEQ ID NO: 28797 - protein, 337 aa, Triticum aestivum
  misc_feature (123)..(123): Xaa can be any naturally occurring amino acid
  unsure (1)..(337): unsure at all Xaa locations
MAGTETTSLQVPMAFKDADDGTIPVRPPTEYAAAVASLPTNPASKLKLRCYQGVWVLEDWVPGIIAMQRSFSTRPGDVVLASFPKCGTTWLKALIFATMARAAYPPASPAHPLRRLNPHDCGXLLDRLFAVGREAVLERLPSPRLMCTHMPLSVLPPSISRGPDCKIVYICRDQKDMVVSMWHFANRVQPDISLQEVFETVCEGTCFAGPVWDHILGYWRVSNAEPNRVLFLTYEQMHQDPVDKVRKLAQFLGRPFSDTEEEAGVVAEIVELCSLEHLKNLEANKKGSQGVFLKFPYDSYFRKGVVGDWVNHLTPEMAKCLDAIFEEKFKGSGFTLL

SEQ ID NO: 28798 - protein, 440 aa, Coprinopsis cinerea okayama7#130
MANGVHTNGAQKQDRSNLIPFSSRLKEGRALAQDVWSIFAAANLPAECINLGQGYMNFAPPKWVTKAAEDALQDVAPNHYSHPRGRIRLREALKNFYSPLLNRDLDVESEILVTSGANEGQYSVFTAFLEQGDEVIMFEPFFDQYLPSVTFNGGKPVYVPLHPPTSSKLQSSSGEWTIDFDELKCHRRAVTPRTKMIIVNTPHNPVGKVFTKEELEEIAAIAEENNLLVMSDEVYDSLVFDGKEHFRIATLPGMWDRTVTVGSAGKAFAATGWRIGWLLGPPSIIQPTLAATTRIVFCTNSPLQEAAACGLEQAQERKFFETQLAEYAERRAILCDAFDRLGLKYSLPEGSYFVLLDISKVKFPEDYPFPKSVLGRGRDFRACWFIAVEIGVSSIPVSEFYCEEHARIGEAYARFAFCKDIDTLKAAADKLQKLKAYIEN

SEQ ID NO: 28799 - protein, 489 aa, Salmonella typhimurium LT2
MGSKTKTTEAPALRRELKARHLTMIAIGGSIGTGLFVASGATISQAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 28800 - protein, 826 aa, Oryza sativa (japonica cultivar-group)
MAYLGGDPGRGGGAPPGMTPWPGPPPQPGQPAVVYTALHQGAYQPGVAQVVYWAPSPGAPSLGGIRAPPAPYQPAQVAAPQAAAPFAAALAKEVEQKLFVTENALGPPAAAAAVSKKGPPTLGDRDCHFCASGCFPEMINGGTEEPRFCGGLIQMCNVENALRDVQRRTTELPVRYAQGRTVLDSQIGLLGEIDSNINATGLQHTHDLMKKMKFAASATPHPRRVLAVALALMVAFAVGPMVALAKCEQQAHAVASLCGGTGIYARCCFALKRSLDGGDPLCLCSLANNREVAEMGLNSTRILSLYRKCEGNVFPVLPAGGCEEVPALSPSPPPLHGSVMPPPLPPATVEPVISAPMVEPPPPPAMITPLPPSTPVFTLPPPPPVTTAPSTALPAGASAAAPSTGVLRRIYQALIGLLCLVAGFLLVAVFVVVRKYWKPQLNNDVEMGSSNAADQSAIENAKKAAAEAQSSAEAAASAAAGSLATAQAASGAAQAAQAATEEVVTVQANAAEQAVLFVEALGRAAQQISTCTITLGQLLQLVSQIIQAVRAAQGGAASAAAAITGLFARFGEIFGRVGAATAFVEAQAVAAQGAPSDLIDIDCINRPGGDRGVSSFDEGGSNEDEDEANVERSTSRTSNRIRKSNVRYSEDVWVLDPPARASITEGTQLSRDPDLPDAAYHRLPQPKDSERVKNYIPKHPAVTPASFPQIQAPVVSNPAFWERMGGDSLSTVLFFAFYYQQNTYQQFLSARELKEQSWRFQRKYNTWFQRHVEPQVTTDELSAKSLTHNLWKKTAKSDGCRNSNSSRTKLEFRETKNRVKQSVCAA

SEQ ID NO: 28801 - protein, 1409 aa, Aspergillus oryzae
MESSTATSSTTNWPSEEHKNSMAEAETSPLASKFEDILHRSLKSGYKPRRLGVTWTDLTVKAKSAEATINENVFSQLNILRRLQQHRQSMPLKTILHQSHGCVKPGEMLLVLGRPGSGCTTLLKMLANRRTGYEEIEGDVWYGSMHHEEAAENYAGQIIMNTEEEIFFPTLTVGQTLDFATRLKVPAHLPSNVVNAEAYRAEMKEFLLESLRIPHTAETKVGNEYVRGVSGGERKRVSILECLASGASVYCWDNSTRGLDAASALDWAKMMRTMADVHGSSIIATLYQAGNDIFRLFDKVLVLDEGKQIYYGPANEAEQFMESLGFECSEGANIGDYLTSVTVPLERRIRSGYESTYPRNAEAIATSYCKSSAKAQMTSEYDYPTSELSQQRTKDFKESVTLEKCRPRSANTVNFATQVRACIIRQYQVLLGDKKTFAMKQGSTLIQALVAGSMYYQVKPDTSGLFLKAGALFWSILYNSMSAMSEVVDSFSGRPIVVKHDAFAYCKPAAFCIGQIAADIPITIFQITLWSVILYFMVGLKMSASAFFTYFVVLFACAMCSTALFRAVGAVFRTFDGASKVSGYVVTIMAMYAGFQIQYTQMRPWFGWLYWLNPVAYAFDGLMSNEFRDREIDCTGGNLIPHGESYASVSMSYRSCAGVRGATPGFASLTEEQYLGALSYSYTHLWRNFGILWAWWVFYVVVTIGATMMWKSPSESGAQLLIPRERLAHHLQLGLDDEESQTPEKYCHGHHSQEKMDGSTPLPTPGAEAHLAKNTSIFTWKNLTYTVKTPSGPRVLLDNVHGWVKPGMLGALMGASGAGKTTLLDVLAQRKTDGKIEGSIMVDGRPLSVSFQRSAGYCEQLDVHEPYATVREALEFSALLRQPHNTSEKEKLGYVDVIIDLLELGDIADTLIGKPNAGGLNIEQRKRVTIGVELVAKPSILIFLDEPTSGLDGQSAFNTMRFLRKLANQGQAILVTIHQPSAQLFYQFDTLLLLAPGGKTVYFGEIGENASTLKEYFERYGSPCPNHMNPADHMIDVVSGRASTIDWRRVWLESPEYQQSLVELDRLIRDTASRESVDNPSSDDNEYATPLWYQTKIVLRRMNIALFRNTNYVNNKIYLHIGLALFNGFSYWMIGNTVNDMQLRMFTIFVFMFVAPGVVNQLQPLFIERRDIYDAREKKSRMYSWKAFVTALIVSEFPYLCVCGVLYFLCWYYTVGFPAASEKAGAALFVVVLYEFSYTGIGQFVAAYSPNAVFAALVNPLLVGIMVSFCGILVPYDQIIPFWRYWMYYMNPLTYLVGSLLVFNIFDVDVKCADSEFAVFNPPSNMTCLDYLSSYLEESDANLVNPEARSECRVCPYTSGGGYLKAINLNDYYFGWRDVGIFVIFIFSSYGLVYLFMKLRTKASKKAES

SEQ ID NO: 28802 - protein, 189 aa, Mycoplasma gallisepticum R
MTSMNRFIKSATSLKDCINDSKKEVCLIGRSNVGKSTIINGLANAKIAQTSKTPGRTVTMNFYEISNQRIVDLPGYGYARIKKSQKEEISLFLSDYLNHRKNLVGIFLILDLGVITDQDIEIVRLLTTLDVEYYIVFNKIDKYPKSAYINNKEKILDALKVNEDRILLISAKNKQNLNNLMLKIIDVIS

SEQ ID NO: 28803 - protein, 173 aa, Yarrowia lipolytica CLIB122
MSHQEEHYAWRQTLQDITITFPVPPGTRGKQMDIKFTPTTISAGVVGQPPVLQGDLFGKIAPEESTWTVEDQREVTISIEKVHNQEWWPHVVTTAPKIDVSQIEPEKSNLSDLDGETRAMVEKMMYDQRQKEMGQPTSDEQRKQQLLENFKKQHPEMDFSKAKINEGFGNMPQ

SEQ ID NO: 28804 - protein, 128 aa, Synechococcus elongatus PCC 6301
MTPKITPVLFGNWLMSEDTIFGKIIRREIPADIVYEDDLCLAFRDVAPQAPVHILVIPKQPIANLLEATAEHQALLGHLLLTVKAIAAQEGLTEGYRTVINTGPAGGQTVYHLHIHLLGGRSLAWPPG

SEQ ID NO: 28805 - protein, 1073 aa, Pseudomonas syringae pv. phaseolicola 1448A
MPKRTDIKSILILGAGPIVIGQACEFDYSGAQACKALREEGYRVILVNSNPATIMTDPAMADATYIEPIKWQTVAKIIEKERPDALLPTMGGQTALNCALDLEREGVLEKFGVEMIGANADTIDKAEDRSRFDKAMKSIGLACPRSGIAHSMEEANAVLEKLGFPCIIRPSFTMGGTGGGIAYNREEFEEICARGLDLSPTKELLIDESLIGWKEYEMEVVRDKKDNCIIVCSIENFDPMGVHTGDSITVAPAQTLTDKEYQILRNASLAVLREIGVETGGSNVQFGICPDTGRMVVIEMNPRVSRSSALASKATGFPIARVAAKLAVGYTLDELSNEITGGKTPASFEPSIDYVVTKLPRFAFEKFAKADARLTTQMKSVGEVMAIGRTFQESLQKALRGLEVGVCGLDPKLDLSHPESMSTLKRELTVPGAERIWYVADAFRAGMTVEEIFAMNMIDPWFLVQIEDLVKDEEKVKTLGLSAIDRDLMFRLKRKGFSDARLAKLVGVTEKNLRTHRHKLDVFPVYKRVDTCAAEFATDTAYLYSTYEEECEANPSARDKIMILGGGPNRIGQGIEFDYCCVHAALALREDGYETIMVNCNPETVSTDYDTSDRLYFEPVTLEDVLEIVRVEKPKGVIVQYGGQTPLKLARALEAAGVPIIGTSPDAIDRAEDRERFQQMVERLNLRQPPNATVRSEDEAIRAAAKIGYPLVVRPSYVLGGRAMEIVYQEDELKRYLREAVQVSNDSPVLLDHFLNCAIEMDVDAVCDGTDVVIGAIMQHIEQAGVHSGDSACSLPPYSLPAHIQDEMREQVKKMALELGVVGLMNVQLALQGEDIYVIEVNPRASRTVPFVSKCIGVSLAMIAARVMAGKTLKELNFTKEIIPNFYSVKEAVFPFAKFPGVDPILGPEMKSTGEVMGVGDTFGEAFAKAQMGASEVLPTGGTAFISVRDDDKPLVEAVARDLINLGFEIVATAGTAKLIEAAGLKVRRVNKVTEGRPHVVDMIKNDEVTLIINTTEGRQSIADSYSIRRNALQHKIYCTTTIAAGEAICEALKFGPEKTVRRLQDLHAGLKA

SEQ ID NO: 28806 - protein, 280 aa, Oryza sativa (indica cultivar-group)
MPPPRLANRYFLVRAGESVYEGQGVVRTNPVSKTSVDSGLSPAGLRQAARAALELQRLGACEDDCWIWPSITQRAYQAAEIIAAANEINRSHIVPEYSFLDARGLGAFEGKSLETLPEVTLGARLRIDAIGEILVANCHEGLKNLWLLIALLLVYASDSISPDIKPPPISDGTPNESVADVFVRVTQLMSILETQYSGDTVVIVSPDSDNLSILQAGLIGLDLRSSSYRPMGKGVHCGNPAHLVTLFTIQFTDPLLLVNHAQGYVQYNLHQGVVQSRYKL

SEQ ID NO: 28807 - protein, 846 aa, Oryza sativa (japonica cultivar-group)
MASPPTSESAITSAGSASASGFDCLPDDLVHHVLSFLPAPDAACTSLLSRRWRNLWVSMPCLDIDVSDFHDASQFDRFMDHVLHLLDDSVPLRSFRLRSCWIDDSAVSWLRYAVKRKVPVLEYAERQGYFIHGCHDLISASSYLTKVVLEHVVLHDCHFGPLNNGCPALENLELLEVNIQFTEISSTSLKHLRIVNYYEDEDLSEDEDEDLSDGHHIEYNILGVLSHARSLKLVAPLREALFEGCLLTCPVFNNLKCLVFGDWCMDFDLYPLRCVLKQSPILEELCVELREKECEYCKEKAPPFSYSYGEILPFKCHRLKTVKIKCGERDERFIALVKLFFKISVCIEKFDLDRCVTTQPDRYLIIVTSGGLNQQRTGIVDAVVAARILNATLVVPELDQRSFWKDSSNFSEIFDINWFISFLAKDVNIIKEPPEKGGKAVKPYKMRVPRKCTPKCYLNRVLPALLKKHLFLWLKFRKILSHIAHTTFSLVIQVIRLTKYDYRLSNKLDKDLQKLRCRVNYHALRFTDPIQELGEKLIKRMREKSRHFIALHLRFEPDMLAFSGCYYGGGEKEKRELGSIRKRWKTLHIGDPEKGRRQGRCPLTPEEVGLMLRALGYKSDVHIYVASGEIYGGEDTLAPLKLLFPNYHTKETLSTEEELTPFLAHSSRMAAIDFIVCDGSDAFVTNNNGNMAKILVGRRRYFGHKRTIRPSAKQLYPLFMNRSNISWDAFSSQVQTIQKGFIGEPMEITPGRGEFHANPAACICEKTGIKSVVGSDSRSNRETVNSTEISNKPIGGPTYPIYTDEEADRPDTEDDPSGIGEMIDMEAEDDSLASRVDSVLEEILSD

SEQ ID NO: 28808 - protein, 174 aa, Zea mays
MVYHSSFADDDGITKACSCPLLPLKTHIKGPAPASDPDKADIVDEAITFFRANVFFKNFHVKSSADKLLIYLTFYINIALKRLEGCRTLAVGTKAIINLGLEKVPVPGEPGFPFPGLFTLPQSQEEAELLRNYLKQIREETSGRLLNCAYRANGFPNKWWLAFAKRKFMNIVIL

SEQ ID NO: 28809 - protein, 524 aa, Candida glabrata CBS 138
MFRSTTSNVLTRALRTRNAGVSSVMVLRAYSHLPLHVPIKLPNGLEYEQPTGLFINNQFVPSKQHKTFEVINPSTEEEICHIYEGREDDVESAVQAADTAFKNGSWTDIDPFERGQALYKLAELIEKDKEIVASIESLDNGKAINSARGDVQLVINYLKSSAGVADKIDGRLVNTGSNYFNYVKKEPLGVCGQIIPWNFPLLMWAWKIAPALVTGNTVVLKTAESTPLSALYVSKYIPKAGIPPGVINIVSGFGKIVGEALTTHPKIKKIAFTGSTATGKHIYSSAAQTLKKVTLELGGKSPNIVFADADLKKAVQNIILGIYYNSGEVCCAGSRVYVEESIYDEFAQEFKTASEALKVGNPFDESTFQGAQTSQMQLDKILSYVEIGKKEGATLITGGERIGEKGYFIKPTIFGDVTEDMRIVKEEIFGPVVTVTKFKDLDHVVQMANDSEYGLAAGIHTTNINSAVKVADRLKAGTVWVNTYNDFHQNIPFGGFNASGLGREMSKEALDGYLQAKAVRVKLD

SEQ ID NO: 28810 - protein, 370 aa, Bacillus anthracis str. A2012
  misc_feature (324)..(324): Xaa can be any naturally occurring amino acid
  unsure (1)..(370): unsure at all Xaa locations
MQVAKTLEQTFRQKGIKDVIVCDLFGESHPVITDITKYLYLKSYTIGKELYRLFYYGVEKIYDKKIASWYANFGRKRLKLLLQAEKPDIVINTFPIIAVPELKKQTGISIPVYNVLTDFCVHKIWIHREVDRYFVATDHVKKVMVDIGVPAEQIVETGIPIRSSFELKINPDIIYNKYQLCKNKKILLIVAGAHGVLGSVKELCQSFMSVPDLQVVVVCGKNEALKQDLVGVQETNPDALKVFGYVENIDELFRVTSCMITKPGGITLSEAAALQVPVILYKPVPGQENENAMYFERKGAAVVIRDDSEVFAKTEALLQDDMKXLQMKEAMKSIYRPEPADHIVDTILAENHVEPNHIPIKSPALAQSFT

SEQ ID NO: 28811 - protein, 215 aa, Oryza sativa (indica cultivar-group)
MDRLQQRRRRHEALTGRRRGGGGGMSRRHGRFRFATGGGDGDEECAGVAVVDQADCTAQSCRSCVAVSLADCIALGCCPCAVVSLLGLAFVKLPLAVARRCARRLRRRQGRLRQKKRVRDLDAAKNAAGGGHQEPLPGGAAAASKGEDGDVVVVAAAAAASPSSDDAENVWLELYQVGRWGFGRLSVSAANPPVRPSYVVATARNADCAADGDVS

SEQ ID NO: 28812 - protein, 583 aa, Yarrowia lipolytica CLIB122
MTERLCTIAALLNPNVYPFCLSNSSVIFSPGEVPYDVLASTELNPLIQYTRSAEPPTVSVNMLRSSKRYMTTMSNRQPVASRRALYGLASGLVLATAYMGHQYLMDPIALDSRGINTNAAGGYDPFGRRMNIMNPERVNARLREHEQSHFVERGRGVLRYDMAQLPSNSPIEDDYSDRVVSVALNEAGNANASSDWMFWGLYDGHGGWTTSAKLREELINYVIRQLDAGYSDAGKTLGDNIRRTPSPETIDLAIKRGFLALDDEICIHSINRLLKNPQKGQSPETLAPAVSGSCGLLAFYDTLSHTLRVAVTGDSRAVLGSKSSSGWTARALSVDQTGSNQREADRIRKEHPGEEDRVIRRGRVLGGLEPTRAFGDARYKWTRDLQDKVARAFFGRSTPPELRSPPYVTAEPEVTTTKVKSGDFLVMGSDGLFEMLSNDEVVSLVVQWMETHPITESSTAASAKSGGMWDKMFGSKDSTKVVDLTVDQDAMKPPFRHQGAVLKPTVEDENVATHLIRNALGGADREQLSMLLSIPAPQSRRYRDDLTVTVVFFGDEKAPENGGIRGNVAATSGGVGTQEKAKL

SEQ ID NO: 28813 - protein, 181 aa, Zea mays
MALRSVKTPPFVTPTAVVSSSIINKPQSFRFVSKPSASLAVHNLHQPISIIRSNLIPKLKPASSAAKFRCSASALTPQLRDTLEKLVNSEKVVLFMKGTRDFPMCGFSNTVVQILKNLNVPFEDVNILENEMLRQGLKEYSNWPTFPQLYIGGEFFGGCDITLEAFQSGELQEVVERAICS

SEQ ID NO: 28814 - protein, 468 aa, Oryza sativa
QVKNVIAAAHKAQRQFARVPAATRGAVMKDICAAYIHHKDALGALISYEMGKVLSEGKGEVQEVIDVADMAVGLSRSIQGSVLPSERPGHLIYEIPNPLGLVGVITAFNFPVAVHGWNFCLSFVCGNATLWKPSPTTPLTAIATTKLIVDVLKKHNLPTALAALVCGDVETGQTLTRDERIQLTSFTGSEHIGKLVAQDVAARLGKILLELGGNNAAIVLDDADLELAVPAVAFAAVGTAGQRCTTTRRLLLQRNVADKFLERLVKFYTSLQSKGLIGDPTDSSVLCGPLHSQRAVTKYWETLDTIRSSGGKILFGPDSPSSPGLASHLVESKGNYVLPAITMPASSTDKVFQEEVFAPILNVAVFDTLDEAIELNNSVRQGLSSSLFTTKLTNIGEWQGALGSDCGIVNVNVSTSGAEVGAGFGGNKATGWGRECGGDAWKQYCRWATSTVNYSSQVALAQGVKFDA

SEQ ID NO: 28815 - protein, 287 aa, Yarrowia lipolytica CLIB122
MSVSQTDSTVTVTIGSSEVKILRYGATVLSWTIDGKEQLWLSESAKLDGSKAVRGGIPLVFPVFGKSTEGPTSALPQHGFARTSTWEYLGQTSEKPVAAIQFGLGPENLSDEAKKQWDYNFTLIYTVTIDDANKTLETRMSVENAEQNKPFDFNILFHTYLRVPEIANVEVTGLQAVPVKDKVTVSSYVEQAAKVTVSGEVDRVYENVPGAVNVDVENKPYLTVTRDNINDVVVWNPWTEKAEGLADFTPKQGFHHMICIEAGDVAKWQKLAAGDKWEGGQKIKAHL

SEQ ID NO: 28816 - protein, 296 aa, Kluyveromyces lactis NRRL Y-1140
MPIEETETEIILTHPNNSSTKARILKYGATVFSWELKGEEQLWLSTAAKLDGSKPVRGGIPLVFPVFGKNHDDEHLSKLPQHGLARNSVWEFLGQVKSNPPTIQLGLGPEFANEELTNLWPFEYSLVLSVELGDEYLKTEIEVLNTSTTQNLKFNWLFHTYLKIDDIEDTLVSNLSSTKLYDQLLKESYIDRQPVISVHEELDRIYQNVDEDRIIQVIDKGYPIHTLKRHNLPDTVVWNPWVEKSKGMADFEPKDGFKNMVCVEPGHVHDFVVLAPGENWVASQILYKDELKFQKV

SEQ ID NO: 28817 - protein, 114 aa, Crocosphaera watsonii WH 8501
MKLINFLVRLTMLLFFLLITLIKPVQAEDINDGAKIFSIHCVGCHPQGKNIIRRAKNLKLRALKRNKVDSLDAIINLVTYGKNNMSAYEDKLTKEQIESVSKYVLQQAQNNWHT

SEQ ID NO: 28818 - protein, 199 aa, Vibrio parahaemolyticus RIMD 2210633
MSKKILVPIAPGTEEMEAVTVIDLMVRAGYDVTVASAAFDGALTMKASRGVTLTADCKLVDIADDEFDAIVLSGGVGGAETFRDSTVMIEILKQHMYESKLVAAICAAPALVLQHHNLYPDALMTCHPSFQSHIPEDKWRAKRVTMDVNHNLLTSQGPGTALEFAMEIIIKLSGKEHGWMVAEPLVTIPTLHYHEFGEE

SEQ ID NO: 28819 - protein, 170 aa, Magnetospirillum magnetotacticum MS-1
MVLPATPARPFGAVLTAMVTPMTPDGAVDLEAAARLAKRLVDDGNDGLVLSGTTGESPTTHAPEKQDLVRAVVEAVGDRAAVLAGAGSNDTDHALRMAEQAAEAGADGLLVVTPYYSRPGQEGVYRHVVAIAEAADLPVMLYDVPGRTGVRIAPDTYARLAAHERVVATK

SEQ ID NO: 28820 - protein, 194 aa, Zea mays
MSETGHTVQVTNLSSRVSESDLYEFFSFSGPIEHVELIRSGEYGATAYVTFKERFALETAVLLIEALTVAQDIVKTMLAKGYVLSKDALAKARAFDESRGLTAAAAAKAAELSKRIGLTDRVSAGVGAMRSVDETYRVTETTKTVATATGRTAAKVVNGIVTSSYFSAGAMMLSDALTRAAKAAADLAAHGRQS

SEQ ID NO: 28821 - protein, 1342 aa, Cochliobolus heterostrophus
MSQSSDQIPQDGSSAPDNGHHQFSTVSPVAEEPSSPSAATDAIDFAATQPSQRSRASTTETTGPLSPSTSDRVFPIRSAISVDPSPTPKSQNAQGDYFHPFSRTNDPRLATDIRRASQGSLTSQSSHASQRAWAMRHGPGKTAQRGPQPIPSQLFNDMSSNKSNGSINDDSRSPSFKPEQAPSTKSGISSVDMGDLVTHRFRHVSTEGGHMIITGREGETLQRCEDEPIHLPGAVQGFGLLVALRDDPDGNLQVRIVSENSKRILGRTPKELFALESFTDILSEEQADNLLDHIDFVKDEESNVTSNGPEVFTMSIKIAGHTRTRKLWCAIHTNEANPGLVICEFELEEDPLYPLVPPNNNTPDLPEDTLSSQPTADEFLESTEIKSKPLRILRSARKRKGEAAAMEVFNIMSQVQEQLAAAPSLERFLKVLVGVVKELTGFHRVMIYQFDQSFNGRVVTELVDPRATKDLYKGLNFPASDIPKQARELYKINKVRMLYDRDLQTARLVCRTAEDLEVPLDLTHSYLRAMSPIHLKYLANMAVRSSMSISINAFGELWGLIACHTYGPRGMRVSFPIRKMCRMIGDSASRNIERLSYASRLQARKLINTVPTQHNPSGYIIASSDDLLKLFNADFGLLSIRDETKILGTLENSQESLAMLEYLRMRRIQAVMTSTDIATDFPDLRYPPGFHAIAGMLIVPLSVDGEDFIVFFRKGQLRQVKWAGNPYEKFIKEGTEGYLEPRKSFKTWSETVVGKCLEWTEEEIETASVLCLVYGKFIEVWRQKEAALQSSQLTRLLLANSAHEVRTPLNAIINYLEIALEGALDQETRENLSRSHSASKSLIYVINDLLDLTKTEEGGPLIKGELFDLKDTIREATDMFRNDAKRKNIEYQIIQHPGLPNHCIGDQRRIRQAISNITANAIQHTTQGCVKVEAYVAARTGRDHVDIEVAVSDTGAGMSQKKLDQLFNDLEQVQSEPASMLEDALIPDQKKLAEQGEKSTLGLGLAIVGRIIRNMNGQLRLRSEEGKGTRFVIQLPFEIPDSEADSVTTGGASPAGSVTPHAEESLPNVVSSTAGERTLIAPSLSRQGSAGEDDKQTSNVVVRKTSAGSLASKNSLRSFKTSSSQRSDVDRLIDAIQEPHLIGRGDTSPGSRSMRPTLTKRSSLDANASAAARRRSKSLEDFSNQTVVPPHQRIMQSTVPGKEAIPGSDAPVVALKVPDEGGSSPIGVRPSGNILGEVAEDKPIQPAAEPEPLSADNMHVLVAEDDPVNSRIVKKRLEKLGHHVHLTVNGEECASAYCDNSKDIDVVLMDMQMPIVDGLTSTKMIRSFEKSHSNMYSPRAAL

SEQ ID NO: 28822 - protein, 326 aa, Rickettsia conorii str. Malish 7
MDIKLGKYKPTKEEYIKSFKDMLLLRRFEEKCGQLYGMGEIGGFCHLYIGQEAVISAIDMVKQKGDSTITSYRDHAHIILAGTEPKYVLAELMGRATGCSKGKGGSMHLFNVPNKFYGGHGIVGAQVPIGTGLAFVEKYNDTHNICFTFLGDGAVNQGQVYEAFNMAALWGLPVVYIIENNEYSMGTSVARSTFMRDLYKKGASFGIKGFQLDGMDFEEMYDGSKQAAEYVRENSFPLILEVKTYRYRGHSMSDPAKYRSKEEVEQYKERDPLVIIRKTILDNKYVTEADLKAIEQSVKEIVKEAVEFSENSPLPDEGELYTQVYC

SEQ ID NO: 28823 - protein, 391 aa, Staphylococcus epidermidis RP62A
MVTQNKKILIITGSFGNGHMQVTQSIVNQLNEMNLNHLSVIQHDLFMEAHPIMTSICKKWYINSFKYFRNTYKRFYYSRPNELDKCFYKYYGLNKLINLLIKEKPDLILLTFPTPVMSVLTEQFNINIPIATVMTDYRMHKNWITPYSQRYYVATKDTKDDFIEAGVPASYIKVTGIPIADKFEESIDKEEWLSQQHLDPSKPTILMSAGAFGVSKGFDYMINNILEKSPNSQVVMICGRSKELKRSLKAKFKDNPSVIILGYTNHMNEWMASSQLMITKPGGITISEGLSRCIPMIFLNPAPGQELENAYYFESKGFGKIADTPNEAIDIVSDLTNNEETLKVMSSKMLESKVGYSTRKICKDLLDLIGHSSQPDEIYGKVPLYARFFVK

SEQ ID NO: 28824 - protein, 231 aa, Arabidopsis thaliana
MGETATDSEHRMMIGLSDPMKIDPKRDRFPCCIVWTPLPFISWLVPFIGHVGICREDGVILDFAGPNFVCVDNFAFGAVSRYIQINKEMESSRSSSSGMFNGERRYEQEEDSHEKEPTWDDALRKSTQEYQHHSYNILTCNCHSFVANNLNRLSIKSGGWNVVNLATLVLFKGRWVNKTAIVKSLLPPLIVYTIGILLGGWTFIASCSILVVLLTGWFIIGTYCFKKLIQL

SEQ ID NO: 28825 - protein, 326 aa, Rickettsia conorii str. Malish 7
MQITVREALRDAMQEEMIRDDKVFVIGEEVAEYQGAYKVTQGLLEQFGPKRVIDTPITEYGFAGLAVGAAFAGLRPIVEFMTFNFAMQAFDHIVNSAAKTHYMSGGQVKCPIVFRGPNGAASRVAAQHSQNYTACYSHIPGLKVVAPYSAEDHKGLMLTAIRDDNPVVFLENEILYGHSFDVPKTIEPIPFGQAKILREGSSVTIVTFSIQVKLALDAANFVQNDNIDCEVIDLRTIKPLDTETIIESVKKTNRLVVVEEGWFFAGVGASIASIVMKEAFDYLDAPIEIVSGKDLPLPYAVNLETLALPSESDVIEAVKKVCYYSI

SEQ ID NO: 28826 - protein, 434 aa, Fusobacterium nucleatum subsp. vincentii ATCC 49256
MTGIVDVIGREILDSRGNPTVEVDVILECGVKGRAAVPSGASTGSHEAVELRDEDKTRYLGKGVLKAVNNVNTEIREALLGMDALNQVEIDRVMLELDGTANKGRLGANAILGVSLAVSKAAAEALGLPLYKYLGGVNAKELPLPMMNILNGGAHADSAVDLQEFMIQPVGAKSFREAMQMGAEVFHHLGKILKANGDSTNVGNEGGYAPSKIQGTEGALSLISEAVKAAGYELGKDITFALDAASSEFCEKVNGEYQYHFKREGGIIRNTDAMIKWYEELINKYPIVSIEDGLGEDDWDGWVKLTKAIGDRVQIVGDDLFVTNTERLKKGIELGAGNSILIKLNQIGSLTETLDAIEMAKRAGYTAVVSHRSGETEDATIADVAVATNAGQIKTGSTSRTDRMAKYNQLLRIEEELGSVAQYKGRDVFYNIKK

SEQ ID NO: 28827 - protein, 609 aa, Rickettsia conorii str. Malish 7
MTSIRNIAIIAHVDHGKTTLVDNMLKQSGTFRANQAVAERAMDSNDLERERGITILAKCTALMWNDIRINIVDTPGHADFGGEVERILSMVDGVVLLVDASEGPMPQTKFVLSKALNLGLKPIVVINKIDRDDQRIKEVIDEVFELFVALEANNDQLDFPIVYASGRAGRASLTFDDKINPLDNLADDLAPLFDLIVQHVPKPLADDKAPFSMLVTTREYNSFFGRVLTGRVQSGTVKINQNVKVLNRENKVLETGRITKILAFRGLERIAINDATAGDIIAVAGVENANVADTICSPEVTEAVPSLPIDPPTLSMTFSVNDSPLAGSEGTKVTSSLIGARLMRELESNVALKVTEAAEKNAFQVAGRGELQLGILIETMRREGFELSISRPEVLFQTDEKGNKQEPMEEIQVDVDDDYVGVVVKSLALRKAEMTDMRPSGGGKSRVTFIGPSRGLIGYHSQFLTETRGTGIMNRIFHGYADYKGNIEGRRNGVLISNGDGAAVAYALWNLEERGKMFINPSDKVYRGMIIGEHNRDNDLEVNPLKAKQLSNVRATGKDEAIRLTPPMLLTLEQAISYIQDDERVEVTPKSIRLRKALLDPNDRKRAAK

SEQ ID NO: 28828 - protein, 191 aa, Nuphar advena
DEFCSTSSMLKTLERYQKCNYGSIEASVPSRETQNSYQEYLKLKSKVEALQHSQRNLLGEDLGPLNSKELEHLEQQLEVSLKHVRSTKTQFMLDQLSDLKGKEQILQDANMALVRKLEGAAGSANHQQLSWENGGQHLQYGRHSGPQKDGFYHPLECDSTLQIGYNPTAQEQITVAAPAHNVNGFIPSWLV

SEQ ID NO: 28829 - protein, 445 aa, Azoarcus sp. BH72
MTHFDYLVIGGGSGGVATARRAAEYGARVLLIESARLGGTCVNAGCVPKKLMWHAAGIGHALHDAAAFGFRVDGLRFDWAALKRGRDDFVAYLNGVYASLLDKAGVSVVRGHARFVDAHTVEVGGQRYSAPHIVIATGGEPRVPDSPGAALGITSDGFFALDHLPARTIVVGGGYIAVELAGVLAALGSEVTMLVRGEHLLRPFDAMVRDELALQMRDAGIRIVTGSEAGAVRRADDGALRAACGSAEFEGDTLIWAIGRQARTAGLNLAAAGLGTEKDGSIATDAWQDTAVPGIHAIGDVTGRVELTPVAIAAGRRLAARLFGGQPEARLDYENVPSVVFSHPPIGTVGLTEEAARARHADVRVYHTRFTAMYHALKTQRPKTAMKLVCAGPQEQVVGCHIIGEGADEMLQGFAVAIRMGATKADFDDTVAIHPTSAEELVTMR

SEQ ID NO: 28830 - protein, 512 aa, Dehalococcoides ethenogenes 195
MYIVSTTQMRQIEEACVKQGITTETLMDNAGRAVAVLARHLLEKQNGCRVVILAGAGNNGGDGLVAGRYLAAWDKKVSIFEPFAGASKNKTASGGLKTPENIFTDLTGLKDHLREADLVIDALLGTGVNRPLEGVYRQALQMTADVKNTRPEMQILALDLSSGLNADTGQADEACLKADFTLSLGIAKQGLFTHLGLELSGAVSVADIGIPLGLTADIHTRLIEKDWAKGVLPVRSPHANKGSFGRVMIVAGSDPYIGAAMLAGSAAMRIGAGLVTLALPQSLTGAVAAKIPEATYLPLPEVSCGTADSFASRLILSELVKYDVLLIGPGLGQSPYAARLVTEVLSNLPEELKVVIDADALNILAAIPRWWLEYSFDAILTPHPGEMARLAKTTAEAVQSDRFGICRESARKWGKTIILKGAGTIVSSPEGETLCNPAANPVLASAGTGDVLAGIISGLLGQGLNLFEAAGLGVYLHSLAGATLRSEMGDAGVLASDLLLKLPAVIKELKQS

SEQ ID NO: 28831 - protein, 237 aa, Acorus americanus
MGRGRVELKRIENNINRQVTFAKRRNGLLKKAYELSVLCDAEVALIIFSNRGRLFEFCSSSSMLKTLDRYQKCSFHAAESSAPSRELQSSYQEYLKLKAKVEALQRSQRNLLGEDLGPLNSKELEQLESQLEMSLKQVRSTKTQYMLDQLCDLKRKEQMLQEANKSLKRKLDEYNSENPLQLSWDNGGSNVPYGRQPTHSEDFFQPLSVDPSLHIGYQVNAAATGQNVNGFIPGWMT

SEQ ID NO: 28832 - protein, 503 aa, Mycoplasma gallisepticum R
MKKALLMILDGYGISSTTHGNAVKNAKTPHLDNLMNNNPTIMLQASGEAVGLPKNQIGNSEVGHLNIGAGRIIYTGLSLINKEIENKKFFTNQALLNAIDHAKKNNSKLHILGLVSNGGVHSHINHIYAIMELANQHNVPAILHIFGDGRDVPPTQLLADLDQLIKKAETTKTKIGTISGRFYAMDRDQRWDRIDLAYNNLLSNTGKSFADLKTYVKDSYQQNITDEFIVPAYNNNYKSDEITIQDNDSVVFANFRPDRARQLSHYVFGSNYYDHHPQLRRKNLYFVIMMQYEGINPSAICYPPKIEKNTLGEVLKNANKKQLRIAETEKYAHVTFFFDGGVEVEYQNEDKVLVPSRKDVKTYDLAPEMSAAAIVDQLLKVYTKYDLTVLNFANPDMVGHTGNYEATLKGLEALDHEIGRLLADAKKNNITVFFTADHGNAEEMIDENNQKVTKHTTNVVPFSITDPNVKFTKKEGILANVAPTILKYLEIQIPEEMDQEPLI

SEQ ID NO: 28833 - protein, 252 aa, Mycoplasma gallisepticum R
MNSMKRYIFGNWKTYKTTQEVKEFFSVLNQTKLTKNPDVVFGVAPVFVHLGLANQLERNECLVLAQDANYVMNKANTGTVSYEQLKDIGVNYVIIGHSERRKLFHESDELINQKVKTLLENKMRPILCIGETLEEYEANKTKAVLKDQLEKDLKGIDSSLLKDLIIAYEPVWAIGTGKTASSQTAQDAIAYIRTVLGLLSSKTIANELPILYGGSVTPDNVSELLAQKDINGALVGGASLDPHKFIQLIEAK

SEQ ID NO: 28834 - protein, 397 aa, Agrobacterium tumefaciens str. C58
MMTPEQIATVMTGKVEAAGKGRHEAVLASPMIQNHAPFLHLADDGALICAWFGGTLEGKSDISIFTSVLAAGSNKWGEPQRLSFDPDHSEQNPVLFAAPGNTLLLFHTSQPSGNQDECRIRMAEVSRDASDPTRLTAGEGLYLDLPRGCFVRAPLTVRADGAWLLPIFRCIQRPGQKWNGSHDRAAVGISEDCGKSWRLEDIDQSTGCVHMSPLVIGDEKLAAVFRRRQADFVYRTESADGGRTWSAPQATDVPNNNSSIAAIRLNDGRIAMICNPTNAAMSSDRRASLYDELGEDDDRPDANPDGGCVPIWGVPRAPVTVCISEDGAKSFPQRITIEDGPGTCLSNNSIDGHNKEMSYPWLLEGADGSLHIAYTYYRRAIKYVRLAPGWARAADGR

SEQ ID NO: 28835 - protein, 503 aa, Coprinopsis cinerea okayama7#130
MSSPLTLLVLVLQQDNIEDELKPSFTPGKSILAVYCRSDGYKPGAPPKSAEEYAKLDAEDESLARWKASLGIVPGATSGDTSGPKVTVLTLELVSPTLPPGKKIAFNLADPNAIASLKKTPVVIKEGVEYKSVKPSAAGGQRMLISACSVRITFKVNHSIISGVRYIQVVKRSGIKVDKLEQMLGSYGPNPTGEPYTKNFEPEESPSGMIARSGSYSVRSRVVDDDGEVYAVPTSQLGLLRGSLASRYSCRATPHVLRRPWPTTSVYKAFGVVRLSSTTSTGIEPVKKTWIDSLPPKKNPSPAWSIAMASYALHLPPSVPLTYISLCGIGALVMRGAGCTINDMWDKNLDKSVGLAFNWGALLGWSAVAGTVDWAVCLPLYAGGVCWTLVYDSIYAHQDKLDDVHAGIKSTALLFADKTRSILTGLSLSSMSLVSYAGYLNHQTEPFYAGVALGLAQLGRILYRTDFEDRKSCWEGFASSGWVGFWIWAGAMADYGLSLVALG

SEQ ID NO: 28836 - protein, 496 aa, Aspergillus oryzae
MPKATSSRSAAVGRRHNPLAEDIVATGHLRTHSSKNSKRKSQSDEDQDDGERFIDAKMSRKILQIGQELADEDAAEQRTSLGNIAAKDNTAFDFESRFEDDEAFSDDEKFQDDPWGDEEEIEQVEVDPNDLDMFHKFVPGGDEDPIFNPSEQGAGGQSTNLADLILEKIAEHEAKQNGDNGPFIQGGGLPEDAVQIPAKAVEVYEKVGMILSRYKSGPLPKPFKILPSVPNWPTLLSITRPESWTANAVYAGTRIFISSKPAVAQEFISTVLLDRVREEIHETKKLNVHTYNSLRKALYKPACFFKGLLFPLVSSGTCTLREAHIVSSVIARVSIPVLHSAAALLRMCDLAAEQSLRSLESTGAVNMFIRVFLEKKYALPYKVIDALVFHFLRFRASDNDEDSMMTNGRSRDTNKAYKLPVLWHQSLLVFAQRYRNDITEDQREALLDLLLVCGHKDIGPEVRRELLAGRGRGVVVPDPEKQGALDAGDDTMDVTM

SEQ ID NO: 28837 - protein, 376 aa, Aspergillus oryzae
MAAPRLFRPAARLLSSRLSAPRRPAFPQSACAPSILRSRGYATEGGAKEVTVRDALNEALAEELETNPKTFILGEEVAQYNGAYKVTRGLLDRFGPKRVIDTPITEAGFCGLAVGAALAGLHPICEFMTFNFAMQAIDQIINSAAKTHYMSGGIQPCNVTFRGPNGFAAGVAAQHSQDYSAWYGSIPGLKVVSPWSSEDAKGLLKAAIRDPNPVVVLENELLYGQAFPMSEAAQKDDFVLPIGKAKIERPGKDLTIVSLSRCVGLSLNAAAELKEKYGVDAEVINLRSVKPLDVETIVQSLKKTGRIMCVESGFPMFGVSSEILALAMEYGFDYLTAPAVRVTGAEVPTPYAVGLEQMSFPQVDTILSQATKLLRL

SEQ ID NO: 28838 - protein, 553 aa, Oryza sativa (indica cultivar-group)
MARKMLKDEEVEVAVTDGGSYDYDLFVIGAGSGGVRGSRTSASFGAKVAICELPFHPISSDWQGGHGGTCVIRGCVPKKILVYGSSFRGEFEDAKNFGWEINGDINFNWKKLLENKTQEIVRLNGVYQRILGNSGVTMIEGAGSLVDAHTVEVTKPDGSKQRYTAKHILIATGSRAQRVNIPGKELAITSDEALSLEELPKRAVILGGGYIAVEFASIWKGMGAHVDLFYRKELPLRGFDDEMRTVVASNLEGRGIRLHPGTNLSELSKTADGIKVVTDKERRSLQMLFCLLQVDDYSRTSVPNIWAVGDVTNRINLTPVALMEATCFSKLCLVASQLNLITEMYLVLFSRRTPNSQRLNLEAAGVEVDNIGAIKVDDYSRTSVPNIWAVGDVTNRINLTPVALMEATCFSKTVFGGQPTKPDYRDVPCAVFSIPPLSVVGLSEQQALEEAKSDVLVYTSSFNPMKNSISKRQEKTVMKLVVDSETDKVLGASMCGPDAPEIIQGMAVALKCGATKATFDSTVGIHPSAAEEFVTMRTLTRRVSPSSKPKTNL

SEQ ID NO: 28839 - protein, 798 aa, Schizosaccharomyces pombe 972h-
MQTASSLSVLTPLNEENVDRKSSWSKDTIAVQAVGSSPSSSSSHDFESKEDAEGMNKDESAPSPSTSSPSSASSRSQSKYVRKEALPPQLFHHLDSAKDKALTTFEEIQECQYASANIGKPPENEAMICDCRPHWVDGVNVACGHGSNCINRMTSIECTDEDNVCGPSCQNQRFQRHEFAKVDVFLTEKKGFGLRADANLPKDTFVYEYIGEVIPEQKFRKRMRQYDSEGIKHFYFMMLQKGEYIDATKRGSLARFCNHSCRPNCYVDKWMVGDKLRMGIFCKRDIIRGEELTFDYNVDRYGAQAQPCYCGEPCCVGYIGGKTQTEAQSKLPENVREALGIEDEEDSWENITARRQRRKKGIDETSKIIEEVQPTPLTSESATKVIGVLLQTKDDLLTRKLMERIFLTSDPSVCRSIIALRGYNIFGLMLKKFSIDIEFILRSIKTMLSWPRLTRNKIQDSNIEPVVQEFCDHENEEVKDHAKTLLKEWESLEIAYRIPRRKPGQVAPQSTNAEPSNNQSNPPLRDQEPQRGDKGDIKSAINNSTEDLSKKHPALHSSRPSDSRSRSKFGNDYQSHSKHNLFRKNSFPKRRRLSNSDTPSETTTPNNEQEQVSNQANKVDLNKIISAAMESVNQKNVLKAQKEEEERIAQQKREEKRRLAYEESLKRHAKKLHEKKTKSSQDATIDHHLTSHSPESIAFKAVLAKFFANKTARYQEKLGKAEFKLRVKKMTEIILKKHIQLVLSKKEKALPDELSDSQQRKLRVWAFRYLDTVVSRSGTATTTPTDSPSIGESPKKAA

SEQ ID NO: 28840 - protein, 296 aa, Schizosaccharomyces pombe 972h-
MSAEIKGSTQVKAGLAQMLKGGVIMDVVNAEQARIAEAAGACAVMALERVPADIRAQGGVARMSDPSMIKEIQAAVSIPVMAKVRIGHFVEAQILESIGVDYIDESEVLTPADDINHIEKSKFTVPFVCGSRNLGEALRRISEGAAMIRTKGEAGTGDVVEAVRHTRQMQGELRRVKSMSPDELYTYAKEIAAPIDLVKECAQLGRLPVVNFAAGGVATPADAALMMQLGCDGVFVGSGIFLSGDPAKRARAIVRAVTHYNDPKILAEVSENLGAAMVGRSVSSLEEKEKLATRGW

SEQ ID NO: 28841 - protein, 515 aa, marine gamma proteobacterium HTCC2207
MTEQHKPLVLLILDGFGYSDIKTHNAISNADAPVWQALWQERPKTLIHTSGMAVGLPEGQMGNSEVGHMTLGAGRVVYQNFTRINKAISDGDFFTNPVYCDAIDKAQSTGNAVHIMGLLSPGGVHSHEDHINAMLEMAAQRGAENIYLHAFLDGRDCPPRSAQPSLEKTQALIEKLGVGKIASICGRFFALDRDNRWDRVEEAYNLVTSGRADFSATDAVSALNDAYARDENDEFVHATTICGEGEAPVTLEDGDAVIFMNFRPDRAREIAHALTTKDFDGFERAATPQLSTFVQTTEYQDNIDAPCAYPPIPLVNSMGDYLAQQGKRQLRIAETEKYAHVTFFFSGGRESLYEHEERILVPSPNIATYDDQPEMSAPEVTEKLVEAIGSGKFDTIICNYANCDQVGHTGNYEASIKAVEAIDHSLAQVIAAAEKVGGEILITADHGNVEEMYDDANQQPHTQHTTLPVPLVYVGERSLSLDNNGSLADIAPTMLALMDLPQPAEMTGRSLVIKS

SEQ ID NO: 28842 - protein, 463 aa, Ustilago maydis 521
MSRITNATVQREAISALQAARTTSSVGASGSDAARDSDTISIQSRHTLRVFSAEDEDEEQDPWSAIPRRVSSTPAAELPTLSRAQRKQLIVRALLQLLVLFVVCLVGLGGTLWLALPVISPEDKPLFKIPRSFDDLRALNTVLQHYKSEHFARVLLCWTIVYLFLQAFSIPGSMYMSILAGALFGVPLALPLVCASVATGASICYLISKFLGTMLLALPSWQARIDDWKHKLAQHDDNLLSYLIVLRMMPLPPHNIVNILSPHLGIRLGVFWLSTFGGIFAVSVIHVTIGEKLDQMTGDERFSMLSWRNVLLLGGVMVAVMLPVAVRRYNRDPTLTHAEHGAVYLDEQVDDDAPHLPESFRRNLAALAASGAADDDDDDELPPHRSVDTHHLAADDSFPNWTDARSSCDDPDEHMWETHSAEYARGGVFADRHARDATPNAHAQSSTRARLKSWIHTRTGVKL

SEQ ID NO: 28843 - protein, 453 aa, Pseudomonas putida KT2440
MQDQSTPERLQRGLKNRHIQLIALGGAIGTGLFLGIAQTIQLAGPSVLLGYAIAGLMAFLIMRQLGEMVVEEPVAGSFSHFAHQYWSEFAGFVSGWNYWVVYVLVGMAELTAVGIYVQYWWPDFPTWATAAIFFVVINLINLTQVKVYGEMEFWFALVKVVAIVSMIGFGAWLLGSGHGGPDASVANLWQYGGFFPNGVTGLVMALAVIMFSFGGLELVGITAAEADNPRESIPKATNQVVYRILIFYIGALAVLLSLYPWQKVVQGGSPFVMIFHELDSDLVATILNIVVLTAALSVYNSCVYANSRMLFGLASQGDAPRQLLKVSRSGVPLTALAVSAFATGLCVLINYLMPGGAFGLLMALAVSALVINWASISITHLKFRKAKLAAGITPFYKSLGHPLTNYLCLAFIVLILVVMYLTPPIRISVMLIPAWIAVLWVAFKLKKARQAKG

SEQ ID NO: 28844 - protein, 851 aa, Schizosaccharomyces pombe 972h-
MTARNSASIPTSIRKTSENEVSGDETPAGVGNLSTKTASKTSLTFRQSSSDESTSSYSGNHHNINIQHHPNRPFRTNSSSFSPNDYSISESPSKSKKDGVHVSAVQLDNETDSEVESEVEELERELEAIEDSVYPEVRAAVNPTDDVNLPVNTWRTWVLTTIFVIVFAAVNQFFSLRYPALSISFIVAQLILFPLGKLLNLLPNWKIGYGRFSFYLNSSPFNVKEHAAITIAVSLTSSTAYATNILSAQTSFYKQNLSWGYKILIVLTSQMLGYGFAGLTRRWIVYPAAMIWPQTLVSTVLFRTLHGNSGNDIGVLKNNRISANGWTISRYRFFAYVMIGSFVFYWFPGFIFKGLSYFTVLCWIWPKNRVVNQLFGYNSGLGILPLTFDWQQVVYNSNPLASPWWVICNTFGSVVLIFWIVVPILYYKGVWFSNYLPMLSSSTFDHTGVSYNSSRVLNSDYSFNHTKYESYSPLYMPMSYSMSTALNFAAVTAIFTHCALYNGKDIWQRLWKESGKDECIHRKLMRNYKEAPQWWYATLFIVVFGLTIFTVRYYDTQCPVWALIVALLIFIVNFIPQGVLEGITNQHVGLNIITELIGGYILPGKPLANLMIKLYGFIPMRQGLEFSRDLKLAQYMKIPPRILFFVQLFATILGGITQVAVQEWMNYHIPGICTTSQSNGFTCPNGRSIYNASLIWGAIGPAKMFSKGKPYYPLIFFFLIGAVAPFITWGLRKRFPKSWIGKLNAPVLFTGPGNIPPATGINYSSWAIVGFIFNYVIRKRAIHWWRKYNYVLAAAMDSGVAVAGVVIFLCVSYPGGKITWWGNTVYTKTYDWKSVPYRSLGPNETFGYTNW

SEQ ID NO: 28845 - protein, 302 aa, Xanthomonas axonopodis pv. citri str. 306
MSNAAFWHGVLPAITTPFTANGDIDHDFLGKHANQLVDAGCTAIVPLGSLGEAATLSVEDKLAILRTLVTALNGRVPVVPGIASLATGEAVALAKAAKDIGCGGLMVLPPYVYSTDWREMGAHVRAVIGATDLPVILYNNPVAYKTDFGPAQIAELAAEFPNLQAVKESSGDVRRFAALQELLGDRLALLVGMDDAIVEGLSMGAKGWIAGLVNAYPKESVRLFELARDGGYPAARELYHWFLPLLRLDTVPTFVQLIKLVQAKVGMGSEQVRAPRLVVAGAERDAALKVIDHAIATAPKLS

SEQ ID NO: 28846 - protein, 379 aa, Erwinia carotovora subsp. atroseptica SCRI1043
MAKQDYYESLGVAKSADDREIKKAYKRLAMKYHPDRNPGDSEAEAKFKEIKEAYEILIDSQKRAAYDQYGHAAFEQGGMGGGGGGGFGGGGADFGDIFGDVFGDIFGGGRRQRASRGSDLRYNMELSLEEAVRGVTKEIRIPALEECDVCHGNGAKPGSSPITCPTCHGNGQVQMRQGFFTVQQACPHCHGRGKIIKDPCIKCHGHGRVEKSKTLSVKIPAGVDTGDRIRLSGEGEAGDHGAPSGDLYVQVQVKAHPIFQREENNLYCEVPINFAMAALGGEIEVPTLDGRVKLKVPAETQTGKLFRMRGKGVKSVRGGAQGDLLCRVVVETPVNLNERQRQLLQELDESFGGPSGERNSPRSKNFFDGVKKFFDDLTR

SEQ ID NO: 28847 - protein, 1080 aa, Xylella fastidiosa Ann-1
MPKRTDLRTILIIGAGPIVIGQACEFDYSGAQACKALRAEGFRVVLVNSNPATIMTDPDMADAVYIEPIHWRTVEKIITKEKPDALLPTMGGQTALNCALDLADHGVLEKYGVELIGAKREAIRMAEDRELFRVAMQEIGLECPKAEVAKSLERALEIQAKVGFPTIIRPSFTLGGTGGGIAYNRQEFEEIIKRGLELSPVHEVLVEESVLGWKEFEMEVVRDASDNCIIVCSIENLDPMGVHTGDSITVAPAQTLSDKEYQRLRDASIAVLRKIGVDTGGSNVQFGIDPQTGRVVVIEMNPRVSRSSALASKATGFPIAKIAAKLAVGYTLDELKNEITGGKTPASFEPSIDYVVTKIPRFAFEKFPQADARLTTQMKSVGEVMAMGRTFAESLQKAVRGLETGKVGLEPTGLDLSSEDDLVVLKRELKAPGAERLFYVADAFRAGFAVADVYALSYIDPWFLDQIEEIVAAEGRLVTDGLGSIDGARLRQLKRIGFSDARIAQLTGTNEVAVRTLRRVLKVKPVYKRVDSCAGEFATGTAYLYSTYEEECEAAPSDRRKIMILGGGPNRIGQGIEFDYCCVHAALALREDGFETIMVNCNPETVSTDYDTSDRLYFEPLTLEDVLEIVEVEHPVGVIVQYGGQTPLKLAKALEANGVPVIGTSPESIDLAEDRERFQRLVQQLGLRQPPNCTARTADEALVLAREIGYPLVVRPSYVLGGRAMEIVYSEADLARYVRDAVKVSNDSPVLLDRFLDNAVEVDVDIIADPEGQVLIGGVMEHIEEAGVHSGDSSCSLPPYSLSVATQDDLRRQVIRLAQALNVIGLMNTQFAIQSNDDGSDIVYLLEVNPRASRTVPFVSKATGVPLAKIAARCMTGKTLAEQSVTCEVVPAYYAVKEAIFPFAKLQGVDPILGPEMRSTGEVMGVGRSFAAAFARAQEAGDIRAPQPGRAFVSVRDPDKKRVLPVVLALVERGFGVVATAGTYAWLQQNGVACEVVNKVAEGRPHIVDLIKNGEIVYIINTTEGRAAIADSFSIRREALQHCVTYSTTIAGAKALVNSLEFRGTGPVWSLQELHKELQV

SEQ ID NO: 28848 - protein, 402 aa, Triticum aestivum
  misc_feature (151)..(151): Xaa can be any naturally occurring amino acid
  unsure (1)..(402): unsure at all Xaa locations
LRTPTYLVRLIEYSSYASNALRALPYGRPAGGRTSDFERPPGQVGAGKLMKKKGTSMAVIEAAGAGDIISMAGLSGPAIGHTVANPEVLTALPAVELDPPTISMTFGVNDSPLAGRDGTHVTGAKIGNRLMAEAETNLAINVLPGPLSEPXVSTARASVQLGILIENMRREGFELSVSPPRVMYKTERGERLEPIEEVTVEVDEEHIGFVLETLNNRKGELLDMGPVPGTTGRTRVFMTCPSRGLVGVKGVFNSFTRGTGFMHRAFQAYAKYRGPLGTVRKGVLVSVGRGFITSHALMSLEARGTLFVSPGMETYEGMIVGEHSRDSDLEINPVRTKELTNIRAPGKDENIRLSPPRLMTLEEAIGYVAVDELIEVTPKVIRLRKKYLDANKRKMMKNKIMQ

SEQ ID NO: 28849 - protein, 401 aa, Populus tremuloides
MATKKSVSSLKEADLKGKRVFVRVDLNVPLDDNFNITDDTRIRAAVPTIKYLMGHGARVILSSHLGRPKGVTPKYSLKPLVPRLSELLGVDVKMANDCIGVEVEKIVAEIPEGGVLLLENVRFYKEEEKNDPEFAKKLASLAEIYVNDAFGTAHRAHASTEGVAKYLKPAVAGFLMQKELDYLVGAVANPKKPFAAIVGGSKVSSKIGVIESLLEKVDLLFLGGGMIYTFYKAQGHSVGSSLVEEDKLDLATSLIEKAKVKGVKLLLPADVVVADKFAPDANSKVVAASEIPDGWMGLDIGPDSIKTFNEALDTTKTIIWNGPMGVFEFEKFAAGTEAIARKLAELSGKGVTTIIGGGDSVAAVEKAGLADKMSHISTGGGASLELLEGKPLPGVLALDDA

SEQ ID NO: 28850 - protein, 317 aa, Erwinia carotovora subsp. atroseptica SCRI1043
MTDKLTSLRQVTTVVADTGDIAAMKLYQPQDATTNPSLILNAAQIPEYRKLIDEAIAWAREQSSDRKQQVVDATDKLAVNIGLEILKLIPGRISTEVDARLSYDTEASVAKAKHLIKLYNDAGISNERILIKLASTWQGICAAEQLEKEGINCNLTLLFSFAQARACAEAGVFLISPFVGRILDWYKANGDKKEFAPHEDPGVVSVSEIYDYYKEHGYETVVMGASFRNVGEILELAGCDRLTIAPALLKELSESEGEVVRKLSYVGDVKVRPARMTEAEFYWQHNQDPMAIDKLADGIRKFAIDQEKLEKMIADLL

SEQ ID NO: 28851 - protein, 914 aa, Magnaporthe grisea
MDGHSNFTQPSDTSHASHTIPSSSSSQRRRLTKKPPPSTSARHHHSSLSIDSRVDAQSLVGKRSSTSLRRAPSAPPARTPTSTHASNSSSPRNPSSSTRLNNHSPIIPAASEFAASSLSPSARDRDSDPARNDHGHQLQNNNNYYYSAFTNAHHHNQYSAASHRRSNSYGHPHGPQSSNSLTFNHSEDFIGAPFDGSAILNRIEATKASPTLGSGAFPHISNPIPVGAAAPAQYSRGSPALEQSFTFPSAAMREKSQQVRGMEAQLPTSKRYSDETKEPKPGVLRKKSGFSGFMSGLVGTPKKPLISAPENPVHVTHVGYDSATGQFTGLPKEWQRLISESGITEKERRENPETLVNVIKFYKETTEKPAEDQVLEKFHDARPGLPSAPSAGSMISPGLAPHHYNPMSPMISPPASPRFPQVGHEGNFENPRSPPPVPKNKDVTLMPSRPAPRPPVSLPTRTAPHAPYAAKDSGIDMPPQHDDLTPTTYQPPKESQPILPEEHRSRSNSRVNGNTAYPASQQSPAVQAAYQQQLMQQQQEQALAQAQASMSGSMSRAPSKRQPQAQQPTPPQSQHQYSRPTDANGAQQTQRPQQPQIGPVPQSRPRHRSRQSNGLDVVAALKRICSEGDPREIYRSFTKIGQGASGGVYTGHERGSNRLVAIKQMNLEQQPKKDLIINEILVMKDSSHPNIVNFIDSYLCGGELWVVMEFMEGGSLTDVVTFNIMTEGQIASVCRETLLGLQHLHSKGVIHRDIKSDNILLSMEGNIKLTDFGFCATINEAQNKRTTMVGTPYWMAPEVVTRKEYGRKVDIWSLGIMAIEMIEGEPPYLTESPLRALWLIATNGTPQIKDEGNMSPVFRDFLYFALKVDPDKRASAHDLLRHEFMNLCVDLSHLSPLVRAAREARAQEKARKGQ

SEQ ID NO: 28852 - protein, 357 aa, Arabidopsis thaliana
MSCWRKKSKKKNSEANQRQRWFQENGKVLLEDLIELCNGKSNPIKTFSAEEILQATDNFSESNLVIRFNFMYRGILQNRPVLIKRATWNYYKSDTLEKICRDIAVSSMVSGHKNFLKLLGCCLEFEHPVLVCEYAERIPFNTPNPEMLLPWRMRIKIAKEIAIAVSYLHTALSRTMIHTDIQPFNIFVDSNGTAKLSDFCLCIAIPEGETFVKVHADRVEGTLDYLEYNYAATGLITEYTDVFSFGVLLQNFFTRTYGVVDCCCSEDESLFEEFEDKQNVMNLRISDRISKFVEEGRIFDMLDPKMLESMGDDETEEHKIRRMKAVLMLSLRCTGHRGDVPKMMEVAKELKRIERWT

SEQ ID NO: 28853 - protein, 369 aa, Oryza sativa (japonica cultivar-group)
MKLTVKTLKGTQFEIRVQPNDTIMAVKKIIEEIQGKDSYPWGQQLLIHNGKVLKDESTLEENKVSEVGFLVVMLSKSKASGSSGALSSLTSSTPLTRQETPADASRAAPQPLVAPTRTPQPERPPAEAPSNAYGQAASNLLSGSNLDTTINQLMEMGGGSWDRDKVQRALRAAYNNPERAVEYLYSGIPITAEVAVPAGGQGANTTEPSSTREASLSGIPNASPLNLFPQGDANDGGGAGGGTLEFLRHNQQFQALREMVHTNPQILQPMLQELSKKNPQLLRLIQENHDEFLQLINEPFDGADGDFLDQPDQDEMPHSINVTPEEQEAIGRLEGMGFDRARVIEAFFACDRNEQLAANYLLEHAADED

SEQ ID NO: 28854 - protein, 323 aa, Pichia stipitis
  misc_feature (58)..(58): Xaa can be any naturally occurring amino acid
  unsure (1)..(323): unsure at all Xaa locations
MSSNSLEQLKATGTVIVTDTGEFDSIAKYTPQDATTNPSLILAAAKKPEYAKVIDVAXEYAKDKGSSKKEKAEIALDRLLIEFGKNILAIVPGRVSTEVDARLSFDKEATIKKALELIALYESQGISKDRILIKIASTWEGIQAARELEAKHGIHCNLTLLFSFVQAVACAEAKVTLISPFVGRILDWYKASTGKTYEGDEDPGVISVRAIYNYYKKYGYKTIVMGASFRNTGEIKALAGCDYLTVAPKLLEELLNSTEPVPQVLDAASASATDVEKVSYVDDEATFRYLFNEDAMATEKLAQGIRAFGKDAVTLLEQLEARF

SEQ ID NO: 28855 - protein, 427 aa, Methylobacillus flagellatus KT
MSAIVDIIAREIIDSRGNPTVEVDVLLESGVIGRAAVPSGASTGTKEAVELRDGDAARYLGKGVLQAVENVNTEITEAIIGLDVEEQSFIDQTLIDLDGTENKSRLGANAILAVSMACARAAAEESGLPLYRYLGGSGFMQLPTPMMNIINGGAHAENSVDMQEFMIIPAGLPTFREALRAGAEVFHALKKILHSEGLATTVGDEGGFAPDLPSNEAAIQYILQAITAAGYEPGRDILLGLDCASSEFYKDGLYHLESEGLQLTSAQFADYLATWVDKYPIVSIEDGMSEHDWDGWKLLTDRIGKKVQLVGDDLFVTNAKILREGIQKGVGNSVLIKVNQIGTLTETFTTIETAKRAGYTAVISHRSGETEDTTIADISVATNALQIKTGSLSRSERIAKYNQLLRIEEELGDATSYAGKEAFYNLK

SEQ ID NO: 28856 - protein, 321 aa, Pseudomonas syringae pv. phaseolicola 1448A
MKLALVGDIGGTNARFAIWEDDTLHSVRVFPTIDYAGPEKAIEVYLQDLELQRGDISHVCLAVAGPVDGDFFQFTNSHWRLSREAFCADLKVDHLLLINDFTAMALGITRLKEDEYLTVCPGAGKPDRPRVVVGPGTGLGIGTLIKLDGSRWLALPGEGGHADLPIGTAREALLWTRLMAEHEHVSAEVVLSGAGLLLLYQVSCALDDIEPVLKSPAAVTSAALAGDPVAAAVLEQFCVFLGRVVGNNVLTLGSLGGVYIVGGVVPRFTEFFINSGFKRAMAEKGVMSDYFKNLPVWLVTAEYPGLMGSGVALQQAFGSQI

SEQ ID NO: 28857 - protein, 487 aa, Methylobacillus flagellatus KT
MKPLYDLAQLREIEQRHAAEGLMEKAGLAAASMARKLLQEHEYSVLVLAGPGNNGGDALVAARHLRAAWYQVTVVFVGDSTRLPADAAAAYEAWIAAGGELLNEIPPHGRWQLVIDGLFGIGLSRELDARYCELIRQVNALGLPVLALDIPSGLCMSTGRVLGAAVKASHTLSFIGLKPGLFTLDGPDHAGEVHLETLGLAQANTIATGMLVDQPPALPLPRTRNSHKGSHGSVGVIGGAEHMTGAAILAARAALLLGAGRVYCGLLAHQPWVLDTAQAELMLHDAATVPALSSVLAVGPGMGTSSAAMAVLHEVLGQSQSLVLDADALNLVAAHHSLQQALKGRPLASTVLTPHPGEAARLLGCRNDEVQADRIASALKLARTYQAAVVLKGCGSIIALPDGRWFVNRSGNPGMASAGMGDTLCGIIAALLAQSMGMEQALLLGVYLHGAAADALVERGIGPIGLTAGEVAWAARDLLNAWVYAKT

SEQ ID NO: 28858 - protein, 203 aa, Prochlorococcus marinus str. NATL2A
MEKTREGEIRRETKETDVFVKIDLDGSGKCSANTGIGFLDHMIQQLSSHGLFDIEVRANGDTHIDDHHTNEDVGIAIGQALSKALGDRVGIKRFGHFLAPLDEALIQVVVDCSGRPHLSFSLDIPSQKVGTYDTELVKEFFGAVVSNGGLTLHIRQLAGNNTHHIIEATFKSFARALRMATEIDPRRSSQIPSSKGVLEQAGQ

SEQ ID NO: 28859 - protein, 830 aa, Azoarcus sp. BH72
MKLTRRAFIKQSAALSTAAAAGIPAETLGANIVTDAALTKLAWHKAPCRFCGVGCGVNVAVRDNRVVATHGDINAEVNRGINCVKGYFLSKIMYGADRLTEPLLRQTNGQYDKNGELQPVSWERAFDVMAEQFKKALREKGPSGVGMFGSGQWTIWEGYAAAKLYKAGFRSNNIDPNARHCMASAVAGFMRTFGMDEPMGCYDDFEQADAFVLWGANMAEMHPILWTRLTDRRLSAPQSRVAVLSVFEHRCYDLADLTLTFRPQTDLAILNYIANYIIQRGAVNRDFINRHTRFMTGNTDIGYGLRPEHPLQKAKNVAAPGGGQPSTFDEYAAFVAKYDVDTVARLSNVPKDRLEQLAQLYADPKVKVMSLFTMGFNQHTRGTWCSHLLYNLHLLTGKISSPGNGPFSLTGQPSACGTAREVGTFSHRLPADMVVTNPQHRETAERIWKLPAGTIPDKPGYHAVLQNRMLKDGQLQAYWVMCNNNMQAAPNIAQEAWPGYRNPSNFVVVSDAYPTMTTVAADLVLPTAMWVEKEGAYGNAERRTQFWHQLVQAPGQARSDLWQLMEFSKRFRMEEVWPAELLAKAPQYRGKTLFDVLFRNGEVDKFPATQVEAGYANDEARAFGFYPQKGLFEEYAQFGRGHGHDLAPFDTYHQVRGLRWPVVNGQETRWRYREGLDPYVKAGEDVKFYGMPDGKAVIYALPYEPAAEEPDKEYPFWLCTGRVLEHWHSGSMTQRVPELHRAFPNAVCFMHPDDTRKLGLRRGDEIEVVSRRGVMRTRVETRGRNKPPPGLVFVPWFDASQLINKVTLDATCPISLQTDFKKCAVNIRKV

SEQ ID NO: 28860 - protein, 384 aa, Bordetella parapertussis 12822
MPRLATRTNDFLTFQVVELFKEAQALQAAGRDIISLGIGEPDFTAPPQVVEALERAARAGLSGYSAPAGLSALREAIAAFYESEFGARVDPARIIVTAGASGALALACAALVNPGAQVLMPDPSYPANSNFVLAAGGQPRLIPSTAAKRFQLSAQDVRDHWNDATQGVLIASPSNPTGTSIAHDELAELLAAVRERQGFSIVDEIYLGLSYESQPRSALLLDDDIIVINSFSKYFHMTGWRLGWMIVPESMVAKVEKMAASLAICAPTLAQHAALACFTPDALKIFEHRREAFKQRRDYLLPEFERLGIPVPVRPDGAFYIYADIAALGTTSMAFSHRLLHEGGVAAVPGLDFGPAHGERTMRFSYATGLDRLQEAVARIEKLL

SEQ ID NO: 28861 - protein, 324 aa, Pyrococcus horikoshii OT3
MLALGIEGTAHTLGIGIVSEKKVLANVFDTLTTEKGGIHPKEAAEHHARLMKPLLKKALEKAGISMDDIDVIAFSQGPGLGPALRVVATAARALAIRYNKPIVGVNHCIAHVEITKMFGIKDPVGLYVSGGNTQVLALEGGRYRVFGETLDIGIGNAIDVFARELGLGFPGGPKLEKLAEKGKNYIDLPYAVKGMDLSFSGLLTEAIRKYRSGKFRVEDLAYSFQETAFAALVEVTERALAHTEKKEVVLVGGVAANNRLREMLKIMAEDRGVKFFVPPYDLCRDNGAMIAYTGLRMYKAGISFPLEKTIVKQKFRTDEVEITW

SEQ ID NO: 28862 - protein, 678 aa, Bordetella parapertussis 12822
MSNPTAPKLALADAIRVLAMDAVQKANSGHPGAPMGMAEIAQALWLGNLRHNPADPAWANRDRFVLSNGHGSMLIYALLHLTGYDLPLEELKNFRQLHSRTPGHPEVGITPGVETTTGPLGQGLANAVGMALAEALLAAEFNRAGHTVVDHHTYVFLGDGCLMEGISHEACSLAGTLKLSKLVALYDDNGISIDGHVEHWFADDTATRFEGYGWNVIRGVDGHDVAAVDAAIKQARAQSEKPTLIVCRTVIGKGSPNMAGTHNVHGAPLGNDEIAATRAALGWSAGPFEVPQDIYAAWDSRPAGALAQAAWEDKFQAYAAQYPAEAAEFTRRMKGELPEGFAARFEAFLQATVAKGETVATRKASQFAIAELAGLLPEMLGGSADLTGSNFTDWKGVAPLRAGHHGVHFGRHINYGVREFGMAAIMNGIALHGGYLPFGGTFLTFSDYSRNAIRMAALMKQRVVHVFTHDSIGLGEDGPTHQSIEHAASLRLIPNLSVWRPCDTVETAAAWGAAVTRPASIGMDVHDGGPTALLLSRQNLPFVARDEATQKAIVRGGYVLRDAHDARAAIIATGSEVAIALAAQELLAADGIAVRVVSMPSTDVFDRQDAEWKREVLPAGMPRVAVEAGVTAFWHKYVGLEGAVVGIDRYGESAPDGALFKFFGLTAEKVAEAVKQVL

SEQ ID NO: 28863 - protein, 420 aa, marine gamma proteobacterium HTCC2207
MAKRNAFYAQSGGVTSVINASAAGVIEACRANKDNIGTLYAGQNGILGALHENLIDTSKETPTAVASLKHTPGGAFGSCRYKMRDHNEDSSEYERLVEVFKAHNIGYFFYNGGGDSADTCLKVSQIAERMNYPIQAIHIPKTIDNDLPHTDCSPGFGSVAKYVAVSTKEASLDIASMCASSTKIFILEVMGRHAGWIAASGGLAAEQAGDPPHIIIFPEIPFSRDQFIAKVDATVKDKGYCVVVASEGAKYADGALVSGSLHKDAFGHQQLGGVAQTLASMVKNSLGHKYHYALADYLQRSARHIASKTDVDQAYAVGRGAVEKALEGKRGIMVTIERGTGKKFSWSLGEAPLSKIANVEKKMPRAFITKDGFGITAKAREYFQPLIMGEDYPPYKNGVPQYANLKNILVEKKLKEGFEG

SEQ ID NO: 28864 - protein, 336 aa, Bordetella parapertussis 12822
MTIRVAINGYGRIGRNILRAHYENGKKHDIEIVAINDLGDPKTNAHLTRFDTAHGKFPGTVTVDGDYMVVNGDKIRVLANRNPAELPWGELGVDVVLECTGFFTSKEKAGAHLKGGAKKVIISAPGGKDVDATIVFGVNQNVLKAEHTVISNASCTTNCLAPLVKPLHDKLGVETGLMTTVHAYTNDQVLTDVYHEDLRRARSATMSMIPTKTGAAAAVGLVLPELNGKLDGFAIRVPTINVSLVDLSFVAKRDTTVEEVNSILQAAAEGELKDILTYNTEPLVSVDFNHNPASSNFDATLTKVSGKLVKVSSWYDNEWGFSNRMLDTTVALMSAK

SEQ ID NO: 28865 - protein, 425 aa, Bordetella parapertussis 12822
MVFPSRGNGSGPFRRQAPDAIHTGTEYSMSNVNTLSALAKSGALSGKRVFIRADLNVPFDDAGRISEDTRIRASVPGIRLALDAGEAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELEALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKAAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 28866 - protein, 334 aa, Desulfitobacterium hafniense DCB-2
MTIRIGINGFGRIGRNVFRAAFGRENIEIVAVNNRSTGEILPHLLKYDSVHGIFPAQIQHTEDGFTVDGQLVKVVSHTDPGDIPWGELGVDIVIESSGKFNNGPACQKHLNNGARKVIISAPAKEEDITLVMGVNEEIYDPQKHHIISNASCTTNCLAPVAKVIHKNFGLKRGLMTTVHSYTNDQQILDQSHKDLRRARAAGLSIIPTTTGAARAVALVLPELKGKLNGFSMRVPTPNVSVIDLVAEIEKNTTIEELNGVLRHASENKLKGILDYTDLPLVSSDFNGSSASSIVDGLSTMVMEDNLIKVISWYDNEWGYSCRVVDLVEYVSRQI

SEQ ID NO: 28867 - protein, 589 aa, Pseudomonas aeruginosa PAO1
MCGISGEFRFDNQAADLAAVERITHHLAPRGPDAWGFHAQGPIALGHRRLKIMDLAEASGQPMIDPDLGLAMVFNGAIYNYPELRGELESLGYRFFSGGDTEVLLKGYHAWGADLLPRLNGMFAFAVWERDRQRLFLARDRLGIKPLYYSLDRSRLRFASSLPALLKGGDIASDLDPQALNFYLNFHAVVPAPHTLLEGVKKLPPATWMSVDLDGSCEQRTWWTLDYGPRPDERELTLDDWQERVLDGLREAVAIRQRAAREVGVLLSGGVDSSLLVGLLHEAGVDNLLTFSIGFEDAGGERGDEFQYSDLIAERYHTRHHRLRIGEHEVIEQLPAAFRAMSEPMVSHDCIAFYLLAREVSKHCKVVQSGQGADELFAGYHWYPKVDGADDAFAAYRAAFFDRDHEEYLATVGERFRVEDVAGRFVRDHFASPGAEAAVDKALRLDSTIMLVDDPVKRVDNMTMAWGLEARVPFLDYRLAELSARIPARFKLGDGGKQVLKGAARKVIPSEVIDRPKGYFPVPGLKHLQGRTREWVRELLLDPSQDRGLFQPAIFDRLLSDPDGDLTPLRGSKLWQLAALNLWLSEQGL

SEQ ID NO: 28868 - protein, 478 aa, Vibrio parahaemolyticus RIMD 2210633
MLILFRSLLLGSLPSHIHNEVPMFGIFKPKAHIDRLSPDSIDSTYSRLRWQLFIGIFVGYAGYYLVRKNFSLAMPYLIEEGYSRGDLGVALAAVSIAYGLSKFLMGSVSDRSNPRYFLSGGLLMSALVMFCFGFMPWATGSITAMFILLFLNGWFQGMGWPACGRTMVHWWSRKERGEIVSVWNVAHNVGGGLIGPLFILGLWAFNDDWRTAFYVPAFFATLVAVFIWMTVRDTPQSCGLPPIEEYKDDYPDDYDKSHEQEMTAKEIFFKYVFNNKLLWSIAIANAFVYLIRYGVLDWAPVYLKEAKDFSVDKSSWAYFLYEWAGIPGTLLCGWISDKLFKGRRAPAGILFMVLVTLAVLVYWFNPAGNPTIDMMALIAIGFLIYGPVMLIGLYALELAPKKAAGTAAGLTGLFGYLGGAVAANAVLGYTVDHFGWDGGFIILIGSCITSIVCLTYALLGERAHHEQKEREKEQEALA

SEQ ID NO: 28869 - protein, 868 aa, Xylella fastidiosa Ann-1
MSASPTAERWIVLKFGGTSVSRRHRWDTIAMVVRKRLEEHGTRVLIVVSALSGVTNELTAIAQGVVDSAKRVTALEQRHRDFLVELGLDVQAVLGTRFAMLSDLLQDARAVTRSLDWQAELLGQGELLSSTLGAAYLGASGIDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTGVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIESGAMPVQDRAVFGSPWREIIGHVRTRVMPWWHSARMRLLAMRDEEGIGPCYVYHLPTVRERARQLNAVAAVDQCYYAIKANPHPAILRTLIEEGFGLECVSLGELRHAFEVVPHLVPSRVLFTPSFASRVEYEQAFLLGVNVTLDNVEALRLWPEVFRERTLWLRIDLGYGDGHHEKVTTGGKTSKFGLSVKRIDEFIDVAKTLNITVTGLHAHLGSGVERGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLSRLDETPHVLCDVVGPICESSDVFGRRRHLPAATASGDLMLIADAGAYGFSMASTYNLRGLPAEVVLDA

SEQ ID NO: 28870 - protein, 172 aa, Populus tremuloides
MANPKVYFDMTIGGAPAGRIVMELFADTTPRTAENFRALCTGEKGKVRSGKPLHYKGSTFHRVIPGFMCQGGDFTEGNGTGGESIYGAKFADENFVKKHTGPGILSMANSGPGTNGSQFFICTDKTEWLDGKHVVFGRVVEGMNVVKAIEKVGSSGGRTSRPVVVADCGQLS

SEQ ID NO: 28871 - protein, 302 aa, Nostoc punctiforme PCC 73102
MSIPIIDLSQFQISNQVRRQNVVKNIYQACHEIGFMYIQNSGISPDLLEQVFSASKSFFDSPLAVKEQLAWNNEFINTGYVGLEREHLNPNQPGDLKEAFNIKNDIIINNFSSPILLTNNPVISTFYNACTELANTVLQAFALALELPEYFFTTRHNQKNHTLRLLHYPPLQTSPKPGQVRAGEHSDYGSLTLLFQHAVGGLEVQTTRKEWIAAPLIPGMVLVNTGDLMQRWTNHIFCSTKHRVMIPNDERVKKSRYSIAFFCHPNDDTEIACLESCSQRQSPIYPPILAGEYLLSSLQLTY

SEQ ID NO: 28872 - protein, 181 aa, Populus tremuloides
MGLSFTKLLGRLFSEKEMRILMVGLDAAGKTTILYKLKLGEIVTTIPTIGFNVETVEYKNISFTVWDVGGQDKIRPLWRHYFQNTQGLIFVVDSNDRDRVGEAREELHRMLNEDELRDAVLLVFANKQDLPNAMNAAEITDKLGLHSLRQRHWYIQSTCATSGEGLYEGLDWLSNNIASKA

SEQ ID NO: 28873 - protein, 369 aa, Nostoc punctiforme PCC 73102
MQVKAAVAYSAGKPLTIETVQLSGPQAGEVLVEVKASGICHTDAFTLSGDDPEGLFPAILGHEGAGVVVEVGAGVTSLKPGDRVIPLYTPECRQCEYCLSFKTNLCQAIRLTQGRGVMPDGTSRFSIDGQMIHHYMGTSTFANYTVLPEIAVAKIREDAPFEKVCYIGCGVTTGIGAVINTAKVEPGANVVVFGLGGIGLNVIQAARMVGANMIVGVDINPSKRALAEKFGMTHFVNPQEVEGDLVPYLVDLTKGGADYSFECIGNVKIMRQALECCHKGWGVSVIIGVAGAGQEISTRPFQLVTGRVWKGSAFGGARGRTDVPKIVDWYMQGKINIDDLITHVMPIEQINDAFELMHKGESIRSVVTF

SEQ ID NO: 28874 - protein, 194 aa, Fusobacterium nucleatum subsp. vincentii ATCC 49256
MKIKKADFVKSAVYEKDYPEQLDKMEFAFVGRSNVGKSSLINSLTSRLKLARTSKTPGRTQLINYFLINDEFYIVDLPGYGFAKVPKEMKKQWGQTMERYIASKRKKLVFVLLDIRRVPSDEDIEMLEWLEYNDMDYKIIFTKIDKLSNNERAKQLKAIKTRLVFDNEDVFFHSSLTNKGRDEILNFMEEKLNN

SEQ ID NO: 28875 - protein, 224 aa, Brassica napus
MEDQVISSKNPDPVEKPTNEKPPGVNRYALQCSIVASIVSIIFGYDTGVMSGAMVFIEEDLKTNEVQIEVLTGILNLCALFGSLLAGRTSDIIGRRFTIVLASILFMLGSVLMGWGLNYPILLTGRCTAGLGVGFALMVAPVYSAEIATASHRGLLASLPHLCISIGILLGYLVNYFFSKLPMHIGWRLMLGIAAIPSLVLALGILKMPESPRWLVLPGRLGEA

SEQ ID NO: 28876 - protein, 420 aa, Oryza sativa (japonica cultivar-group)
MGASGKWIKSLVSLKAAPEGTTKGRRWTRLWRSSSSASASASTAGDASESASSEADAFSSVVAAVVRAPPRDFRVIRQEWAAVRVQAAFRAFLARRALKALRGIVRLQALVRGRLVRRQLAVTLKCMNALLRVQERARERRARCSADGRDSQDAVGERDGRADPIKQAEALILQLLPPFHNEQWCDSQGSVSEVRSKIHMRHDAVAKRERAIAYALSHQPRSSKQSARPSSPARSLRNHESNRCNHDWSYIEGWMATKPWESRLMEQSHAELKCSKNSGELNLAGAQLSNASSVKMRGNRVAAKPPSVLSASSSDFPCDVSSASTSSATPARSDGGHGEGPSYMSLTKSAKARQSCNSPFQIQRQRSGGMSSYKRVALSPLDVQSNACSEFSVTSRKLNSLSLKGRSMTRSLDKENDNLF

SEQ ID NO: 28877 - protein, 577 aa, Bacillus cereus ATCC 10987
MNRGRDVMSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLNNPFYIGNRHPRITGEAYDEFIDTFVRAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMKDLLDFQMPYARKEAEVSEWKQNGVIGLAEVVKHVKPTILIGTSTVAGAFKEEIVKEMASHVERPIILPMSNPTPLAEAKPADLIKWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENLSDNDIKIAVKEAIWEPEYRQIKAVEKVRI

SEQ ID NO: 28878 - protein, 572 aa, Aspergillus nidulans FGSC A4
MASSVVPVALQNKLLGYGRAPSAQLAVLNLDLVRNIVFALFLFRYVRKTFYSLRGYGFFGSIHNVYLAIRLFLYSIFLRFPGVRGQVDKQVTAAIEGLESKLVANGPGVTRYLTLPKEGWTHEQVRAELAKLGNMEHTRWEDGRVSGAVYHGGKDLLKIQAEAFEQFGVANPIHPDVFPGVRKMEAEVVAMVLAMFHGPSDGAGVTTSGGTESILMACLAARNKARAERGVTEPEMIIPDTAHAAFIKASSYFGIKLHRVPCPAPDHKVDIAKVRRLINSNTVLLVGSAPNFPHGIVDDIPALSRLATHYKIPLHVDCCLGSFVIALLKKAGFPSPYEEEGGFDFRQPGVTSISVDTHKYGFAPKGNSVLLYRNKTYRSHQYFIYPDWSGGVYASPSVAGSRPGALIAGCWASLMSVGESGYIKSCLDIVNAAKKFESAINEDARLSPNLQVVGQPMVSVIAFESKNDAVDIYDIADDLSAKGWHLNALQSPPAMHVAFTIPTAAAVDTLISDLVAVVEKELEKAEERKRQGKSYVVKRGDTSALYGVAGSMPDKSIVSRLAEGFLDTLYKA

SEQ ID NO: 28879 - protein, 362 aa, Oryza sativa (japonica cultivar-group)
MGIYLSTPKTDKFSEDGENDKLKLGLSSMQGWRANMEDAHSALLNLDNETSFFGVFDGHGGRVVAKFCAKYLHSQVLRSEAYSAGDLGTAVHRAFFRMDEMMRGQRGWRELSALGDKINKIGGMIEGLIWSPRGSDSNNGQDDWSFEEGPHSDFAGPTCGCTACVALIRNNQLVVANAGDSRCVISRAGQAYNLSRDHKPELEAERDRIVKAGGFIHMGRINGSLNLTRAIGDMEFKQNKFLPPEKQIVTANPDINVVELCDDDDFLVLACDGIWDCMSSQQLVDFIHEHIQKESSLSAVCERVLDRCLAPSTIGGEGCDNMTMVLVQFKKPITQNKKADVGEQSVKGVEEAEINAAEENGS

SEQ ID NO: 28880 - protein, 268 aa, Oryza sativa (japonica cultivar-group)
MARDFTATFLLLLSVASLLVISPCAAQQIKTTDTRWSYHLPLPDGVSGAESLAFDGKDGLYTGVSDGRVLKWGGSAAGWTTFAYNANYRKIPLCSSSEVPPEERESICGRPLGIRLFRKTGELYIADAYKGLMKVGPDGGEAQVVATEADGVPFHFLNGLDVDQATGDAYFTDSSSTYTRRFNGEITMNADATGRLLKYDARTRRVTVLKTDLPYPNGVAVSRDRTHLVVAHTVPCQAFRYWLRGTKAGEYELFADLPGYPDNVRRDT

SEQ ID NO: 28881 - protein, 173 aa, Prochlorococcus marinus str. NATL2A
MTNDSEIVVEEKISGPISDWLSNNGFENIPLKEDHLGIEVIKISPNNLLTIVEALKNDGFNYLQCQGGYDEGPGLNIVCFYNLIEMNELKEDISPREVRLKVFLDRNGDLTVPSLYSLFRGADWQERETFDMYGVNFQGHPHPKRLLMPEDWKGWPLRKDYVQPDFYEMQDAY

SEQ ID NO: 28882 - protein, 223 aa, Pseudomonas syringae pv. syringae B728a
MRLRAVLFDMDGTLLDTAPDFIAIAQAMLADRNLPAVPDKLIRDEVSGGARAMVAATFAMSPEDPQFEALRLEFLERYQRDCAVHSKLFDGMDELLTDIEKAGLIWGVVTNKPVRFAQPIMERLGLAERSALLICPDHVTHSKPHPEPMILACRMLDLDPASVLFVGDDLRDIESGRDAGTKTAAVRYGYIHPDDNPDHWGADVVVDHPLELRKVLDNALCSC

SEQ ID NO: 28883 - protein, 177 aa, Rickettsia conorii str. Malish 7
MTFMEDLSSWKEKFETCVYAQKLLDNIEYLNAKVKNPVDIEEVKKGIYYARKYHDLQIRQLGDPYYSHPIEVAIMLAEFVAEDAPKLYNAIMLQAVLLHETIEDIALTEEVITIGPEVAKHVEGLTRIKPYGKISSEKGLNLLVRQKRYDTVLIKFFDRMYNLQTLGAKSPEKMRRV

SEQ ID NO: 28884 - protein, 543 aa, Methylobacillus flagellatus KT
MAIHIISTQPFDDQRPGTSGLRKRVSVFQQPHYLENFVQSIFDAVQVPAGATLVVGGDGRFYNLEAIQTILKMAAANGIGRVLVGKNGILSTPAASCVIRKYKTFGGIILSASHNPGGPTGDFGIKFNSANGGPAPEKVTEEIFARSQEMTQYKIVDAPDVALDIVGEIELAGMTVEIIDAVSDYVDLMAKLFDFEAIRQLLASGFRLRFDAMHAVTGPYARAILVDCLGADPDAVMNADPLPDFGGGHPDPNLTYAHDLVEIMYGDDAPDFGAASDGDGDRNMILGKRFFVTPSDSLALIAANARLVPGYAQGIAGVARSMPTSAAVDRVAQELDIPCFETPTGWKFFGNLMDAGKVTLCGEESFGTGSDHVREKDGLWAVLFWLNILAIKRQPVETIVKRHWARFGRNVYSRHDYEELPSDAANGLIEHVRAQFASLPGRDFGRYTVKTCDDFSYTDPVDGSVSQKQGIRILFEDGSRIVFRLSGTGTAGATLRIYLESFEPDISKHDQDAQDALADLIAIAHQISELKQRTGRDQPTVIT

SEQ ID NO: 28885 - protein, 411 aa, Pseudomonas syringae pv. tomato str. DC3000
MRALTYHGANSVKVDSVPDPELQEADDIILRVTATAICGSDLHLYRGKIPTVEHGDIFGHEFMGIVEETGSAVTAVQKGDRVVIPFVIACGSCFFCNIDLFAACETTNTGRGAIMNKKSIPPGAALFGFSHLYGGIPGGQAEYVRVPKANVGPFKVPGTLADEKVLFLSDILPTAWQAVTNAGIGPGSSVAIYGAGPVGLMSAACAKMLGAERIFMVDHHPYRLAYAQKTYGVIPINFDDDDDPADTIIRQTPGMRGVDGVVDAVGFEAKGSTTETILATLKLEGSSGKALRQCIAAVRRGGVVSVPGVYAGFIHGFMFGDAFDKGLTFKMGQTHVHRFMPELLEHIEAGRLAPEAIISHRMSLEDAAKGYKLFDKKEEDCRKVILTPGDNTIVVPDTQTEALVGGVVPAM

SEQ ID NO: 28886 - protein, 765 aa, Myxococcus xanthus DK 1622
MAGQTVELTQENFERITQEAGVCVVDFWAEWCGPCRGFAPTFEAAAKEFPNITFGKLDTEAQEEVSGRMEIRSIPTLVAFKDGVEVRRASGAMSASAFATWLSKLDSVDLAVEQQRAANRKLTEEGTPPPGIPPHAEWDAGDEEWCSGDTDEEGEKHGPWKYWRADGTLCNECIFVHGKPHGPFKRFHESGEVSQDGAFEQGNLHGPRTWYASDQFTTERMHENGVSEKVRRTVMVYANGRVTQVLHYNGAGERVVPSTGEPYPTRPANLPEKAEYREDQDQWASVSLNAKAERHGLCRFWDREGQLLWECEFHEGSRHGRYHSRAVDEYADPRVRFDEGEMEDDFACGTWKLLDAEGNAVVTRDLGVVQDHETLDASEVFSNLPRSAAEWRAFAEQARADRRYREALLAMARASAVSLDAGPLKAWLESLTLPRTEASARENAEGVMNSAGDERAALADAMMRGAEAAMLLRGFAVLHDQQDRPRAALDFILAAMLLAPERSAYLFTRSLILANLGLGEQMQKDAEALAPAEPDSWKFLSAYRRVLFPRFEFWPGREPAHCTFDEVPDGPTKELDAVQAVVRKYATRLQLLRAEILSRFKPGTNVPWLPPDVSSLLPDGPVELEQTEVEDADGDSVDVDETLSTKGMGIPALSRAARGDWSALTWLLWACGVDSIRMPDALTPPADFGQAAGQATQRLWQCRNRRSRGRIDPDLPTFDFEGVALQELHPNLAGIAEEQYAETQAMFFWLTDANHVSPWQANLRG

SEQ ID NO: 28887 - protein, 468 aa, marine gamma proteobacterium HTCC2207
MSEKTLNLIKESGARWVDMRFTDTKGKEQHVSIPTGEVGDDFFVEGKMFDGSSIAGWKGINESDMILMPDDSTAVLDPFTDEPTVIIRCGIVEPSTMQGYERDPRSIAERAEQYLQSTGLGDTAFFGPEPEFFVFDDIKWGVDMSGAFYKINSDEAAWASGSDFTDGNMGHRPGVKGGYFPVPPVDSLHDLRAAMCNAMEQMGLDIEVHHHEVGTAGQCEIGVRFDTLVAKADQVQILKYCVHNVAHAYGKTATFMPKPIVGDNGSGMHCHMSFAKDGVNQFAGDAYAGLSEMALYYIGGIIKHAKSLNAFANASTNSYKRLIPGFEAPVMLAYSARNRSAAIRIPYVASPRGKRVEVRFGDPTANPYLMFASMLMAGLDGIKNKIHPGDAADKDLYDLPAEEAAAIPQVAGSLREALDELNADREYLTAGGVFTDDMIDAYIELKMEEVYRVEHTTHPVEFDMYYSV

SEQ ID NO: 28888 - protein, 490 aa, Leptospira interrogans serovar Lai str. 56601
MIRGRIPGGRLTSEQYLVWDELGDKFGGGAIRLTTRQSVQLHTLRIFHLRDVMKAIHEVNLSSMGACGDVVRNVTQAVNPLGKKELQLLDGVSQILSDHFKYKTNAYAEVWLGDKQLNKDEEDPIYGKTYLPRKFKIAVTLAGNNTVDIYANDMGFAATLSSDGNRIDGYFVFAGGGFGMTHNKPETFARAASLLGWVPENALIPVAEAIVTAHRDFGDRTNRKHARLKYVLAEKGVEWFQSEVESRSNVKLDKDKPLPNWETPSYLGWNERQDGTLSLGFHTLAGRIKDFPGKPLKSALKEIIGAYKLSVQITADQDLILIGIQKSDQEKVEKRLEELNVSWKSPSRLYDRALACPALPTCALALTESERSFPEVLNGIQKVLDKLGLSDRAPVVRMTGCPNGCARPYSAEVGIVGQQAGGKYSLFFGADSEGTKVGEYVAKKIALADIPAQLEKAFVLWKNEGDSDEKFGDFVNRFPLERFREALGSM

SEQ ID NO: 28889 - protein, 455 aa, Pseudomonas aeruginosa PAO1
MPDAPASAAERLERLPLSPYHRLVFVIIALAFFFDSMDLAMMTFLLGSIKAEFGLDSAQAGLLASSSFFGMVIGAALSGMLADRFGRKPVFQASIVLWGLASYLCSTAGDLDSLTFYRVLLGIGMGMEFPIAQSLLSEMIPASRRGKYIALMDGFWPLGFVAAGCLSYFLLPLTGWRSIFLVLALPAVFVLAIRFLIPESPRWLEQAGRREQADRVLRDIEARVMRSLGLTELPPPLRQPQRERSRPGFFSAFAELWSPAYRRRTLTVWGLWFFALLGFYGLTSWLSALLQQSGFAVTQSVYYTVLISLAGIPGFLCAAWLVESWGRKPSCVLMLLGGGAMAYAYGQTAVFGGSLALLIGFGLAMQFFLFGMWAVLYTYTPELYPTSARATGSGFASAVGRIGSLLGPLVTGLVLPLTGQGGVFTLGALCFGVAALVVWAFGIETRGRTLEELAG

SEQ ID NO: 28890 - protein, 141 aa, Candida glabrata CBS 138
MLLFRTARCQVPTLGRFATHPRIAPSIAMRFQSSGGYASIKQVKTLEEVQKLMKDSNLSVIDFYATWCGPCKAMVPFLSKFVDQYKDVKFYKVDVDESPDVAEYYGVSAMPTFVFTKDDDILHKIRGANPKGLAKAIEEFK

SEQ ID NO: 28891 - protein, 183 aa, Archaeoglobus fulgidus DSM 4304
MKIYVIYNYGQYNHLIHRTLRDLGVETKLVENTTPVEQLKDVDGLVIGGGPSLDRTGNCELYLKELDVPMIGICLGHQLMAKVFGGEVGKGSMGGYSEVKVRIVEDDELFEGIPREITVWASHMDEVKKLPEGFKRLAESDICKIEAMRHEKKPLYGVQWHPEVYHSQFGVELYRNFIEICKK

SEQ ID NO: 28892 - protein, 487 aa, Kluyveromyces lactis NRRL Y-1140
MAKIEKKQAVKNNQVLSLAEKIKRKALEKQQQAHANEPSPSDEDSAQSNSKDSNSNEQPEESEEIFESFTELDLVPELIEACKNLNYNKPTPIQSKAIPPALKGSDIIGLAQTGSGKTAAFAIPILNQLWHDQQPYYACILAPTRELAQQIKETFDSLGSLMGVRSTCIVGGMSMMDQARDLMRKPHIIIATPGRLMDHLENTKGFNLRKLKYLVMDEADRLLDMEFGPVLDRILNIIPTQGRTTYLFSATMTSKIDKLQRASLTNPVKCAVSNKYQTVDTLVQTLMVVPGGLKNTFLIYLLNEFIGKSTIVFTRTKANAERISNLCNLLEFSATALHGDLNQNQRTGALDLFKAGKRSILVATDVAARGLDIPSVDIVINYDIPVDSKSYIHRVGRTARAGRSGKSISLVSQYDLELILRIEDVLGKKLPKENVDKDAILALRDSVDKANGEVVMELNRRNKEKQARGKGRRGRMATRDNMDREER

SEQ ID NO: 28893 - protein, 564 aa, Pseudomonas aeruginosa PAO1
MTETAKRPLYVPHAGPSLLEMPLLNKGSAFSTQERIDFNLQGLLPHNIETIEEQTERAYSQYNLCNTDLDRHIFLRSIQDNNETLFFRLLEEHLEEMMPIIYTPTVGQACQEFSKIYRTHRGLFISYPDRERIDDILRSATKNNVKIVVVTDSERILGLGDQGIGGMGIPIGKLSLYTACGGISPAYTLPVVLDVGTNNPDLLNDPMYMGWRHERVSGAQYEEFVDLFIQAIKRRWPNVLLQFEDFAQTNAMPLLERYKDELCCFNDDIQGTAAVAVGTLLAACKAKGEKLSEQTVTFVGAGSAGCGIAEQIIAAMQLEGLDEAQARRRIFMVDRWGLLTDDMSNLLDFQHRLAQKRADLGAWGGQQGDDLALLEVIRNARPTVLIGVSGQRGLFSEEVIRELHSHCKQPLVMPLSNPTSRVEATPQEILNWTDGQALVATGSPFQPVQVGDKRIPIAQCNNAYIFPGIGLGVIAARANRVTEGMLMAAANALANCSPIVTQGEGAVLPALGDIREVSKRIAVAVAKQAQAEGKALHTSDEVLNDAIEANFWFPRYRAYRRTSF

SEQ ID NO: 28894 - protein, 125 aa, Oceanobacillus iheyensis HTE831
MRKAIQTEKAPAAIGPYSQAIQAGDFLYISGQIPINPATGNVEEGIENQTKQVLSNLEAILTKAETTFEHAVKFTIYLSSMEDFKVVNEIYGKYLQEPYPARATVEVSRLPKDVLIEMDLVAYVK

SEQ ID NO: 28895 - protein, 170 aa, Cenarchaeum symbiosum
MDLEAMLASYPDFPKKGVLFKDIGPILRDPAALAWAADELLRRYPPADFDVIAGIESRGFILATIMSARSGKGMVMIRKPGKLPGKTVKLAYKTEYGEDILEAQHGSVKSGERVIICDDLLATGGTAAAAASLVEQVGGKVAGLAFIVELAKLCGADKIAGYNRKSLVVY

SEQ ID NO: 28896 - protein, 227 aa, Triticum aestivum
MMMGTDVCSSRMLSLPRYESGDEELTVLPRHTKVVVTGNNRTKSVLVGLQGVVKKAVGLGGWHWLQVLKNGVEVKLQRNALSVLEAPTGNEDDDEIDGGNSSFCGSFDMGDKDMNYSSIEYQKPTKPRVRHTRPWSSCTTTSSSRANNLHSTSKLRARVNLTKLGTPTLWRYWKHFNLVSMNPTPSEEQLFHGVQQHFQSQQLDELQVILGFIQTAKRLKTLYKNSS

SEQ ID NO: 28897 - protein, 219 aa, Erwinia carotovora subsp. atroseptica SCRI1043
MTQDELKKAVGWAALDYVRPDTIVGVGTGSTAAHFIDALGSIKHQIKGAVSSSDASTEKLKSLGIPVFDANDVDSLDVYVDGADEINGHMQMIKGGGAALTREKIISALSRQFICIVDASKQVDVLGKFPLPVEVIPMARSYVARELVKLGGQPEYRQGVVTDNGNVILDVHNLNIMDAVAVENHINGIAGVVTVGLFANRGADVALVGTADGVKTVTK

SEQ ID NO: 28898 - protein, 227 aa, Oceanospirillum sp. MED92
MNHLSASVLFDLDGTLIDTAPDFHAVINLLLKEEGLPEVSYEFLRQHVSNGARAMIAASFELAEGDERFTRLHKRMLEIYLSHLDKESKLFPGIADTLVWLNDNKIPWGVVTNKPELYTIPVLRGLGIIDQAQSIICPDHVENRKPHPEPLFLACKQLDKIPEHSVYVGDHVRDIEAGNRAGMVTIGASYGYLNDGEDPISWQADHYIECATELKPLLQSIYKDIAS

SEQ ID NO: 28899 - protein, 375 aa, Arabidopsis thaliana
MTKRKQQDTKENLTLTVFESNKRCSNSGGEYFDRIPADLVIKILSKLSAKSMAKCRCVCKLLSSIIRQPNYNQLFPIKYPDPPRFIFTFLGGGMLFSYTSTQPENPDENSSLVATAHHHTDIPRDFSQILSSVHGLVCYHRKIKNDTVFVIYNPITGQYVTLPILEAHATINYFAIGYDPINKRFKVLCVTSVHHGTGEEFDSQHQVLTFETGRRNLFWRKIQCRRHYYTHRYHKGICIKGVLYYAATSMKPMLGPMIVCFDVRSEKFGFITWKPPSLINYKEHGQERKWSKHIYVKPLQWPEFNGIDVNFLVTSKGEAVFCPNHYDPQVPFYLYYYNLEENIVVRVRVEVPESQGSKRVLFHAVPNYLENMKLT

SEQ ID NO: 28900 - protein, 369 aa, Rhizobium leguminosarum bv. viciae 3841
MPAMTATTTSPEIKIELHKSPVSDADRIQALETPGFGKVFTDHMVLARWTADKGWHDAKVTPRRPLELDPASAVLHYAQEIFEGMKAYKADDGRILLFRPEENARRFAQSATRMAMPPVPEELFLKAVEELVRVDKAWIPSGDASLYLRPFMFANEAFLGVRPAQEYVFCIIASPVGAYFKGGAKAVSLWVETEYTRAAAGGTGAAKCGGNYAASLVAQAEAAKKDCDQVVFLDAAEHRWVEELGGMNVFFVMNDGSVVTPPLGGTILPGITRASVIVLAGEKGLRVEQRPYSFAEWQQDATSGKLVEAFACGTAAVLAGIGLVRHAGGEFLVGDGQTGKLTSELRQQLVSLQKGVTNDERGWTRLIPA

SEQ ID NO: 28901 - protein, 226 aa, Actinomyces naeslundii
MSAATSQEHADAPGQPEPHSQHYGPVRIGVGGPVGAGKTQLIERITRAMSQEVSMAAVTNDIYTIEDAKILAAQGVLPVDRIVGLETGGCPHTAIREDTSMNEAAIAELVERHPDLEVVFVESGGDNLSATFSPELVDFSIYVIDVAQGEKIPRKAGQGMIKSDLFVINKTDLAPHVGADLAVMEADSKVFRGDRPFCFTNLKTDEGLEQVIEWIHHDVLMTDLES

SEQ ID NO: 28902 - protein, 1499 aa, Candida glabrata
MSLASDKKDADVASTTTTAQDDDNLSTYHGFDHHVQDQVRQLARTLTQQSSLHQKKEHTLPEEGINPIFTNTEADDYNPRLDPTSDEFSSAEWVQNMSNISNSDPDYYKPYSLGCYWKDLVATGESADIEYQANFLNGPYKGLKTVYNTVVPSTASSKDKNFKILKSMEGAVNPGELLVVLGRPGSGCTTLLKSISSNTHGFNIAKDSTISYSGMTPNDIRKHFRGEVVYNAEADIHLPHLTVYQTLLTVARLKTPQNRLKGIDRETYARHLTEVAMATFGLSHTRNTKVGNDLVRGVSGGERKRVSIAEVSICGSKFQCWDNATRGLDSATALEFIRALKVQASISNAAATVAIYQCSQDAYDLFDKVCVLYDGYQIYLGPAGKAKRYFQKMGYVSPERQTTADFLTAVTSPSERIINQDYINRGIFVPQTPKEMWEYWRASEDHADLIKEIDSKLSDNYDANLAEIKDAHVARQSKRARPSSPYTVSYGMQIKYLLIRNFWRIKQSSGVTLFMVIGNSSMAFILGSMFYKVMKHNTTSTFYFRGAAMFFAVLFNAFSSLLEIFSLFEARPITEKHRTYSLYHPSADAFASILSEVPAKLITAVCFNIIYYFLVNFRRNGGVFFFYFLINIVAVFAMSHLFRCVGSVSKTLSAAMVPASMLLLGLSMYSGFAIPRTKILGWSKWIWYINPLAYLFESLMINEFHDRKFPCSQYIPSGSVYNNVPADSRICSSVGAIRGNDYVLGDDFLRESYSYLHKHKWRGFGIGLAYVIFFLVLYLILCEYNEGAKQKGEILVFPQNIVRRMKKERKLKNVSSDNDVEIGDVSDISDKKILADSSDESEESGANIGLSQSEAIFHWRNLCYDVQIKKETRRILNNVDGWVKPGTLTALMGASGAGKTTLLDCLAERVTMGVITGEVSVDGKQRDDSFARSIGYCQQQDLHLKTSTVRESLRFSAYLRQPADVSIEEKNQYVEDVIKILEMEQYADAVVGVPGEGLNVEQRKRLTIGVELAAKPKLLVFLDEPTSGLDSQTAWSICQLMKKLANHGQAILCTIHQPSAILMQEFDRLLFLQRGGKTVYFGDLGDGCKTMIDYFESHGSHKCPPDANPAEWMLEVVGAAPGSHANQDYHEVWRNSDEYQKVQEELEWMSNELPKKNTNNSETVHKEFATGVLYQCKLVSPRLFQQYWRSPDYLWSKFFLTIFNNIFIGFTFFKADRSLQGLQNQMLAVFMFTVIFNPLLQQYLPSFVQQRDLYEARERPSRTFSWKAFIVSQILVEIPWNILAGTVAFVIYYYAIGFYSNASVAHQLHERGALFWLFSCAFYVYIGSLALFCISFNQVAEAAANMASLMFTLSLSFCGVLVTPNGMPRFWIFMYRVSPLTYLIDGMLSTGVANVAIKCSNYELLRFSPAANLTCGEYLGPYLQTVKTGYIVDPSATDTCELCPYSHTNDFLSSVSSKYSRRWRNWGIFICYIAFNYIAGIFLYWLARVPKKSGKLAKK

SEQ ID NO: 28903 - protein, 473 aa, Triticum aestivum
MDVPLASKTFPSPSPSKREQCNVDGHKSSSKHADLNPHANDSVLGIILGGGAGTRLYPLTKKRAKPAVPLGANYRLIDIPVSNCLNSNIPKIYVLTQFNSASLNRHLSRAYGSNIGGYKNEGFVEVLAAQQSPDNPDWFQGTADAVRQYLWLFEEHNVMEYLILAGDHLYRMDYEKFIQAHRESDADITVAALPVDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 28904 - protein, 295 aa, Zea mays
  misc_feature (203)..(203): Xaa can be any naturally occurring amino acid
  unsure (1)..(295): unsure at all Xaa locations
MAIISDFKDDEAPEQQLAAGHGVEVALVAALERSGGALPFLQAAMDVAHRRSGLFRDPSAVSKVTAMAAAVRAQIEAEERVTREAEAEAQRAAKEAVMATAEEKPESTVEKDSMEVDKKEEANVRQPNAGNGLDLEKYSWTQQLPEVNITIPVPQGTKSRFVVFDLKKNHLKVGLKGQPPIIDGELYKPVKAEARPSRPEDGXTLSILLTNHDQMEWWKSVIKGGPEVDTQKVEPENSKLSDLDPETRQTVEKMMFDQRQKQMGLPTSDEMQKQEILKKFMSEPPEMDFSRAKMP

SEQ ID NO: 28905 - protein, 488 aa, Archaeoglobus fulgidus DSM 4304
MDSSSVDIVLNKGGHNKSFEVKIYRIHTTKIMSFPNGSDAEGVLKRLEDYAKNDFEPHSRRMWGHIYYAGLKDVVELARKAYLMYMDKTMLDFTCFPSLLRMEREVVRMASSLLNGDEEVVGNFTYGGTESIMLALKAAREKFRKEEGGNVVPEIVLPATAHPAFWKSAEYLGMRCLRAKLDDELRADVETVKELVGDKTAMIVGSAPNYPFGVVDDIKALSDIAVDGKLWLHVDACLGGFHLPFFRELGEKIPDFDFSVEGVHSISADFHKYGLSPRGASVILYRNAKLREGQIFVMASWPGYPLVNTAVLSTRSAGTLAAAWAVMSYLGFDGYLKLAKKTLYAKKRLIDGLTELGLELLGSPEGAVLAFTSERHNLFKVSTLMAEKGWYVQSQPGSKKLGFPRSLHFSVIPGHAEVVDEFLEDMREVLPECECSYPEMSSFDVSKLKFGEDGLPEDSELISELIHSMPPEIVESVFKQFINELIFR

SEQ ID NO: 28906 - protein, 324 aa, Pseudomonas putida KT2440
MSQSSELIQSAQRTLRLELEAVEALLARIDDNFVKACELILASKGRVVVVGMGKSGHIGNKIAATLASTGTPAFFVHPAEASHGDMGMITRDDVILALSNSGSTAEIVTLLPFIKRLGIKLISLTGNPDSPLAQAAEVNLDARVEQEACPLNLAPTSSTTAALVLGDALAIALLEARGFTAEDFAFSHPGGALGRRLLLKVENVMHAGDDLPQVPRGTLLKDALLEMSHKGLGMTVIVEADGKLAGIFTDGDLRRSLDRNIDVHTTLIDQVMTVHGKTARADMLAAEALKIMEDHKINALVVVDREDRPTGALNMHDLLRAGVM

SEQ ID NO: 28907 - protein, 387 aa, Erwinia carotovora subsp. atroseptica SCRI1043
MSVIKMTDLDLAGKRVLIRADLNVPVKEGKVTSDARIRASLPTIEIALKQGARVMVTSHLGRPTEGEYNEDFSLLPVVDYLKEKLSSPVRLAKDYLDGVDVAEGELVVLENVRFNKGEKKDDEVLSKKYAALCDVFVMDAFGTAHRAQASTHGVGKFATIACAGPLLSGELEALGKALSKPARPMVAIVGGSKVSTKLTVLDSLSKIADQLIVGGGIANTFVAAQGHNVGKSLYEADLISEAKKLLETCDIPVPSDVRVASEFSETAAATLKSVTEIKDEEQILDLGDVSAERLAEILKNAKTILWNGPVGVFEFPNFRKGTEIIARAIADSDAFSIAGGGDTLAAIDLFGIADKISYISTGGGAFLEFVEGKKLPAVVMLEERAKQ

SEQ ID NO: 28908 - protein, 338 aa, Erwinia carotovora subsp. atroseptica SCRI1043
MTIRIAINGFGRIGRSVLRALYESGRRAEITVVAINELASAEGMAHLLKYDSSHGRFSWDVRQECDQLYVGDDDIRLLHQVEIQQLPWRELSVDIVLDCSGVYGSREDGEAHLAAGAKKVLFSHPGTTDLDATVVFGVNHDRLESGHRIVSNASCTTNCIIPVIKLLDDAFGIENGTVTTIHSSMNDQPVIDAYHHDLRRTRAASQSIIPVDTKLSAGITRIFPQFVDRFEAISVRVPTINVTAIDLSVSVRKAVNVNEINALLQKSAHESFRGIVDYTELPLVSADFNHDPHSAIVDGTQTRVSGQHLIKTLVWCDNEWGFANRMLDTTRAMAACGF

SEQ ID NO: 28909 - protein, 465 aa, Cenarchaeum symbiosum
MLASQFPRPPLRLYRGRITPGKSKRMRPHSGRPGIRPWPDRGTGHIRPGTCHATCRGRATRSRYNNKTSPDPAMEPSIDTKNIGLRGIPVADTRISNIDGKQGRLIYRGYDISDLSSKSNFEEVAYLLLHDGLPTKDRLSAFNSRLVEARWIPKQMQINMGNWRKDADPMDMLQAFVAALAGYYDEEFANKEASYDRAINLIGKVPTIVASWHRIRNGEDLIDPDPALSHAANFLHMMTGKVPDKEMERIFDTCLILHADHTFNASTFAARQVASTRAHMYSAASAAIGALSGELHGGANYEVMRMLLDMGSVEAVVPWIRKRMDDGQRIMGMGHAVYKTYDPRATVLKELSRRLAAKTGQPWFAITEKVEQATADEMKKRKGVEIYPNVDLYSASVYYMLDIPMDLNTPIFAISRVAGWAAHIIEEKFAEAAPKPALYRPKAVYVGKYCGPEGCEYKALDLRES

SEQ ID NO: 28910 - protein, 302 aa, Triticum aestivum
  misc_feature (191)..(191): Xaa can be any naturally occurring amino acid
  misc_feature (203)..(203): Xaa can be any naturally occurring amino acid
  misc_feature (250)..(251): Xaa can be any naturally occurring amino acid
  misc_feature (279)..(279): Xaa can be any naturally occurring amino acid
  unsure (1)..(302): unsure at all Xaa locations
MDPCPFVRVLVGNLALKMPVAPRPAGAGAGVHPTTSPCYCTIRLNKLPLQTAAAPLLPSDDMTQGPAATGALAAAFHLSKADLDRVTAKPSLFVARSARLKVAVYAGRRGTTCGVNSGRLLGKVVIPLDLKTAVGKPIVFHSGWLSINKRGRKASAVSGSAQLNLTVRAEPDPRFVFQFDGEPECSPQVLXVQGGMMQPMFTXCKFSCRSNSDLRSRSMHSDPGSGSRHWLMSFGSDRERPGKERKGCSXXVHDLSGSAVALASMVTPFVRPRLDRVSXVNPGAGLYPPRGGIGPGGPLECG

SEQ ID NO: 28911 - protein, 664 aa, Erwinia carotovora subsp. atroseptica SCRI1043
MSSRKELANAIRALSMDGVQKAKSGHPGAPMGMADIAEVLWRDYLNHNPANPNWVNRDRFVLSNGHASMLIYSLLHLSGYDLPIEELKNFRQMHSKTPGHPEYGYTAGVETTTGPLGQGVANAVGMAIAERTLAAQFNRPGHDIVNHHTYTFLGDGCMMEGISHEVCSLAGTMKLGKLTAFYDDNGISIDGHVEGWFTDDTAARFEAYGWHVVRGVDGHDADAIKRAIGEAQLVTDKPSLLMCKTVIGFGSPNKAGTHDSHGAPLGEAEVAASREQLGWTHAPFDIPADIYAAWDAKPAGQRKEAAWDEEFAAYASAYPELAAEFTRRTGGELPTHWQADAQKFIEDLQANPAKIASRKASQNALEAYGKLLPEFLGGSADLAPSNLTIWSGSVSLDKDHAGNYIHYGVREFGMTAIANGIALHGGFVPYTATFLMFVEYARNAVRMAALMKIRSIYVYTHDSIGLGEDGPTHQPVEQLASLRVTPNMSNWRPADQVETAVAWKYAIERQDGPTSLILSRQNLAQQTRTAEQLANVVKGGYVLKDSDGQPELILIATGSEVELAVGAYDKLTAAGRKVRVVSMPSTDAFDKQDAAYREAVLPKAVAARVAIEAGIADYWFKYVGLNGAIVGMTSFGESAPAELLFEAFGFTVDNVVEKAQALLK

SEQ ID NO: 28912 - protein, 454 aa, Oryza sativa (japonica cultivar-group)
MVKGGREALLGGYEMGRTLGEGNFGKVKYARHLATGGHFAVKILDRGRVVSLRAGDQIRREIATLKLLRHPHVVRLHEVAASKTKIYMVLEFVNGGELFERIAVKGKLSEKEGRRLFQQLIDGVSYCHDRGVYHRDLKPENVLVDQKGNIKISDFGLSALPQHLGNDGLLHTTCGSPNYIAPEVLQNKGYDGSLSDIWSCGVILYVMLIGYLPFDDRNIVVLYQKIFKGDTQIPKWLSHSAQNLLRRILEPNPMKRIDMAGIKSHEWFQKDYIPVLPYDDDDEDVQFGARLPAKEQINDEPGDKNSHQINAFQLIGMASSLDLSGFFEDEEVSQRRIRFTSTHPPKDAFDKIESSATELGFQVQRGHSKLKLMRNCKGSKNPESFMVSAEVFELGPSVNVVELRKSNGDPALYRQLCERISSDMGARNTEQIFATASLEDDLQNSNAGTPLFAL

SEQ ID NO: 28913 - protein, 419 aa, Glycine max
  misc_feature (316)..(316): Xaa can be any naturally occurring amino acid
  unsure (1)..(419): unsure at all Xaa locations
MGIPWDDVVVIQQGKDHNEPCIVTVNCPDKAGLGCDLCRIILEFGLRITRADISTDGRWCYIVYWVLAHPASLNVDWESLKTRLLSACPSCLLSYHFNQHSTSPSPPPIYLLKVWCVDQKGLLHDINEILCNLELIIQRVKAMPTPDGRVLDMFFITDGMELLHTKKRQDYVCEYLMDALGERCISSELQLAGPEYGHLQGFSSLPPAFAEELFSSELLDKLSLHPLSQDMTTLKTPTVTVDNSLSPVHTLLQIQCVDQKGLCYDIMRISKDSDIKVAFGRFSSSVKGFRNIDLFVQHNDGKKIIDPESQKTLCFXLKEEMLHPLRVTIVNRGPDTELLVANPVELSGKGRPRVFYDVTLTLKALGVGIFSAEVVRHSTQERQWEVYRFLLEESRDFPLTRSQARTQIVDKVRRTLMGW

SEQ ID NO: 28914 - protein, 499 aa, Clostridium perfringens ATCC 13124
MEICSSNSIRNMDKDYIEKFNMPSIVLMENAIIKFLENIDLTKESFTIISGRGNNGGDALGIARHLLNKGKKVYVHILEKEKEGSVDYKTNLTILEKLGCYINGISNNKDLEILKNNIINSEILIDGIFGTGLNKEISGIYFETIKCINENSKFTVSIDVPSGINSDDGSICEIAVKANETISFQVYKLGFLNYKSFEYLGDLKIVDIGIPKSIVYKNSDNMRFTDREYIRNKFPYRNKYGHKGTYGRSLIFAGHKGFIGAAYMVGQASIKTGAGLVTVFTHKDVQSELSIKLNEGMTGTYNSKEEYEEFIGGANVIAFGPGMGNNDLTFEVLNNICNLYSGTLVIDADGINVLKRKKSILKEFKGDIVLTPHPGEMARLLGIEIKDVERDRIGIAKDFAKENGVTVLLKGYNTIITDGDKVFVNPTGNSAMASGGMGDTLTGIITSLISQGVNSFDAAILGAYIHGYIGDELSKENFTVSAMEIIKNIPNKIKELISF

SEQ ID NO: 28915 - protein, 367 aa, Coprinopsis cinerea okayama7#130
MTSNAAELSYLSYARYGKTSVRVFRIVREGKWHHTVEYNVETLLEGDIETSYTEADNSVVVATDSVKNITYYLAKVSPHILNAEKFALHIGTFFVSKYAHIHKAHVTVEQLRWKRISINGEEHPHSFYRDGDDKRVVKAVVDATAGKHALVANVSSGLVDLLVLKSSGSAFENFWTDEYTTLVPVDDRIFSTSVDLSYTFKGVKLVAPQDDKKLEFQIPLNKGDEGYDGSVWDEDVPKRTRDATLQIFALDESASVQDQATLYKMAQRIIAENGGIQDVTYTLPNKHYIPVDMRYIGVDNLTPTRPRLNSFNLCPPLLRFIFVGGPLPNVHVSRSPVKVIVTRRVINDASCFPLQISSKERLPASFY

SEQ ID NO: 28916 - protein, 221 aa, Pseudomonas syringae pv. phaseolicola 1448A
MKHIVDGFVHFRNEVFPQQEELFKKLATAQSPRAMFITCADSRIVPELITQSSPGDLFVTRNVGNVVPPYGQMNGGVSTALEYAVVALGVQHIIVCGHSDCGAMRAVLNPDSLDKMPTVKAWLRHAEVARTVVEQNCSCSGELETMQVLTQENVISQLHHLRTHPSVAAKMASGQLFIHGWVYSIETSEILAYDAELDRFIPLDGSGPTPMASPKARFSAD

SEQ ID NO: 28917 - protein, 421 aa, Rhizobium leguminosarum bv. viciae 3841
MSDHHVVVVGGGFGGLQLVNGLKGAGVKITLVDRRNHHLFQPLLYQVATTILSTSEIAWPIRRLYADRPDVTVLLGEVTGVDSGAKTVSLRNGMTLGYDTLVLATGATHAYFGHDEWEPVAPGLKTLEDATTIRRRVLLAFEKAEMEADPAVRDALLTFTIVGAGPTGVELAGIIAELAHFTLPKEFRNIDTRKTRVVLVEAGPRVLPTFAEELSAYARKALEKLGVEIHLGKPVTECNADGVKIGETFVASRTIVWAAGVTASPAAQWLGVPADRAGRVVVEKDLSAPGLPEVFVVGDTASVMREDGKPVPGIAPAAKQQGGYVAKVIRARILGKPAPAPFRYWHQGSLATIGKSAAIIDFGRIKLKGWLAWWIWGLAHIYFLIGTRSRFSVAWSWLWIYLSGQHSARLITQRETMREEG

SEQ ID NO: 28918 - protein, 496 aa, Pseudomonas syringae pv. tomato str. DC3000
MVAELLARLGVANSAHTQGDYPVYTPIDGSQIASVTLENEAQVVARIDSAHSAFLKWRTVPAPRRGELVRIFGEVLREHKADLGELVSVEAGKITQEGLGEVQEMIDICDFAVGLSRQLYGLTIASERPGHHMRETWHPLGVVGVISAFNFPVAVWAWNTTLALVCGNPVIWKPSEKTPLTALACQALFDKALTIFGDAPAALAQLVIGDRDAGEALVDDPRVPLISATGSTRMGREVGPRVAARFGRTILELGGNNAMILAPSADLDLAVRGILFSAVGTAGQRCTTLRRLIVHRSIKDEVVACVKAAYAKVRVGDPREGNLIGPLIDQQAFSAMQNALTKARDEGGQVFGGERQLQDKYPNGYYVTPAIAEMPGQTEVVRHETFAPILYVLAYDDFEEALRLNNEVPQGLSSCIFTTDLREAEAFQSAAGSDCGIANVNIGTSGAEIGGAFGGEKETGGGRESGSDSWRAYMRRQTNTVNYSRELPLAQGIVFD

SEQ ID NO: 28919 - protein, 828 aa, Salmonella typhimurium LT2
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPMLRMKDGSYHKDGEFTPVSWEQAFDVMEEKFKTSLKEKGPEAIGMFGSGQWTIWEGYAAAKLFKAGFRSNNIDPNARHCMASAVVGFMRTFGMDEPMGCYDDIEQADAFVLWGSNMAEMHPILWSRITNRRLSDPNVKVAVLSTFQHRSFELADNGIVFTPQSDLVILNYIANYIIQNNAVNQDFFTKHVNLRKGATDIGYGLRPTHPLEKAAKNPGSDASEPMSFDEYKAFVAEYTLDKTAEMTGVPKDQLEQLAQLYADPNKRVISYWTMGFNQHTRGVWANNLVYNLHLLTGKISQPGCGPFSLTGQPSACGTAREVGTFSHRLPADMVVTNEKHRDICEKHWQIPAGTIPAKVGLHAVAQDRALKDGKLNVYWVMCNNNMQAGPNINEDRMPGWRDPRNFIIVSDPYPTVSALSADLILPTAMWVEKEGAYGNAERRTQFWRQQIKAPGEAKSDLWQLVQFSRRFKTEEVWPEALLAQKPELRGKTLYDVLFATPAVSKFPLSELKEDQLNDESRELGFYLQKGLFEEYAWFGRGHGHDLAPFDDYHNARGLRWPVVEGKETQWRYSEGNDPYVKAGEGYKFYGKPDGKAVIFALPFEPAAESPDNEYDLWLSTGRVLEHWHTGSMTRRVPELHRAFPEAVVFIHPLDAKARDLRRGDKVKVSSRRGEVISIVETRGRNRPPQGLVYMPFFDAAQLVNNLTLDATDPLSKETDFKKCAVKLAKV

SEQ ID NO: 28920 - protein, 110 aa, Porphyra tenera
MKKKFSVLFTVFSFFVIGFAQIAFAADLDNGEKVFSANCAACHAGGNNAIMPDKTLKKDVLEANSMNTIDAITYQVQNGKNAMPAFGGRLVDEDIEDAANYVLSQSEKGW

SEQ ID NO: 28921 - protein, 482 aa, Oryza sativa (japonica cultivar-group)
MPRALQRSGSNSLAALLRADPPPNAAIADQDDAKRPGRRRRRRRRSCLRLPLGVGAGGCRVCACDEMDPATAAPRRRAPEEKDDDEEEEEAVPARRAAVLLVEEGGGRRPPRRGLGMVTGRLRDLTLAPQFMRMRRLEARPHRTPWLFLFGVEGDGWGATAAATAVHALDVDAQRWRRVGADGLRGRFLFSVAGVGDELYVVGGRSGDAGSVKTKTHKGVLVYSPLAGAWRKAASMRSARSRSVLGVFEMGTISRSILLARADKHVHRHANTGGGKFRLGGTSAVYEDPHRLSLRRLRLRDVLNDDADSSEFAATDAKVAGQEEERRAQQRLALIAVGGRGRWDEPLVSGEIYDPVTDKWFEIAGFPADVGLACSGAVCGQMFYVYCESDTLVAYHPRQGLLVRHPDVPPAAAAPRLRADAAVLLVAAADALRLVMMMTHSFLACYFCPGAIAQGRVSQDVDLFQVLNCVLGERHMQHFCHV

SEQ ID NO: 28922 - protein, 618 aa, Ustilago maydis 521
MVDTRAYTVDAQLSAAADDSQSHRRRQSYMHGLLLLLIVVFLWTASNFLTNALLTTGGYDKPFFVTYANTSSFALYLVPYLVSSRLRKRWSNAAANPHTYTSLPQHDVEADADQSEHHIQDDKDELPKWLKTLGFDVPTVTPDQSVAAASTAAVVVTPTVKPFALLAEDQQQQQQQQQQQPRGRGGKKASCTNLNHKPIRLTRSFSHCQQQQYQQDDSSTASTPLLAPTPPVSRPSSPVRPFLVSTSVPRPSSIDGRRPRTSISIVRAADGNASAIPAVPVAALPLPPLTLRETAILASQFTLVWFGANWAINAGLGLTSVASGTTIGSASGFFTLALGAALGVDRFTLARLGAVCISALGVAAVTFADRDSATSTITVSSEAILDGLWRRSWTSTSAASMHSFVSKPPNAPLGDMLALLSALLYSLYVMLLKTRIGSEDRISMPLMFGMVGAINIVCLWPMLPLLHFARIESFSLPPSPSIWAGVVLNMCITLVSDFIYLLAMLKSSPLITTLGLSLTIPLAVVIDALKGSHTGGVVAVVGSTAVLSSFGFIGWDDHRLFQQESAKALATAAASAELGEQHHAPHEHHAHCHMNRVHPPSIPPRTPTTSSAITVVSD

SEQ ID NO: 28923 - protein, 174 aa, Dendrobium grex Madame Thong-In
MGRGRVEMKRIENKINRQVTFAKRRTGLLKKAYELSVLCDVEVALIIFSNRGKLYEFCSSRSMLKTLEKYQKCSDGAPEMTMTSRETQSSQVEYLKLKSQVEALQRSQRNLLGEDLNPLGGKDLDQLERQLEASLKQIISTRMQYMLDQLGDLQQRELLLFETNKSLGTRVSAL

SEQ ID NO: 28924 - protein, 304 aa, Staphylococcus aureus subsp. aureus MRSA252
MTNKVVILGSTNVDQFLTVERYAQPGETLHVEEAQKAFGGGKGANQAIATARMQADTTFITKIGTDGVADFILEDFKAAHIDTSYIIKTAEAKTGQAFITVNAEGQNTIYVYGGANMTMTPEDVINAKDAIINADFVVAQLEVPIPAIISAFEIAKAHGVTTVLNPAPAKALPNELLSLIDIIVPNETEAELLSGIKVTNEQSMKDNANYFLSLGIKTVLITLGKQGTYFATKNQSQHIEAYKVNAIDTTAAGDTFIGAFVSRLNKSQDNLADAIDFGNKASSLTVQKHGAQASIPLLEEVNQV

SEQ ID NO: 28925 - protein, 485 aa, Nocardioides sp. JS614
MNGLDLLGPTQRGLLIGGTWRDAEGGKRLDVIDPADGSVLTDVADGSVADAVDALDAAVAAQADWAATPPRQRGELLRTAFELIIERSEQFAHLMSLEMGKTVAEAAGEVTYGAEFFRWYAEEAVRIHGRWMQAPGGGSRLLTIKKPVGPCLFITPWNFPLAMGTRKIGPAVAAGCTMVVKPASQTPLSMLALAAVLEEAGLPAGVLNVVTTSHTGEFSETLQADDRLRKVSFTGSTGVGRVLVRQSADRLQRVSMELGGNAPFLVFEDADVDAAVDGAMVAKMRNMGEACTAANRFLVHASVADDFAEKLGKRMGALSLGRGQDDGVDVGPLIDERAVESVSQLVTDAVHDGATVVTGGRPVDGPGYFYPPTVLLGVPADSEINVQEIFGPVAPITTFDSEADAIRMANDTEYGLASYVYTRDLARTIRLAEALEFGMVGVNTGLISNPAAPFGGVKSSGFGREGGFEGIEEYLETTYVALPAG

SEQ ID NO: 28926 - protein, 372 aa, Archaeoglobus fulgidus DSM 4304
MKDGLEDVIACKTTISRIALENGRAILEYRGYDIRDLARKASYEEVAYLLLYGELPKKYELQDFKIELAERRELPPQIIGLLTHLPPYTHPMVVLRTATSYLGSLDKKIAVRTREETFNKAKDLIAKFPTIVAYYHRIRTGRNIIPPALEFSHAANFLYMLHGEEPTKTAERALDMDLILHAEHELNASTFAARIAASTLADIYACVVAATGTLMGPLHGGAAQEVMRMLREVASPRRAEEYVKRKIEAGERIMGFGHRVYRGVMDPRAELLRYLAKRLAAEGSTKWFEISEAIAKAAYKYKKLLPNVDFYSASVYANLGIPDDLFVNIFAMGRISGWTAHIIEQYENNRLIRPRAEYVGEKEKKFIPLSKR

SEQ ID NO: 28927 - protein, 220 aa, Dendrobium grex Madame Thong-In
MGRGRVELKRIENKINRQVTFAKRRNGLLKKAYELSVLCDAEVALIVFSNRGRLFEFCSSTSMTKTLERYQKCSYNASESAVPSKDAQNSYHEYLTLKAKVEYLQRSQGNLLGEDLIELSSKELDQLELQLEMSLKQIRSTKTQLMLDQLCDIKRKEQMLHEANRALSMKLKEDGPEIPLELSWPGGETNGSSERQQPQSDKFFQPLPCSNPSLQIGYSP

SEQ ID NO: 28928 - protein, 526 aa, Oceanospirillum sp. MED92
MTKDIHAQRILILDFGSQYTQLIARRVREIGVYCEIHAWDMSEEDIREFAPKGVILAGGPESVTEGDSPRAPEVVFDLDVPVLGICYGMQTMAAQMGGEVSTSDKREFGYAQVRLESSPSRLLEGIEDHVANNGSLSLDVWMSHGDKVTALPEGFTVIASTESAPIAAMCHPEKQFFGVQFHPEVTHTKQGGRILERFVVEICGTEALWNSANIIKDQIEKVREQVGNQKVLLGLSGGVDSSVVAALLHKAIGDQLTCVFVDNGLLRKQEGDQVMDMFAKNMGVRVIRADAEDLFLGRLEGENDPEKKRKIIGNTFIEVFDDEATKLSDVNFLAQGTIYPDVIESAAAKTGKAHVIKSHHNVGGLPEDMQFELVEPLRELFKDEVRKLGLELGLPYDMVYRHPFPGPGLGVRILGEVKKEYADILREADAIFIEELHKADWYHKTSQAFAVFLPVKSVGVVGDGRRYEYVIAIRAVETIDFMTARWAHLPYELLETVSSRIINEIPKVSRVTYDVSSKPPATIEWE

SEQ ID NO: 28929 - protein, 334 aa, Erwinia carotovora subsp. atroseptica SCRI1043
MKTLGEFIVEKQHDFSHATGELTALLSAIKLGAKIIHRDINKAGLVDILGASGISNVQGEVQMKLDLYANEKLKAALKARGEVAGIASEEEDEIVIFEGDKAENAKYVVLMDPLDGSSNIDVNVSVGTIFSIYRRITPLGTSVTEADFLQPGSQQVAAGYIVYGSSTMLVYTTGHGVHAFTYDPSLGVFCLSHEKVCFPEKGNMYSINEGNYIKFPSGVKKYIKYCQEQDEETQRPYTSRYIGSLVADFHRNLLKGGIYLYPSTASYPKGKLRLLYECNPMAFLAEQAGGKASDGKHRILDITPEKLHQRSPFFVGTESMVDDVERFIREFPDA

SEQ ID NO: 28930 - protein, 451 aa, Cryptococcus neoformans var. neoformans JEC21
MSNYPSEPEFQQAVAEITQTLEPFLAKNPEYRRALDVVQVPERIVQFRVTWERDDGTIAINRGYRVQFNSALGPYKGGLRLHPTVNLSILKFLGFEQIFKNALTGLMMGGGKGGSDFDPKGKTDSEIRRFCYAFMQELSRHIGTDTDVPAGDIGTGGREIGFMFGAYKKYRNENAGILTGKGADWGGSHIRPEATGYGLVYYVTEMLRDLDNTDWKGKRVLISGAGNVAQYAALKVIELGGTVLSLSDSTGALVATGDEGFTPEEIMNIADIKLQRKSLTAFATGSKFQWHEGKRPWTLVSNADIALPSASQNELNDEEAKALIKAGVRYVAEGSNMGCTLDAIKIFEESRTAAKNATDAGVCFYAPGKAANCGGVAVSGLEMAQNSQRLKWTHEEVDAKLKAIMINCYQTCWETGKQYAEAGVVPSLVAGANIAGFVKVANAMREQGDWW

SEQ ID NO: 28931 - protein, 335 aa, Alteromonadales bacterium TW-7
MAKQTITVIKGDGIGPSIIDSALEILKAAGCDFDYEFVDAGLAALEKTGELLPQETIDTIAKNKITLKGPLTTPVGEGFTSINVTLRKQFGLYANVRPVKSFVGTKARYDDIDIITIRENTQGMYSGAGQVVSEDGNEAEAKSVITREGAEKIVTFAYELAVREGRKKVTAVHKANILKSTSGLFLKVAREVAERYPQIESTEMIVDATCMKLVMTPEEFDVVVTTNLFGDILSDLCAGLVGGLGMAPGANIGEDAAIFEAVHGSAPDIAGKNLANPTSVILASIQMLEHLNMGDTAERIRSAVADVIKSGDRTTRDLGGSHGTTDFTQSVIDRL

SEQ ID NO: 28932 - protein, 76 aa, Glycine max
MGCAGSSQSKPDGAVKKIRKPKPWKHPQPITKTQLTQLRDEFWDTAPHYGGRKEIWDALRAAAEADLTLAQAIVDS

SEQ ID NO: 28933 - protein, 393 aa, Fusobacterium nucleatum subsp. vincentii ATCC 49256
MAKRDYYEVLGIDKNASEDDIKKAFKKAAMKYHPDRFANASDAEKKDAEEKFKEINEAYQVLSDAQKKQQYDQFGHAAFEQGGAGFGGGFNAGGFDFGDIFGDIFGGGGSFGGFEGFSGFGGSSRRSYVEPGNDLRYNLEITLEEAAKGVEKTIKYKRTGKCEYCHGTGGEDDKMKTCPTCNGQGTIKTQQRTILGVMQSQSVCPDCHGTGKVPEKKCKHCRGTGTAKETVEKKINVPAGIDDGQKLKYAGLGEASQSGGPNGDLYIVIRIKPHDIFIRQGDNLYCEVPISYSTAVLGGEVEVPTLNGKKTVKVPEGTESGKLLKVSGEGIKSLRGYGKGDIIVKLTIETPKKLTDKQKELLQKFEESLNDKNYEQKSSFMKKVKKFFKDIID

SEQ ID NO: 28934 - protein, 321 aa, Oryza sativa
MAKFTLDDADDDPPVATARDKRKRDDGPADAEDEPPRARGSAVAGREPAAPGAEAEAAGRRGPAEEMANGEVEGGLSVQIDPDVLDCSICFESLRPPLYQCQNGHVACFSCWSKLSNKCHICSRDAKFARNIALEKIVESIKSSCSYAKWGCCKFINYAQRDAHEEACLFAPSVCPISNCGYRGFTGRWSGHFLTSHSSDVMRFIYGQPFEVNIEVSVPFLVFLGEDDHLFLLQNNNLTPFGHAFSVVCLRSGNLNWMFSYQIEATSRKKPENRLQLKASVTNTRQWTGIYPSEAFLLVPFDFCHSSNIVLNISIERYAVV

SEQ ID NO: 28935 - protein, 468 aa, Agrobacterium tumefaciens str. C58
MLQQNCKWRAQIACLPPGQGFYGSMLSSSNTPLTGPNDRQTSIAFFERASTVFPGGVTRATIELDPHPIFVAYGEGAFVTDVDGHRMLDLNNNFTTLIHGHAYPPITEAIAGLLRTGSCFANPMNHEIDLAELLVGRIPAVEQVRFVASGTEAVMFAIKAARATTGRVAIARVEGAYHGAYDWAEAGQHASSNTPCAAYPGMPASVIDDVVLLQFNCPAELEQQIAMNAGRLAAILIDPMPSRAGLIEPTEEFIATINKVAKQHGIVIIADEVLNLRQGFAGASARYGLKPDLVTMGKIIGGGFPIGAVGGRREIMSAFGKQGSKAPLTQGGTFAANPVSMVAGRLAMEALTQDAFQRLEHMGNLVREGLRSRIERHGANLSVTGAASLFRIHAKKVAPVSYQDSIPTASEDVVLKLLRRHFANNGILMPYGAAASLSTPMTDNDMGDIVSVFDDFLVNLDRHAWEAA

SEQ ID NO: 28936 - protein, 364 aa, Candida tropicalis
MTPNPSLVLNKVDDISFEEYEAPKLESPRDVIVEVKKTGICGSDIHYYAHGSIGPFILRKPMVLGHESAGVVSAVGSEVTNLKVGDRVAIEPGVPSRFSDETKSGHYHLCPHMSFAATPPVNPDEENPQGTLCKYYRVPCDFLFKLPDHVSLELGAMVEPLTVGVHGCKLADLKFGEDVVVFGAGPVGLLTAAVARTIGAKRVMVVDIFDNKLKMAGDMGAATHTFNSKTEGDYEALIKKFDGVQPAVVLECSGAQPCIYMGVKILKAGGRFVQIGNAGGDVNFPISDFSTRELSLHGSFRYGYGDYQTSIDILDRNYANGKDKAPIDFELLITHRFKFKDAIKAYDLVRAGNGAVKCLIDGPE

SEQ ID NO: 28937 - protein, 414 aa, Zea mays
HISIWYWRWAPGPEIPAALKYYNPRGQATGMFASICRRRLLRLCQIPFGTGAIPSDALPHCHSLATIADAPVSEPCAALVSCGLSPAAAVAHRLPIRSTAKADAVRALLRSYGFTDAEVADLVRRLSQILSVDPDRIRPKLDLFASLGVKPRRLARYPALLTRSLDKHLVPCIQFLRNILSTDEDVCLAISRTPRALSAGLEKIMRPALDTLRRLGLPDESISKLVVIEMGVLMMSPDRICQIFEALKELGLGVTEKRFPYGIRALCCISREKWLHRVALYRSFGVSEGELQRAFKKQPNIVNFSDEIIKKKIRFFLDVLKVELSEVMEQPAIIGYSLERNIIPRCAVLSLLMREGKIGPNVKLISALLGSANMFSTRYVLRYANELPDVVKAYEGKITFDGFREQDLLVPLKL

SEQ ID NO: 28938 - protein, 477 aa, Leptospira interrogans serovar Lai str. 56601
MSLLPTVCIIGAGPSGIAVCKALKDKGIPFECYEAGSEVGGNWKFKNDNKMSSIYKSLHTNTHKDKMQYKDYPMPNSYAAYPDHQKISEYFINYVNHFGFRDHIFFKTPVTHVKHEEDGTWSILTEDGKQKYYDVLIVSNGHHWSQRWPKPDFPGKFTGDIIHSHSYIDPNKPIQLTGKRVVILGMGNSAMDIAVELCRPGISSKVFLAARRGAYIIPNYLFGKPLDKIATLFPVHTPFWLKSLIIKFALKLGVGNVEDFGLQKPDHKPGAAHFTISQDILVRLGRGDIIPKPNIESYNGNKVKFVDGSEEEIDVIIYCTGYDVKFPFFDENFLSAKDNHLPLFHRMVKPEFKNLFFVGLFQPLGPIAPLSEFQGKWISEYLVGNYEFPSEEKMNQSIEKYESKMKRRYITSARHTMQVDFEVFLYDMKSELKKGIKRAAKNGNKLPVPALAQNKSILSNDISVKRFKNKTELFSEI

SEQ ID NO: 28939 - protein, 592 aa, Desulfovibrio desulfuricans G20
MARLILHGIPVSAGISIGKAFFAWRDNISTLPRGIVTPGAAQSEVERLESAVEAVQNELTQARNRVPAELKDHAAIIDSHLLIAADPKLIKDAARRIQEQNITAEWALEQAVEAIALAFSSIEDDYIRERVQDVRVVADRISKRLMGASGCLKRPLQERMVLMAHDLAPADTMELPLDKIMSFATSEGGKTSHTGILARSMLIPAVVGVSNLEEHVNDGDLVIVDALRGFIIVDPNEDELADYTELKFQFEAYQKALHKECRLPAETVDGYRVEVVANIEMTEEVAQVLDSGGEGVGLYRTEYAYLSRPALPTEDQLYEEYSELASIMAPGKVIFRTLDVGADKMLTEQTLMREPNPALGLRAIRYCLRNIDVFKTQLRAILRASVHGNVALMFPMISGLQELRQAKVLLNEVRMELDRARQPYNPNMPVGIMIELPSAVLIADSLAQEVDFFSIGTNDLIQYSLGIDRGNKHVSYLYQPLHPAIVRSIKFVVDAAHREGIEVSVCGEVAADPYCIPILLGMQIDAISIAPQSIPGIKRIIRRTNMEECKTLLNEVLRTATVARINRVVKDTIFKQFPEELTFYSSLIDHDD

SEQ ID NO: 28940 - protein, 467 aa, Mucor circinelloides
MSSDVGATVPHFYTRAELADIHQDVLDKKPEARKLIVVENKVYDITDFVFDHPGGERVLLTQEGRDATDVFHEMHPPSAYELLANCYVGDCEPKLPIDSTDKKALNSAAFAQEIRDLRDKLEKQGYFDASTGFYIYKVSTTLLVCIVGLAILKAWGRESTLAVFIAASLVGLFWQQCGWLAHDYAHYQVIKDPNVNNLFLVTFGNLVQGFSLSWWKNKHNTHHASTNVSGEDPDIDTAPILLWDEFAVANFYGSLKDNASGFDRFIAEHILPYQTRYYFFILGFARTSWAIQSIIYSFKNETLNKSKLLSWCERIFLIVHWVFFTYCTIAWISSIRNIAMFFVVSQITTGYLLAIVFAMNHNGMPVYSPEEANHTEFYELQCITGRDVNCTVFGDWLMGGLNYQIEHHLFPEMPRHHLSKVKSMVKPIAQKYNIPYHDTTVIGGTIEVLQTLDFVQKISQKFSKKML

SEQ ID NO: 28941 - protein, 556 aa, Clostridium perfringens ATCC 13124
MKNDIEIAQSAKMEPIINIAKKIGLGEDDIELYGKYKCKISLDAIKKLENNKDGKLVLVTAINPTPAGEGKSTVTVGLGQALNKIGKNTVIALREPSLGPVFGIKGGAAGGGYAQVVPMEDINLHFTGDMHAITSANNLLCAAIDNHIHQGNLLRIDSRRIVFKRVMDMNDRALRNIVVGMGGKINGFLREDGFMITVASEIMAILCMASDLEDLKERMGNILIAYNLDGEPVYAKELEVQGAMALLMKDAIKPNLVQTLENTPAIIHGGPFANIAHGCNSIIATKTALKMSDITITEAGFGADLGAEKFLDIKCRYGNLNPDCVVLVATIRALKHHGGVKKDELNISNVDALNKGMKNLEKQIENIKAYGVPVVVAINKFITDSDEEVKAIEDFCKNIGVEVSLTEVWEKGGEGGIDLANKVIKTMETEPSNFKMIYDSEESINDKILKIVQTIYGGKGVNYTPQALKQIAEIEKFNLDKLPICMAKTQYSLSDNPSLLGRPENFDITVREVRVSNGAGFIVVLTGDVMTMPGLPKVPAANRMDIKDNGEIVGLF

SEQ ID NO: 28942 - protein, 518 aa, Erwinia carotovora subsp. atroseptica SCRI1043
MMKGHDRKREGDLPDSVFYAEWVRREEARAARESGISLWELMQRAGEAAFLVARQCYPSARRWRVLAGHGNNGGDGYVVASLALAAGMAVDVVACASDKPLPDDANLARQRWLDQGGRVEEVRAQDDVDTLWPEGIDLIIDGLLGTGLSAAPRAPYAALISQANIYLAPIVSLDIPSGLHAETGACAGIAICASQTVTFIALKPGLLTGRAREQVGKLHYHSLGLQAWLNDQTAPIRRLTAAQLPEWLTPRSAGQHKGDNGRLLVVGGNAGLGGAVLMAADAALHSGAGLVRVLTHKQYQSAFLTVRPELMVQELTTDTLRKGLEWADVVVIGPGLGQDEWAKNALRLAENCNKPMLWDADALNLLAINPHKRQNRVLTPHPGEAARLLNCRVSDIESDRLLAATKLVKRYGGVVVLKGAGTVIASENEEVAIADVGNPGMATGGMGDVLSGIVGGLLAQKLSLYDAACAGCVVHGAAADWLATRRGTRGMLATDLLPVLFRYVNPERMFPEPIFLEQ

SEQ ID NO: 28943 - protein, 118 aa, Zea mays
MAGLQRSSQTFRRSGSSGLVWDERLTSQDDDQSGPEDADAATDLKELRHSRSVGSVGLQPQPQPQPQRRRSDDSGQGFRTRRVAPALDPPSPKVPGCIFCGIFRKAGASEPKSKPRRY

SEQ ID NO: 28944 - protein, 331 aa, Cryptococcus neoformans var. neoformans JEC21
MCVTFFTLSQPGYKLILAFNRDEFLDRPTLPAHWHDFNSPSPLTPTLYKFNNFTDPCSRENKESDDGGRVLSGLDRGKAEGGTWLGISKDLKVALLTNIARIRPAPGVQPLSPPPSRGKLLREFLSPSPLTSSQLETQSYISSHFPTAGDYEGFNLLLFSLSPERNIGYLTNRPSPSSLDLTSSLCGGEDGQRRCVGLSNSPLDEKWPKVQQGEKNMEKSLREWEEKREGEDRLVERMFRVLSPSRPITCDDDLTLSTTIPPIKLGEDLFLNTDPQNTRARWKGTRTATVIIVKDSGETTYVERDIWMIDEDGEPKKGEDERRFKFVGEEK

SEQ ID NO: 28945 - protein, 542 aa, Capsicum annuum
MPMENETRDLIFRSKLPDIYIPKHLPLHSYCFENISEFNSRPCLIDGANDQIYSYAEVELTSRKVAVGLNKLGVQQKDTIMILLPNSPEFVFAFMGASYLGAISTMANPLFTPAEVLKQAKASSAKIIITLACYIGKVKDYATENDVKLICIDSAPEGCIHFSELTQSDEHEIPDVKIQPDDVVALPYSSGTTGLPKGVMLTHKGLVTSVAQQVDGENANLYMHSEDVLMCCLPLFHIYSLNSVLLCGLRIGASILIMQKFDIVHFLELIQKYKVTIGPFVPPIVLAIAKSPLVDHYYLSSVRTVMSGAAPLGKELEDTVRTKFPNAKLGQGYGMTEAGPVLAMCLAFAKEPFEIKSRACGTGARNAEMKNVDPDTGCSLPRNQPGENCIRGDQIMKGYLNHLESTTRTIDKKGWVHTGDMGFIDNDDELFIVDRLKELIKYKGFQVAPAELEALLLNHPNISDAAVVPMKDEQAGEVPVAFVVRSNGSTITEDEVKDFVSKQVVFYKRIKRVFFVETVPKSPSGKILRKDLRARLAAGVTN

SEQ ID NO: 28946 - protein, 425 aa, Oryza sativa (indica cultivar-group)
MATASSFTAAAKFLAPVSARSAGDYKPPLPLPASASLRPGRKPAPRLRTALAVSSDVLPGNKAAPTATAHSAVTREEALELYEDMVLGRIFEDMCAQMYYRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSRPDGLDVTLAFFGDGTCNNGQFFECLNMAQLWKLPIVFVVENNLWAIGMSHLRATSDPEIYKKGPAFGMPGVHVDGMDVLKVREVAKEAIERARRGEGPTLVECETYRFRGHSLADPDELRRPDEKSHYAARDPITALKKYIIEQNLATESELKSIEKKIDDVVEEAVEFADASPLPPRSQLLENVFSDPKGFGIGPDGKYRCEDPLFTQGTAQV

SEQ ID NO: 28947 - protein, 452 aa, Pseudomonas syringae pv. phaseolicola 1448A
MAFDFDLFVIGAGSGGVRAARFAAGFGAKVAVAESRYLGGTCVNVGCVPKKLLVYGAHFSEDFDHAKGFGWSLGEASFDWSTLIANKDREINRLNGIYRKLLVDSGVTLLEGHARLVGPQRVEINGQSYSAERILIATGGWPQVPDVPGREHAITSNEAFYLKTLPKRVVVVGGGYIAVEFASIFNGLGADTTLVYRRELFLRGFDGGVRTHLHEELLKRHMTIRFNSDIERIDKQADGSLLLSMKGGGTLETDCVFYATGRRPMLDNLGLDSVDIKLDEHGYIKVDEHYQSSEPSILAIGDVIGGVQLTPVALAEGMAVARRLFKPEQYRPVDYNHIPTAVFSLPNIGTVGLTEEDAIKAGHDVQVFESRFRPMKLTLTDDQERTLMKLVVDAKTDRVLGCHMVGPDAGEIVQSLAIAIKAGATKQVFDDTIGVHPTAAEEFVTMRTPAKR

SEQ ID NO: 28948 - protein, 435 aa, Arabidopsis thaliana; identical to SEQ ID NO: 1125

SEQ ID NO: 28949 - protein, 328 aa, Escherichia coli O6
MSHVELQPGFDFQQAGKEVLAIERECLAELDQYINQNFTLACEKMFWCKGKVVVMGMGKSGHIGRKMAATFASTGTPSFFVHPGEAAHGDLGMVTPQDVVIAISNSGESSEITALIPVLKRLHVPLICITGCPESSMARAADVHLCVKVAKEACPLGLAPTSSTTATLVMGDALAVALLKARGFTAEDFALSHPGGALGRKLLLRVNDIMHTGDEIPHVKKTASLRDALLEVTRKNLGMTVICDDNMMIEGIFTDGDLRRVFDMGVDVRRLSIADVMTPGGIRVRPGILAVEALNLMQSRHITSVMVADGDHLLGVLHMHDLLRAGVV

SEQ ID NO: 28950 - protein, 389 aa, Chlamydomonas reinhardtii
MADPGAQPVPAPQSAEEPVTGGLQESVEVTASGKLDSYNREYNQFLVCGSLFECPAKYLPIKPIGKGAYGVVCSAKNLDNQEKVAIKKIANAFDNVIDAKRTLREIKLLRHLQHENIVQIKDIIPPTNRDAFKDLYVVYELMDTDLHQIIRSPQALSNDHSQYFLYQLLRGLKYIHSANILHRDLKPSNLLVNANCDLKICDFGLARTSTSNEKEFMTEYVVTRWYRAPELLLSCSGYTTAIDVWSVGCIFAELLGRKPLFPGKDYVHQLSLITKVIGSPSEEELGFITSEKAKRYIRSLPRSERVDFGQLWPHVTKTALDLIDKMLVFDPTKRITVEQALEHPYLASLHDVSDEPVCPTPFTFDFDSEHLTPDVVREVILQDMAELHT

SEQ ID NO: 28951 - protein, 489 aa, Agrobacterium tumefaciens str. C58
MRERSMIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQEAVAKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 28952 - protein, 186 aa, Oryza sativa
MAVVRQLLVHRLSCSGLPASRCKTSCWSSGERLPGLKSRVRLLAVAIKPPRAAAGKDEIVRADDDDDGVSLGTVKLPANIDIARFETLLFQWGNSLCQGATLPLPVPLRVDKVEGGVRLGFMAVDDGVTQVLVYIDCLVSPATDASGPVFRAIRNGPMKDQEPPGEPRIMRSLLEALQKCIQYAQV

SEQ ID NO: 28953 - protein, 115 aa, Desulfovibrio desulfuricans G20
MNIIKKIELEQMRLDIPKFKSGDSVKVHMRIVEGEKERIQVFHGNVIRISRGTTNATFTVRKISNGVGVERVFPMHSPFIDRIEVVQQGRVRRSRLYYLRNLKGKAARIKPLKTW

SEQ ID NO: 28954 - protein, 461 aa, Chlamydomonas reinhardtii
MALSMKMRANARVSGRRVAAVAPRVVPFSSASSSVLRSGFALRCLWTSAAWAALASVVEAVKKSVGDLHKADLEGKRVFVRADLNVPLDKATLAITDDTRIRAAVPTLKYLLDNGAKVLLTSHLGRPKGGPEDKYRLTPVVARLSELLGKPVTKVDDCIGPEVEKAVGAMKNGELLLLENCRFYKEEEKNEPEFAKKLAANADLYVNDAFGTAHRAHASTEGVTKFLKPSVAGFLLQKELDYLDGAVSNPKRPFVAIVGGSKVSSKITVIEALMEKCDKIIIGGGMIFTFYKARALKVGSSLVEDDKIELAKKLEEMAKAKGVQLLLPTDVVVADKFDANANTQTVPITAIPDGWMGLDIGPDSVKTFNDALADAKTVVWNGPMGVFEFPQVRQRTVSIANTLAGLTPKGCITIIGGGDSVAAVEQAGVAEKMSHISTGGGASLELLEGKVLPGVAALDEK

SEQ ID NO: 28955 - protein, 417 aa, Aspergillus oryzae
MSLSNKLAITDVDLKDKRVLIRVDFNVPLDADKKITNNQRIVGALPTIKYAIENGAKAVVLMSHLGRPDGKANPKYSLKPVATELEKLLSKSVIFAENCVGKETEEIVNKATGGQIILLENLRFHAEEEGSSKDAEGKKVKADKEKVEEFRKGLTALGDVYINDAFGTAHRAHSSMVGVDLPQKASGFLVKKELEYFAKALESPQRPFLAILGGAKVSDKIQLIDNLLPKVNSLIITGAMAFTFKKTLENVKIGNSLFDEAGSKIVGDIVEKAKKNNVKIVLPVDYVTADKFAADAKTGYATDADGIPDGYMGLDVGEKSVELYKKTIAEAKTILWNGPPGVFELEPFANATKKTLDAAVAAAQSGSIVIIGGGDTATVAAKYGAEAKLSHVSTGGGASLELLEGKVLPGVDALSSK

SEQ ID NO: 28956 - protein, 204 aa, Alteromonadales bacterium TW-7
MQVTQQNQTQVDFAKSEMIPAIVQDARSGVILMQGFMNSEALKATLESNKVTFYSRSKSRLWTKGESSENYLNVVSVHTDCDYDSILVLANPEGPTCHLGTQSCFGDDAKPSLSFLAQLEDVIVERKNDDPAKSYTASLFAKDLSRSCQKVGEEGVEVALAAMKHDNDELTNESADLIYHLTVLLQRQGLALEDVVKCLQGRHK

SEQ ID NO: 28957 - protein, 417 aa, Candida maltosa
MSLSNKLSVKDLNVTGKRVFIRVDFNVPLDGKTITNNQRIVAALPTIKYVEEQKPKCIILASHLGRPNGERNEKYSLAPVAAELEKLLGQKVTFLDDCVGPEVTKAVDSATEGQIFLLENLRFHIEEEGSAKDKDGKKTKADPEAVKKFREQLTSLADVYVNDAFGTAHRAHSSMVGLEVPERAAGFLMSKELEYFAKALENPQRPFLAILGGAKVSDKIQLIDNLLDKVDMLIVGGGMAFTFKKVLNNMPIGDSLFDEAGAKNVENLVAKAKKNNVELILPVDFVTADKFDKDAEVSTADDVTGIPDKWMGLDCGPKSRKLFADAVAKAKTIVWNGPPGVFEFDKFAEGTKSLLDDAVKSAEVGNIVIIGGGDTATVAKKYGVVDKLSHVSTGGGASLELLEGKELPGVTALSNKA

SEQ ID NO: 28958 - protein, 407 aa, Clostridium perfringens ATCC 13124
MRYIVVGASAAGISGAKTLRELDKDAEIILVSKDENVYSRCILHHYISGHRDIEALDFTDRDFFEKYNIEWKKGLEVKAIDDREHVIVLSNGESLKYDKILLATGASAFIPPVENLREAKNVVGLRNLEDAIKIKEEAEKVKNVVVLGAGLVGIDAIAGLAFKDLNVTLVEMGDRVLPIQLDKYASSKYEKRFEDAGVKLKLGVRAEKVLIDENKNPKALLINTGEEIPCELIIVATGVRSNVAFLKDSSIETDRFGLIINEKGETNARDVYGAGDITGRNPIWPTAVKEGIIAANNMVGNEIFMEDFFGSKNTMNFLGLTTMSLGVVNAPDDSYTEEIDISGENYKKIIHKDGKIYGAIIQGDLSYAGVLTQLIKEKIHVSKVKKPLFEIDYADFFNIKENLEYTY

SEQ ID NO: 28959 - protein, 353 aa, Alteromonadales bacterium TW-7
MSNPYLFIDRDGTIIEEPITDKQVDSLEKLAFLPGVIPALLQLQAAGYRLVMVSNQDGLGTDSFPTADFDIAQDKMMDIMQSQGISFDEVLICPHFDEQNCDCRKPKTGLLTELMRSGKVDLARSYVIGDRQTDIGLAQNLCCEGILYDGSWPAIVTKLTTANREGRVTRNTKETQIDVAINLDQTKNGSIETGLGFFDHMLDQIRTHANIGLNIKAKGDLHIDEHHLVEDIGIALGVALKQALGTKSQIARYGFALPMDECKAEAQIDLSGRASFVLNANFSREKAGDLDVQMVEHFFKSLSDNAAISLILSVSDGNCHHQVEGLFKAFSRALRMAVAQDTTQQTASSKGCL

SEQ ID NO: 28960 - protein, 428 aa, Oceanospirillum sp. MED92
MISTEQVSFDQQHIWHPYSSMINPPPTYPVESARGVRIKLADGRELIDGMASWWSVIHGYNHPELNQAAHQQIDKMSHVMFGGLTHEPAIELCKKLVEMTPSSLDKVFLADSGSVAVEVALKMAIQYQHARGKPEKHKLITIRNGYHGDTFGAMAVCDPVTGMHEIFSGTLPKQFFAPAPQTRFEQAWDENDITPLQSLLAQNHDQIAALILEPIVQGAGGMRFYSAEYLRQARTLCDEYDVLLIADEIATGFGRSGRLFACEHAGIEPDILCLGKAITGGYMTLAATLTSSHIGETISAGGAGCFMHGPTFMGNPLACAVANKSLELLVNNDWQSNVQRIENGLKAGLLEAKNLAKVADVRVLGAIGVIEMKEAVNTSEIQKLFIERGLWIRPFGKLVYVMPPFIMQDEDLATLTSGMVESVAAYQY

SEQ ID NO: 28961 - protein, 793 aa, Clostridium perfringens ATCC 13124
MKVPFNWLKDYVDIDMTAEELGDALTLSGSKVEEVVTAGAEIENIVTCQIDKIEQHPDAEKLKICQVNIGSEMIQIVTAADNMKEHDKVPVALHGAILADGSKIKKGKLRGEVSNGMFCSEEELGIADGKEVIGLMILPEDAPIGVCIKEYLGLNKQVLDFEITSNRPDCLSVLGMARETAATTRKTYRMPSTKFEVKCDKNINDEIKVSVNDKLCNRYMARGVKNVKVAPSPTWMQERLLDAGVRPINNIVDITNFVMLELGQPMHAFDRRELKSSNIVVERAKDGDKFVTLDEIERELNSDVLCIKDGEEIVALAGIMGGLNSGVKDDTTEIVFESANFDGTNIRVNSKNLGLRTESSSRFEKDIDPNLAALALDRACALVEELGCGEIMEGTIDVYNNVKEEKTLEVSVSWINKFLGTSLEAEEMKRCLDSLDLKTTINGDTLEILVPTFRIDVDIREDVAEEVARIYGYNNIPATLISTSTEKEAKDKKQLLDEKVIDTMLASGLNQSISYSFVSPKVFDKICVPEDSSLRNVVKIKNPLGEDYSVMRTSTLPSMMESLARNYSRSNEIVRLFEIGKTYIPNSDENELPTERNILTIGIYGQCDYFDLKGIVENLLDSLGLKSASFKRMSENPSYHPGKTAELILGRTSLGVLGEIHPDVNENYGVDVPCYVAELDLDAMYNFSKTEKAYKPLPKYPAITRDIALLVDDAVLVQEIEDAIRKAGGQVVEKVELFDVYKGAQIPEGKKSIAYAIAYRDPSKTLKDKDINKVHDKILRALEYKLGAQLREQ

SEQ ID NO: 28962 - protein, 707 aa, Magnaporthe grisea 70-15
MAPDADSSKAADKGKAIETPDDVKKDKDGKTVVNGKYEDKINSTEELSEEDQQLKNELDMLVERLTESDASLYKPALEAMKNFIKTSTSSMTAVPKPLKFLRPHYETMTKLYEAWPTGDNKVSLADVLSVIGMTFSDEDRQDTLKYRLLAPSQDISSWGHEYTRHLALEIGEVYAKRIAAEESTKDLVDLALVLVPLFLKSNAEADAVDLMSELEIIEQLPKFVDENTYARVCLYVVSMVNLLTYPENEQFLRVAHDIYKQYKQHTQAMVLAIRLNDSDMIYNEFEKIEDPALKKQLAFLIARQKILLPDPDTEDQELTECLGNIRLSEHFKSLGKELNILDPKTTEDIYKSHLESSRVAGMTNLDSARHNLAAAFVNAFVNAGFGNDKMMLVDDKESWVWKTKDEGMMSTVASMGTLLLWDVEAGLDKVDKYTYADEEQIQAGALLAIGIMNSGVRLDSEPAMALLCDPDKLHHKNPLVRIAAIMGLGLSYAGSNKLELLVELVPMITDSSLDMQISAMAALSCGLIFVGTSNDEVSEAIVNTLLDEDRRSQLTDKWTRFLALGLGLLFFGQQEEVDVILETLKAVDHPVGKPIAVLAEICAWAGTGAVLKIQELLHICNEHLEESEEKKGDELLQAYAVLGIGLIAMGEDVGQEMVLRHFGHLMHYGEANIRRAVPLAMGLVSPSNPQMKVYDTLSRYSHDNPFR

SEQ ID NO: 28963 - protein, 552 aa, Cryptococcus neoformans var. neoformans JEC21
MGQTLSEPMTEKHTTDVVRGKQFWVGLSDMQGWRISMEDAHSVHLYLPPSSDDSKPHSPASDVPAQPEGSTVTNHNEPEVANAMFGVFDGHGGQTVAKFAGTTLHSRLSALDAYKSGDYITALTQAFIKTDEDLRADPSFLNDPSGCTAVVGLITTDGRIIVANSGDSRSVLGYQGQAKALSNDHKPTNEEETARITAAGGFVEFGRVNGNLALSRAMGDFEFKQNFSLAPEKQIVTVVPEIITHELDGEEEFLVLACDGIWDCLTSQQVIDFTRRAIANGDPLGKICENMMVKCLAKDSSTGGIGCDNMTVVIVALLNGRTPEEWQAWVKERVEQKVGHDTPESIPDVFPQNSGPSNSGFAGSGFRVAGGAGGLANIASILGASGITFRPAYDSDDDDDGIQLMGDGPVSPDKLSSPGLIDNEAVEGGTKPKDVTGQLEKEEEETMFGGEGKKGSVRLLDEDGDSSMDSDDSDSTTTGNDPAPQPIPSSSHQATHSPIPPNFSSIGSPTVPTPQELQGLQASNRSEPQGDAYSDAVKVEGLMDKSESPLNL

SEQ ID NO: 28964 - protein, 514 aa, Oryza sativa (japonica cultivar-group)
MAMVQDITGYLCLSLALLLLTLVLHKVARKATGNGAGKPRLPPGPWRLPVIGNLHQVAMGGPLVHRTMADLARRLDAPLMSLRLGELRVVVASSANAAREITKTHDVAFATRPWTSTIRVLMSDGVGLVFAPYGALWRQLRKIAVVELLSARRVQSFRRIREDEVGRLVAAVAAAPAAQPVNVSERIAALISDSAVRTIIGDRFERRDEFLEGLAEAIKITSGFSLGDLFPSSRLASFVGGTTRRAEANHRKNFELIECALRQHEERRAAGAVDDDEDLVDVLLRVQKDGSLQMPLTMGNIKAVVLELFGAGSETSANTLQWAMTELIMNPRVMLKAQAELSNVIKGKQTISEDDLVELKYLKLIIKETLRLHPVVPLLLPRECRETCEVMGYDIPIGTTVLVNVWAIGRDPKYWEDAETFIPERFEDGHIDFKGTNFEFIPFGAGRRMCPGMAFAEVIMELALASLLYHFDWELPDGISPTKVDMMEELGATIRRKNDLYLIPTVRVPLSTVL

SEQ ID NO: 28965 - protein, 923 aa, Saccharomyces cerevisiae
MKSDFKFSNLLGTVYRQGNITFSDDGKQLLSPVGNRVSVFDLINNKSFTFEYEHRKNIAAIDLNKQGTLLISIDEDGRAILVNFKARNVLHHFNFKEKCSAVKFSPDGRLFALASGRFLQIWKTPDVNKDRQFAPFVRHRVHAGHFQDITSLTWSQDSRFILTTSKDLSAKIWSVDSEEKNLAATTFNGHRDYVMGAFFSHDQEKIYTVSKDGAVFVWEFTKRPSDDDDNESEDDDKQEEVDISKYSWRITKKHFFYANQAKVKCVTFHPATRLLAVGFTSGEFRLYDLPDFTLIQQLSMGQNPVNTVSVNQTGEWLAFGSSKLGQLLVYEWQSESYILKQQGHFDSTNSLAYSPDGSRVVTASEDGKIKVWDITSGFCLATFEEHTSSVTAVQFAKRGQVMFSSSLDGTVRAWDLIRYRNFRTFTGTERIQFNCLAVDPSGEVVCAGSLDNFDIHVWSVQTGQLLDALSGHEGPVSCLSFSQENSVLASASWDKTIRIWSIFGRSQQVEPIEVYSDVLALSMRPDGKEVAVSTLKGQISIFNIEDAKQVGNIDCRKDIISGRFNQDRFTAKNSERSKFFTTIHYSFDGMAIVAGGNNNSICLYDVPNEVLLKRFIVSRNMALNGTLEFLNSKKMTEAGSLDLIDDAGENSDLEDRIDNSLPGSQRGGDLSTRKMRPEVRVTSVQFSPTANAFAAASTEGLLIYSTNDTILFDPFDLDVDVTPHSTVEALREKQFLNALVMAFRLNEEYLINKVYEAIPIKEIPLVASNIPAIYLPRILKFIGDFAIESQHIEFNLIWIKALLSASGGYINEHKYLFSTAMRSIQRFIVRVAKEVVNTTTDNKYTYRFLVSTDGSMEDGAADDDEVLLKDDADEDNEENEENDVVMESDDEEGWIGFNGKDNKLPLSNENDSSDEEENEKELP

SEQ ID NO: 28966 - protein, 397 aa, Burkholderia thailandensis E264
MNTAADSLLRLASRVDAIEPFYVMEIVKEAAVLERAGRDIIHMSIGEPDFTAPEPVVDAAAAALRRGVTQYTSALGIAPLREAIAAHYARAYGLSIGPERIVVTAGASAALLLACLALVGRDDEVLMPDPSYPCNRHFVATAEGRAVLVPSGPEARFQLTADDVRTRWGERTRGVLLASPSNPTGTSLEPAELGRIIDAVRARGGFSIVDEIYQGLSYDGAPVSALSFGDDVVTVNSFSKYFNMTGWRLGWLVVPPALVGTFEKLAQNLFICPSALAQHAALACFEPHTLAIYEARRAEFKRRRDFIVPAIESLGFKVPVMPDGAFYVYAQCGGVAHPAAGDSAALVNAMLHDAGVVLVPGMDFGVHAPRDYIRLSYATAYSRLEEAVERLGKLFGR

SEQ ID NO: 28967 - protein, 219 aa, Lactobacillus delbrueckii subsp. lactis
LQIAGVDALELAAKYQTPLQVFDVGKIRQAIRAFKRVFEEEGVDYEVSYASKAFSCLAIYQVINEEGGHTDVVSGGELWTAMKAGFPMDKVSFHGNNKSRAELEMAVDQGVGVIILDNFHEIDLLSQILEEKDASSKVMLRVTPGISAHTNEYIQTGQVDSKFGFDMESGQADRALELVLANPRMKMAGIHAHIGSQIFDVRGFVGCADKLCQLASAWK

SEQ ID NO: 28968 - protein, 623 aa, Magnaporthe grisea 70-15
MADAPNANDELYPIAVLIDELKHDDVLLRLNAIHRLSTIALALGPDRTRDELIPFLDESVEDEDEVLVALSEELGNFVEYVGGSQWGHVLLSPLENLAAIEEPVVRDKAVESLNKICAELSPKQVEEYFIPLTSRLSKADWFTSKISGCGLYTTPYSKVAPPLQEQLRRDFGHLVHDETPMVRRQSATHLAKFVKEMPAAVVVDEMIPMFQHLASDDQDSVRLLTVEVLISVAEVVPKEQQSSHGVLLTTLRNLIEDKSWRVRYMIADRFEKIAKAVDDEVVSRDLVPAFVKLLKDNEAEVRTAIAGQIPGFCALIDRTTLLNEVMGSIEDLVSDSSQHVRAALGTQISGLAPILGKQETIDHLLPMFLQMLKDEFPEVRLHIISKLELVNNVIGIELLSQSLLPAIVQLAEDKQWRVRLAIIEYIPLLASQLGVKFFDEKLSSLCMGWLGDTVFSIREAATHNLKKLTEVFGVEWASEAIIPKVMAMGNHPNYLYRMTTCFAISTLATVVSMDVIGKNILPMLDKLVVDDIPNIRFNVAKTYGVLIDVLRRLPEEGTVYSLEKAGTPFSPSSRGAELIQQRVMPSLEKLQKDDDVDVRYFATTAAAAASGPLPGGEPMNTSP

SEQ ID NO: 28969 - protein, 157 aa, Brassica napus
AEKSVLRGCSEKLADSEPFPAAGCAIATGLASCTEFEKKPLFVTKNWRNMLCKCEKCLEMYSERKVSYLLDAEDTIAEYENKAKEKRTEKLEEQEGEALDHFNNLDHVTKVELSHGIKDFKEGFRSLLESVGTSRAITSEDVEEMFSKLKNKRKRME

SEQ ID NO: 28970 - protein, 221 aa, Archaeoglobus fulgidus DSM 4304
MHEYELNQDLLAENKRLAEKNREALRESGTVAVNIMGAIGSGKTLLIERTIERIGNEVKIGAMLGDVVSKADYERVRRFGIKAEAISTGKECHLDAHMIYHRLKKFSDCDLLLIENVGNLICPVDFDLGENYRVVMVSVTEGDDVVEKHPEIFRVADLIVINKVALAEAVGADVEKMKADAKLINPRAKIIEMDLKTGKGFEEWIDFLRGILNVHSDSGQN

SEQ ID NO: 28971 - protein, 357 aa, Oryza sativa (japonica cultivar-group)
MRWTAFMWEGASRAFNHRPTFTNLVLVLGAASSGGLVAYADSNSDDVVGKPQGPPKKKIVVLGTGWGGTTFLRNLDSRLYDVQVISPRNYFAFTPLLPSVTCGTVEPRSVVEPIRRILEKKGGDIKFWEAECFKIDSSNKKIHCRSNIGTNLDGNGEFLVDYDYLVIAVGARSNTFNTPGVEENCFFLKEVEDAQKIRRNVMDCFERASLPYLDEEERKKNLHFVVVGGGPTGVEFAAELHDFVTEDLSKLYPSIQHLVKISLIEAADHILTMFDKRITEFAEDKFGRDGIDVKTGYKVVKVAKDAITMQNPATGDIAVPYGMAVWSTGIGTRPFISEFMKQIGQVPSKKLSSTLCS

SEQ ID NO: 28972 - protein, 446 aa, Candida albicans SC5314
MASVPPLFKVPNTKRTSNNKVLPNLSIPPTSNNKNGNPNTKPSLSLNQNIINHDSQQHENLNPLSYQPHQLQHQQYQNPQGLKLSTSPSSVSSSKSTKRKPPPIDTKVISHSPDMMDVDQQGSADESVNVDENEYSVKHHLEQLTPYDWHLIANANKIVEISSLGEGNGGAVTKCYIPQLPNKQIFALKLVMCDPNPDLQKQIFRELEVAKKCQHPNIVKYYGTFLLEKQSMIGIAMEFMDGQSLDSIYKEVLKRDKTNRINEKVLGKIANSILSGLDYLHSKNIIHRDIKPSNILLDTKGNVKLCDFGVSGEAVNSFASTFVGTQYYMAPERITGGNYSITSDIWSLGMSLLEVANGCFPIIQSLGPIEVVEIISRSNLELKDCEEDNIFWTREFKQFIAKCLTKDYLRRPKPSDLLAHDEWCLIQSKEKVKMDKFVKVVWELNE

SEQ ID NO: 28973 - protein, 355 aa, Zea mays
MADESWRLPSSVQQLAASIQEPPRQYLLREQEPLGGNLAGTEMPDPIPTIDLGLLSASNDAEEAAKLRSALQTWGFFKVSNHGMETSLMDSVMTASRDFFRLPLEEKRKYSNIIGGKHFQMEGYGTDQVKTQDQRLDWSDRLHLKVEPEDERNLALWPIHPKSFRDDLHEYTLRSKRIKDDILRAMAKLLELDEDCLVNQFSDRALTYARFNYYPPCPRPDLVLGIKPHSDVYALTVLLMDKDVAGLQFLRDGTWYNVPSASNYTLLINVGVTMEIMTNGIFKGPVHRVVTNSEKERMSVAVFYGLDPEREIGPIAQMLTEDQPARYRKMKVKDFLVAHLEHFSRGERVVDSLRI

SEQ ID NO: 28974 - protein, 313 aa, Brassica napus
  misc_feature (254)..(254): Xaa can be any naturally occurring amino acid
  unsure (1)..(313): unsure at all Xaa locations
MATERPSFELAKGINGLDKIVLRESRSRSAEVYLYGGHVTSWKNENGEELLYLSSKAIFKPPKPIRGGIPLCFPQFSNFGTLESHGFARNRIWEVDASPPPLPTNSSSNAFVDLILRPTEDDLKTWPHNFEFRMRVDLGSEGELTLTSRIRNTNSDGKPFTFTFAYHTYFSVSDISEVRVEGLETLDYLDNLKNRERFTEQGDAITFESEIDKIYLSTPTKIAILDHEKKRTFVVRKDGLADAVVWNPWDKKSXKSISDLGDEDYKHMLCVEAAAVERPITLKPGEEWKGRLELSAVPSSYSSGQLDPKKVLQ

SEQ ID NO: 28975 - protein, 295 aa, Brassica napus
LIHQTLTKPFSQSTTIPTKQDRVRDHAYDNYMEVEKKIRKVVKFHSLILSQPQHTIPISLLDTLARRLGLGFKQHEPGAFLLKFPHVFEVYEHPVQRILYCRLTRKALDQIRDEQEAVVAQIPDAVTRLRKLIMMSNTGRIRLEHVRIARSEFGLPEDFEYSVILKHPEFFKLIDGEETRDKYIEIVDREESLSRCAIERVREVEYRTKGIDAEDVRFSFLVNFPPGFKISKYFRIAVWKWQRLPYWSPYEDISGYDLRSLEAQKRLEKRAVACIHELLSLTVEKKITLERIAHF

SEQ ID NO: 28976 - protein, 550 aa, Alteromonadales bacterium TW-7
MEKIWLKRYPEGMPETIDPEHYNSLLEVFEKSFSDYKDLPAFTNMGKTLSYEEIDTATKKVASYIQNDLGLKKGDKVAVMMPNLLQTPISILGILRAGCVVVNVNPLYTVRELEHQLKDSDTSAIFILANFADTLEKALGKTDVKHIVVTQVGDMVGGLKKHIVNFVVKHVKKMVPKYNLPNTIKFSDLLNADENAYTRPELNLSDLAFLQYTGGTTGVSKGAMLSHGNMVGNLEQVSGCLDKVLNRGTEVVVTALPLYHIFALTANCLTFMKYGGLNLLITNPRDMPGFVKELSQTKFTAITGVNTLFNGLLNTPGFDELDFSHLKMSLGGGMAVQRPVAEKWQKVTGSKLMEGYGLTECAPLVTISPYDLESYNGSIGLPAPNTDIKLMLENGEEAAKGEPGELCVKGPQVMLGYYKRPDATAECLQDGWFATGDIATYDDEGFFYIVDRKKDMIIVSGFNVFPNEIEEVVAMHDGVLEVAAVGIPHDVSGEQVKVFVVKKDPSLTEKDIINHCRDNLTNYKVPKLVEFRDELPKTNVGKILRRALKD

SEQ ID NO: 28977 - protein, 359 aa, Rhodococcus sp. RHA1
MRIDTAPDAVILVGGMGTRLRPLTLSVPKPMLPTAGVPFLTHLLSRIKDAGLCHVVLGTSFKAEVFEQYFGTGEEFGLEIEYVTEDEPLGTGGAIRNVLPNLRADTVVVFNGDVLGGTDMRAVLQTHAEADADGTLHLVRVSDPRPFGCVRTDSNGRVTAFLEKAQDPPTDQINAGCYVFRREWIEKIPSDRPVSVEREVFPALVSGGTRVFGHVDSAYWRDMGTVNDFVAGSADLVRGIAPSSALSGTRGESLIHPSAIVAPGAVLIGGTVLGARVTVGAGARLDGAVVFDGAHVEAGAVIERSILGHDCRIGPRALVRDSVVGNGADVGARCELLRGARVWPDVTLPDGGVRFSTNV

SEQ ID NO: 28978 - protein, 696 aa, Zea mays
MVSARLVALAAFHLLVLLAMGPGEARAADGGEVRALLALGAALDPTGRLLPSWAPGRDPCAPPPSGGFDGVACDDSGAVANVSLQGKGLAGTLPPAVAGLRSLTGLYLHYNALRGGIPRELAALAALTDLYLDVNNFSGPVPPEIGAMASLQVVQLCYNQLTGSIPTQLGNLSRLTVLALQSNRLNGAIPASLGDLPLLARLDLSFNRLFGSIPVRLAQLPCSLVALDVRNNSLTGSVPAELAAKLQAGFQYGNNSDLCGAGLPALRPCTPADLIDPDRPQPFSAGIAPQVTPSDGRGNGRVPSTRALAAVVVVAVALLLTTGVGLFALSWRRWHRQKVAGASPSTISGGRCSTEVVPSAAKASSARKSASSALASLEYSNAWDPLADARGGLGFVSQDVQLAQSLRISTEEVESATRYFSELNLLGGHGKKAGGLAATYRGTLRDGTSVAVKRLGKTCCRQEEADFLSGLRLLAELRHDNVVALRGFCCSRARGECFLVYDFVPNGSLSQFLDADTTAGGSGRVLQWSTRISIIRGIAKGIEYLHSTRTNKPALVHQNISADKVLLDYAYRPLVSGCGLHKLLVDDLVFSTLKASAAMGYLAPEYTTVGRLSEKSDVYAFGVIVLQVLTGRRKVTATAQLLAGNVDDDELVDGNLQGSYSAAEAAMLAKIGSACTSEDPDQRPTMAELLQELDTI

SEQ ID NO: 28979 - protein, 200 aa, Zea mays
  misc_feature (10)..(10): Xaa can be any naturally occurring amino acid
  misc_feature (34)..(34): Xaa can be any naturally occurring amino acid
  misc_feature (48)..(48): Xaa can be any naturally occurring amino acid
  misc_feature (155)..(155): Xaa can be any naturally occurring amino acid
  unsure (1)..(200): unsure at all Xaa locations
GLGRTCGPDXVLVSSITAAGFTGLGVGAAYPGLXPLVEFLTLFFSLLXFARVIYSGGESNYMSAGPISVPLVFRGPNGAAAGVGAPPSQCFAAWFALVPGLKVLAPYSADDARGLLVAAFRDPDPVVFLGNDLLLGESFPVSAAVLASRFCLPVXWASFERPGFVVPLPAFFSWVGLPSPPLVSWPLCVSVPLLSFFPSL

SEQ ID NO: 28980 - protein, 323 aa, Bacillus cereus E33L
MNNMKLQLMYSFLRSDINVIEKELKKTVASEQPLVEEAALQLIEAGGKRIRPVFVLLAGKFGDYKLDAIKHVAVALELIHMASLVHDDVIDAAFLRRGSATVNAKWGDRIAMYTGDYLFAKSLECITNIEIPEAHQALSHTILEVCKGEIEQIKDKYNYDQNLRTYLRRIKRKTALLIAASCQLGAIAAGANRDTVSRLFWYGYFVGMSYQIIDDILDFVSTEEKLGKPAGGDLLQGNITLPALYAMEDPILCKKIRSVHENTTADEMKEIIEAVKNSASIDKAFAFSERYLHKALEMIKPLPRGQAKYALQNVAKYIGKRKF

SEQ ID NO: 28981 - protein, 588 aa, Geobacter metallireducens GS-15
MDSARNETRIFRGIEASAGIAIGTARLTDRSRVAVTEVSIGDEEVELECARFLAALQDAREELLAVKEHLASSRGPEHLYVVDSHLLILEDGMLTRGTLDLIAGEKINAEAALKRNLLKFKEFFSAIEDEYLRERAGDVETVVERIMRAMVGKRQECIGSIDGGKIVIVAHDLSPTDILQIDKNNVIGFITDLGGRTSHTAILARALEIPAVVGLETITGEDIDGLPIIIDGTDGTVVVNPDQDTFRDYLRRKQRYDYLEQEFLKLRDLPAETIDGHRISLMGNIEFAEEIPTLKGHGGEGIGLYRTEMLYMNRQGLPDEEEQYLAYSAIVEAMAPLPITIRTLDVGGDKLATDLHLEDEMNPALGLRAIRLSLRKPEVFKTQLRAILRASVRGKVRIFFPMISGVEEVRAAKAILEEAKNELRAEGVPFDNAIDVGIMIEIPSAVLVADILAREVDFFSVGTNDLIQYSLAIDRTNEHLAHLYQPMHPAVLRSLRTVVDAAHAAGIRACMCGEVAGESRYLPILLGLGFDELSMTGVSIPRVKKVLRRAVKADAQLLVSRAFTFSTAAEVEAFLNSEISARFSESFD

SEQ ID NO: 28982 - protein, 326 aa, Glycine max
  misc_feature (153)..(153): Xaa can be any naturally occurring amino acid
  misc_feature (277)..(277): Xaa can be any naturally occurring amino acid
  misc_feature (281)..(281): Xaa can be any naturally occurring amino acid
  misc_feature (293)..(293): Xaa can be any naturally occurring amino acid
  unsure (1)..(326): unsure at all Xaa locations
MGGLMILICMVVSWMFIHRWSQRNKKGPKTWPFFGAAIEQLMNYDRMHDWLVNYLSKSKTIVVPMPFTTYTYIADPANVEHVLKTNFNNYPKGEVYHSYMEVLLGDGIFNVDGESWKKQRKTASLEFASRNLRDFSTKVFKEYALKLSTILSXNQEIDMQELLMRMTLDSICKVGFGVEIGTLAPNLPENSFAHAFDTANIIVTLRFIDPLWKIKKMLSIGSEAQLGKSIKVIDDFTYSVIRRRKAEIEDIKKSGQQNQMKQDILSRFIELGERNAXDKSXRDVVLNFVIAGXDTTATTLSWAIYMVMTHAHVADKLYLELKKKKK

SEQ ID NO: 28983 - protein, 219 aa, Triticum aestivum
  misc_feature (22)..(22): Xaa can be any naturally occurring amino acid
  misc_feature (26)..(26): Xaa can be any naturally occurring amino acid
  unsure (1)..(219): unsure at all Xaa locations
RRLCLVSADLETVVKPNVAFLXECGXGDCDIAKLCIGQPWLLASSLECVRAVAARAEGIGVPCGSAMFRHALWAVARLSKEKIAAKVEHLKKMLRWSDAEVRIALSKSPGMLSFSSDRLQGISEFLISKAGLEPAYIAHRPAMLNYSLEGRIKPRHYVVKYLKENGFLDHDRDYYNTLCISEKVFMERFIYPHKEAAPHLAEDYADACRGKVPFSFRFT

SEQ ID NO: 28984 - protein, 179 aa, Brassica napus
MAASSSFLSTASLSNPKSTISFASSVSPAPIPSLRRVVFRSPSSHRRVTTVRSKIREIFMPALSSTMTEGKIVSWIKTEGEKLAKGESVVVVESDKADMDVETFYDGYLAAIVVGEGETAPVGAAIGLLAETEAEIEEAKNKAASKPSSSAVVPSPPPATSSPAPAIAQPSPAAAASDG

SEQ ID NO: 28985 - protein, 353 aa, Oceanobacillus iheyensis HTE831
MKKVVILGGGYGGIKVLAGLLNQSLSEDIHITVVDRNPFRSLKTEFYSIAAGTSADHDVRVEFPEDSRVNYLFQEITKIDVEQKRILFNDPDIIVEYDYLVIGIGCEDNFHGIPGAKEYAESVQTFSKARHTGVAIGNLKAYGKVSVIGAGLSGIEVASEIRESRPDLNIRLLDRGANVLKAFDSKIQDYVEQWFIKNDVDVIHHSTVEYVEKDGVCNNGVCYLNDVTIWTAGVQPNWLVRQLPFKKDIQDKVIVNDFYQVPEDPNVYVLGDCASSEYSPSGQLAGLQGEQIAEVLLSILADKEPKQPKPLKLKGTLGSLGKSDGFGNMVKTPLTGLLPRLAKTGVLWLSKRH

SEQ ID NO: 28986 - protein, 321 aa, Nocardia farcinica IFM 10152
MAGNPHNLPLEAAAQEFVDATSQPPFLYQLPPEEGRKAVDAVQDSPIEKPAIDEEWITVPGGPTGSVRARIVKPPAVEGPLPVIVYTHGAGWVFGNAHTHDRLVRDLAIGARAAVVFPEYDRSPEVHYPVANEQSYRVAQWVAAEGASKGLDSTRIAVAGDSVGGNMAIALTLMATERGDLSFVQQVLFYPVTDANFDTGSYEQFAEGYFLSRAGMRWFWDQYTTSESDRAQITASPLRASIEQLAGLPPALVITAEADVLRDEGEAFAGKLRAAGVPVIQTRYGGIIHDFVMVNSMHGTEAAQAAVAQAVSVLRAALHGA

SEQ ID NO: 28987 - protein, 225 aa, Oceanospirillum sp. MED92
MMRELFSGDMPQLVLFDLDGTLVDSVPDLAQAVDKMLCALDRPVAGLEKVRTWVGNGAAMLVKRALADDLYPSGEEDDQYRRAYNLFLDFYAQATADQSELYPGVRECLESLAVSGVRLGLVTNKPMRFTRSMLEGLQLDSYFGVVFGGDSFPEKKPHPRPLQEAMVACGVEPDVTLMVGDSVSDVRAARAAGCPVVCVPYGYNHGSPISESQPDLIVETLDQMI

SEQ ID NO: 28988 - protein, 501 aa, Ehrlichia chaffeensis str. Arkansas
MTNHSVILCILDGWGNSENSQFNAIAQSYKPCWDNTILQYPKSQLITHGLNVGLPDGQIGNSEVGHVNLGSGRIVLQDLCKINNEIKYIKNNRYLLEFIKKIKQNNGICHIAGLLSDGGVHSLHTHMLDIIDTLSNFQIQIAVHIFLDGRDTPPISAIKYINILREHIKHLNNVNIATISGRYYSMDRDNKLDRTRTAYKAMAFADAKRYTDPSLAIQDSYNAGITDEFILPCVIGDYNGMNPQDGFIMTNFRSDRAIQIIKMIIGDIKTDNHITLENTIGMVKYSESINIPCLFPNNNITNTLGEVIANHKLHQLRIAETEKYAHVTFFFNGGREDTFENEDRIIIPSPSVTTYNLMPEMSAKEVTNTVIERIKLQKYSLIILNYANADMVGHTGNIEATKQAITALDQCLNKILNCIQGTNYVLVITADHGNAEEMFDVKNNMPYTAHTLNPVPFIICNYSKQIRLKNGRLCDVAPTILEILNIEKPKEMTGISLIEYI

SEQ ID NO: 28989 - protein, 328 aa, Medicago sativa
NSNEFGNFIAIDDELKLPEDQPEPMTLEHTEPMHSDPLEMEEVEMEDIEGEMILDIDSCDANNSLAVVEYIEDLHAYYRKIEYLGCVSPTYMDEQLDLNERMRAILVDWLIEVHDKFDLMQETLFLTVNLIDRFLAKQNVVRKKLQLVGLVAMLLACKYEEVSVPVVSDLIHIADRAYTRKDILEMEKLMLNTLQYNMSLPTAYVFMRRFLKAAQADKKLELVAFFLVDLSLVEYEMLKFPPSLVAAAAVYTAQCTVSGFKHWNKTCEWHTNYSEDQLLECSMLMVGFHQKAGAGKLTGVHRKYGSAKFSFTAKCEPACFLLENKNQP

SEQ ID NO: 28990 - protein, 324 aa, Pseudomonas fluorescens Pf-5
MSQSSDLIQSAQRTIRLELQAVEGLLPHIDADFVRACEMILASKGRVVVVGMGKSGHVGNKIAATLASTGTTAFFVHPAEASHGDMGMITRDDVILALSNSGSTNEIVTLLPLIKRLGIQLISLTGNPESPLAKAADVNLNVHVEHEACPLNLAPTSSTTAALVMGDALAVALLEARGFTAEDFAFSHPGGALGRRLLLKVENVMHEGSDLPQVQRGTLLKDALMEMTRKGLGMTVILEADGRLAGIFTDGDLRRTLDRAIDIHHATIDSVMTPHGKTARADMLAAEALKIMEDHKISALVVVDKEDRPIGALNMHDLLRAGVM

SEQ ID NO: 28991 - protein, 139 aa, Pisum sativum
NTDITSITSNGGRVKCMQVWPPIGKKKFETLSYLPPLTRDQLLKEVEYLLRKPWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 28992 - protein, 127 aa, Saccharomyces cerevisiae
MLFYKPVMRMAVRPLKSIRFQSSYTSITKLTNLTEFRNLIKQNDKLVIDFYATWCGPCKMMQPHLTKLIQAYPDVRFVKCDVDESPDIAKECEVTAMPTFVLGKDGQLIGKIIGANPTALEKGIKDL

SEQ ID NO: 28993 - protein, 221 aa, Hydrogenovibrio marinus
MCEKCDCNSAIDQLFENNEEWIKEMNAERPGFFSSLVAQQSPEYLWIGCSDSRVPANELVKMDPGTIFVHRNIANLVNSSDMNVLTVIQYAVEVLKVKHIIVNGHYGCGGVMAALQQSNPDLIDHWIRPIRKYYHHNRKELETIGEEQGEKAKVNRLCEINVVEQVRNIAHVPAVRHAWEKGQELAIHGFIYDIKDGRLHNMNVTIDNIEKAEKAVLRELC

SEQ ID NO: 28994 - protein, 296 aa, Xylella fastidiosa 9a5c
MQDLKKKVILVTGASDGIGKFTAATLAKQGHKLIIHGRNRQKTEAALAEIKRQSGNPDVAMFLADFLPLAGVKAFADAIKEKYDHIDVLINNAGAQFTEQREVTSEGHEKTMAINVFAPMLLTKLLMPLLVKSESARVVTVASDAHRMAGKPDLDDIELKQGYHMAKAYSLSKLYVIWVMHHFIGETKKAGIHNVTFNLVHPASTRTNLGREAVKSWKWKIIFFLWQIMLVSMDKAASSTLYAATAPELEGVSGRYFGPKGEEQPSAKYHSPENEQKVWDYALNAIRPYLPAGAQS

SEQ ID NO: 28995 - protein, 713 aa, Saccharomyces cerevisiae
MTASVSNTQNKLNELLDAIRQEFLQVSQEANTYRLQNQKDYDFKMNQQLAEMQQIRNTVYELELTHRKMKDAYEEEIKHLKLGLEQRDHQIASLTVQQQRQQQQQQQVQQHLQQQQQQLAAASASVPVAQQPPATTSATATPAANTTTGSPSAFPVQASRPNLVGSQLPTTTLPVVSSNAQQQLPQQQLQQQQLQQQQPPPQVSVAPLSNTAINGSPTSKETTTLPSVKAPESTLKETEPENNNTSKINDTGSATTATTTTATETEIKPKEEDATPASLHQDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANNHRNSITENNTTTSTDNNTMTTTTTTTITTTAMTSAAELAKDVENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSPLGPEYNVFATGSGDCKARIWKYKKIAPN

SEQ ID NO: 28996 - protein, 397 aa, Alkaliphilus metalliredigenes QYMF
MKVELSKKGLSVSSSITLAIDSKAKQMKAEGMNVISFGVGEPDFQTPDYIKQAAIKAIEEKSIGYTPAPGMLQLRQSICNKLASDNELEYLPQHIIVSNGAKHSVYNIFQAVCNPGDEVIIPVPYWVSYPEHVKMADAIPVYIDCPEENDFKMKPEDFLAAISSKTKAIILNSPSNPTGAVYSKKELEQIAKIAVDHNILVVSDEIYEKLIYGNEKHVSIASLNSEIKDLTIVINGMSKGYAMTGWRIGYTASNSEIAKIMSNIQSHATSNPNTVAQYASIEALERDQSSIETMRLAFDERRKYMINRVNEIQNLSCIAPNGAFYIMMNISQLIGKVVDGKIINGSMDFAEVLLDRTHVAVVPGIAFGVDHLVRLSYANSMENITEGLNRIDKFLNE

SEQ ID NO: 28997 - protein, 1089 aa, Campylobacter upsaliensis RM3195
MPKRSDIKNILLIGSGPIVIGQACEFDYSGTQAAKTLKELGYRVILINSNPATIMTDPEFADATYIEPITKESILSILKKEKVDAILPTMGGQVALNVAMEVFESEEFKKDFSFVKFLGANPEAIKKGEDRQIFKECMKKIGMDLPKSMYAYDYEETLKAVDEIGFPLMIRASYTLGGAGSGVVYNLDEFKDLATAALSLSPIHEILIEESLLGWKEYEMEVIRDKFDNCIIVCSIENLDPMGVHTGDSITIAPALTLTDKEYQAMRNASFAILREIGVDTGGSNVQFAIHPQNGRMIVIEMNPRVSRSSALASKATGYPIAKVATLLAVGFSLDEIKNDITGTPASFEPAIDYIVTKIPRFTFEKFPGANEILGTAMKSVGEVMAMGRTFKESLQKALCSLERNYSGFDRVQFEDKNELIFKIRNANEKRLLYIAQAYRQGFSTEELYELCKVDRWFLEQIREIIEFEKRIDMDILSDKALLRKAKTMGFSDKKIAALVNEKDNLELSQNDIYYARVKHKIIAEFSEVDTCAGEFKALTPYLYSSINASELTQSKVENKKEKKVLIIGGGPNRIGQGIEFDYACVHASFALKDLGIKTLMYNCNPETVSTDYDTSDVLYFEPIDFEHLRAVIEREKPDGVIVHFGGQTPLKFAKRLSAFGAKIIGTSARVIDLAEDRKKFALFCENLGINQPRNATATKVEEAVLKASEIGYPVLVRPSYVLGGRAMRVVYDEAELRLYMQEAVAVSERSPVLIDEFLDNATEIDVDAISDGKEVYVAGIMEHIEEAGIHSGDSACSLPPCNIDEKTQELICQKTTEIALNLGVKGLLNIQFALHENKLFMIEVNPRASRTVPFVSKATGVPLAKVATRVMWQGNLREALGFYDFFGVVDFKLLRPKRLNYISIKEAVFPFVKLSGSDLELGPEMRSTGEVMGISKDFTKAYAKSQICAFNPLPKSGVVFISLKEKDKKFAAKIAKEYLHLGFSLLATSGTCKKIKESGYACELVYKISEGRPNVEDRLKNGEIHLVINTSDTHSFAGDTKKIRENILRFKIPYFTNLRSALAGAKSIKAMQDKSYLEVKSLQEWLRR

SEQ ID NO: 28998 - protein, 648 aa, Archaeoglobus fulgidus DSM 4304
MKEFIEGLIRLTEVERDAQISAMMDEIRRLSGEKRERKGRAVLGLRGKVVGEELGFKLVRYGRRKAIETEISVGDEVLISRGDPLKSDLRGVVVEKGSRYLTVSLESVPEWALRDVRIDLYASDLTFKRWIENLENLTENGKRALKFALGLEEPSKTECEDFKPFDSSLNRAQLKAVGCAVSTDDFFLIHGPFGTGKTRTVVEVVRQLVKRGERVLVTAESNTAVDNLVELLSDMKIVRLGHPSRVEKRLKEHTLASLVLNHPDYKRIEEIKGKIEEIERRMERLTKPSPQLRRGLSDEEILRLARSNRGARGVAAKKIRSMAEWIEARKALDQLYTEMKEEEERIVKEIIEESDVVISTNSSAFLLEESFDTAVIDEASQATIPSVLIPINRARKFILAGDHRQLPPTVMKAEKLSETLFEKLIELYPEKSQLLNVQYRMNEKLMEFPSREFYGGRIVAHESCTAIALSQIAKREAEKLREILGDEPLVFIDTSKCKNRWEGKLADSTSRYNRLEAEIVTEIVTELLKMGLKKEQIGVITPYDDQVDLLREKVDVEVSSVDGFQGREKEVIIISFVRSNRKREIGFLDDLRRLNVSLTRARRKLIMVGDSETLSVNGTYARLIDHVKRKGVYVELDKNGKLGGNPKG

SEQ ID NO: 28999 - protein, 595 aa, Saccharomyces cerevisiae
MPTVSVNKQQLFDLLGKNYTSQEFDELCFEFGMEMDEDTTEEALKTGEEPELKLDISANRYDLLCIEGISQSLNEYLERKERPDYKLSKPTTKLIIDKSTEQIRPFATAAVLRNIKLNEKSYASFIALQDKLHANLCRNRSLVAMGTHDLDSIEGPFHYRALPPKDIKFVPLNQTQEFTGDKLIEFYKSPEQKNNIGRYVHIIEDSPVFPVIMDSKDRVCSLPPLINSEHSKISVNTRNILIDITATDKTKAEIVLNILTTMFSRYCDEPFTVEPVEIVSEHNGQSRLAPNFNDRIMDVSIKYINSCLGLDQSADEIAHCLKKMSLHAVQSKEDKDILHVDIPVTRPDILHACDIMEDAAVGYGFNNLPKGEKLSNANFIAKPLPINKVSDIFRVASSQATWVEVLPLTLCSHDENFKFLRQSDNGDLAVKLANPKTLEYQVVRTTLLPGILKTVKENRKHSLPIKVFETGDVVFKDDKLERKAYNERHWAAIYVGKNSGFEIIQGLLGKIMQTFRTEWIADYGAAASGRGYWIEEDDSVKTYLPGRGAKVMFRSKEGAEPKQIGHLGVLHPEVMMNFDVPFAASFVEVNAEVFL

SEQ ID NO: 29000 - protein, 108 aa, Solanum lycopersicum
MSLAKAKEIVSGNPVAVFSKTYCPFCVSVKDLLSKLGATFKAVELDSEKDGSEIQAALAEWTGQRTVPNVFIGRKHIGGCDATTALHREGKLLPLLTEAGAIAKTSTA

SEQ ID NO: 29001 - protein, 341 aa, Geobacter metallireducens GS-15
MLILTIETSCDETAAAVVRDGRTVLSSIVATQVKDHAVYGGVVPEIASRKHLESIPVVIDEALRTASVSLDAIEGVAVTQGPGLAGALLVGTAVAKAIAFARRLPIVGVNHIEGHLSAIFLEREVAFPFVALAVSGGHTHLYRVDGIGRYTTLGQTRDDAAGEAFDKVAKLLGLPYPGGVEIDRLAAEGDPASISFPRPLLHDGSFNFSFSGLKTAVLNHVRKNPVQEDGQQLRDLCASFQRAACDVLVTKTLLAAETEGIGRVVVAGGVACNSALRRDMAREAADRGIELAIPSPSLCSDNAAMLAVPGDFYLSRGISDGLSLDALVNWPLDTIRTRLES

SEQ ID NO: 29002 - protein, 315 aa, Zea mays
MGGGRTNGEEDADMVLVNQDKLPAPSVPASAGVAANLFRKKATLPQPSTSARKPLRIKIGQPKLPKNFEEDTWSILKDAITAIFLKQKLSCDVEKLYQAAGDLCLHKLGANLYERIKKECEIHIAEKISALVGQSPDLVVFLSLVQRTWQDFCDQMLIIRGIALLLDVKYVKNVANICSVWDMGLQLFRKHLSLSPEIEHKTVTGLLRLIESERLGEAIDRTLLSHLLKMLTALGMYSESFEKPFLECTSEFYATEGVKYMQQSDIPDYLKHVESRLQEEHERCILYLEANTRKPLIATTETQLLDRHTSAIIEK

SEQ ID NO: 29003 - protein, 549 aa, Erwinia carotovora subsp. atroseptica SCRI1043
MKNINPSQTAAWQALQTHFDAMKDVKISELFAQDSDRFAHFSATFDDQMLVDYSKNRITAETMGKLHALARETDLPAAIHAMFAGEKINRTEDRAVLHVALRNRSNTPILVDGKDVMPEVNAVLAKMKDFSERVIGGEWKGYTGKTITDVVNIGIGGSDLGPFMVTEALKPYKNHLNMHFVSNVDGTHIAETLKPLNPETTLFLVASKTFTTQETMTNAHSARDWFLKTAQDEKHVAKHFAALSTNAKAVGEFGIDTNNMFEFWDWVGGRYSLWSAIGLSIILSLGFDNFEKLLSGAHAMDKHFASTPAEKNLPVLLALIGIWYNNFFGAETEAILPYDQYMHRFAAYFQQGNMESNGKSTDRNGNPVDYQTGPIIWGEPGTNGQHAFYQLIHQGTKLVPCDFIAPATSHNPLSDHHSKLLSNFFAQTEALAFGKSREVVEAEFTAAGKSAKEVEHVAPFKVFEGNRPTNSILLRDITPYSLGALIALYEHKIFTQGAILNIFTFDQWGVELGKQLANRILPELESDSTIDSHDSSTNGLINRFKAWRN

SEQ ID NO: 29004 - protein, 209 aa, Arabidopsis thaliana
  misc_feature (15)..(15): Xaa can be any naturally occurring amino acid
  misc_feature (44)..(44): Xaa can be any naturally occurring amino acid
  misc_feature (173)..(173): Xaa can be any naturally occurring amino acid
  unsure (1)..(209): unsure at all Xaa locations
MASSMLSSAAVVTSXPAQATMVAPFTGLKSSAAFPVTRKTNKDXTSIASNGGRVSCMKVWPPIGKKKFETLSYLPDLSDVELAKEVDYLLRNKRIPCVEFELEHGFVYREHGNTPGYYDGRYWTMWKLPLFGCTDSAQVLKEVEECKKEYPGAFIRIIGFDNTRQVQCISFIXYKPPSFTELNSFLNIYEYLCHSFLCWVFSLMILMQC

SEQ ID NO: 29005 - protein, 500 aa, Panax ginseng
MFPLAYPLLFVLLGALSWWILPIISPLKRHHKLPPGPRGLPIIGSLHTLGALPHRTLQTLAKKYGPIMSMRLGSVPTIVVSSPQAAELFLKTHDNIFASRPKLQAAEYMSYGTKGMSFTAYGPHWRNIRKFVVLELLTPAKINSFVGMRREELGMVVKSIKEASAANEVVDLSAKVANIIENMTYRLLLGRTKDDRYDLKGIMNEALTLAGRFNIADFVPFLGPLDIQGLTRQFKDTGKRLDKILEFIIDEHEQNSSNGNASGDFIDDMLSLKNKPSNTHDELSKVIDRSVIKAIMIDIISAAIDTSDTSIEWILTELIKHPRAMKKCQEEIDAVVGVDRMVEETDLPNLEYVYMVVKEGLRLHPVAPLLGPHESMEDITINGYFIPKQSRVIVNSWALGRDPNVWSEDADEFLPERFEGSNIDVRGRDFQLLPFGSGRRGCPGMQLGLITVQLVVARLVHCFDWNLPNGITPDNLDMTEKFGLTTPRVKHLLAVPKYRL

SEQ ID NO: 29006 - protein, 648 aa, Burkholderia thailandensis E264
MNANPKFLSADARVDAAAVAPLPNSRKVYVTGSQPDIRVPMREITQADTPTSFGGEKNPPIYVYDTSGPYTDPDAKIDIRAGLPALRQRWIDARGDTETLAGLTSEYGRERAADPATAELRFPDLHRHPRRAKAGRNVTQMHYARQGIITPEMEFIAIRENQRRAEYLESLKASGPNGAKLAAMMGRQHAGQAFGAAAFGANEAGTNMLTEITPEFVRSEVACGRAIIPANINHPETEPMIIGRNFLVKINANIGNSAVTSSIGEEVDKMTWAIRWGGDTVMDLSTGKHIHETREWIIRNSPVPIGTVPIYQALEKVNGKAEDLTWEIFRDTLIEQAEQGVDYFTIHAGVRLQYVPLTANRMTGIVSRGGSIMAKWCLAHHKESFLYEHFEEICEIMKAYDVSFSLGDGLRPGSIYDANDEAQLGELKTLGELTQIAWKHDVQVMIEGPGHVPMQLIKENMDLQLDWCKEAPFYTLGPLTTDIAPGYDHITSGIGAAMIGWFGTAMLCYVTPKEHLGLPNKDDVKEGIITYKLAAHAADLAKGHPGAQVRDNALSKARFEFRWEDQFNLGLDPDKAREFHDETLPKDSAKVAHFCSMCGPHFCSMKITQDVREFAAQQGMSEDDALKKGMEVKAVEFVKTGSEIYHRQ

SEQ ID NO: 29007 - protein, 326 aa, Bacillus cereus E33L
MQKETAIIIGGGPCGLAAAISLQKVGINPLVIEKGNIVNAIYNYPTHQTFFSSSEKLEIGDVAFITENRKPVRNQALAYYREVVKRKSVRVNAFERVEKVQKDGEVFQVETTKRDGSKEIYIAKYIVVATGYYDNPNYMNVPGEELKKVAHYFKEGHPYFDRDVVVIGGKNSSVDAALELVKAGARVTVLYRGSEYSPSIKPWILPEFEALVRNGTIHMHFGAHVKEITEHTLTYTVDGETTTIQNDFVFAMTGYHPDHSFLTKMGVRIDEATGRPIYAEDTMETNAANIFIAGVIAAGNNANEIFIENGRFHGDAIAQTIATREM

SEQ ID NO: 29008 - protein, 251 aa, Burkholderia thailandensis E264
MSKQRIKRVIGNWKMHGRLSGNQALLTEVAQGAQAVHDNVAIGVCVPFPYLAQAQAQLQGGRVSWGSQDVSAHEQGAYTGEVAAGMVAEFGAAYAIVGHSERRAYHGESNETVAAKARRALAAGLTPIVCVGETLAEREAGTTEQVVGAQLDAVLAVLSPDEAARIVVAYEPVWAIGTGKSATAEQAQQVHAFLRGRLAAKGAGHVSLLYGGSVKADNAAELFGQPDIDGGLIGGASLKSGDFLAICRAAK

SEQ ID NO: 29009 - protein, 210 aa, Oryza sativa
MARKNLLLLGVFLSALLFFFLDVAHARELAEASESEGKNVKPTGRSGVEDQKWGGAHGGGYGYGGGYGGGGYGHPGYGGGYGGGYGHPGYGGGYGGGYGQGYGCGYGHPGHSGGYGGGYGGGYGGGYGGGGGYGGGGRHTRRHIHILHHEHRPTSDPRPLTHLLASHSSPQIHWLQRALLRELHPGRRKAEQIGEHQAEGDSCEPFQMIT

SEQ ID NO: 29010 - protein, 452 aa, Staphylococcus aureus subsp. aureus MRSA252
MNFLKPAKHIKPLPENQIDDTYKRLRLQVFLGIFIGYAGYYLLRKNFSLAMPALQEQGFTKAELGFALSAVSIAYGFSKFFMGTVSDRSNARIFLVLGLVLTAIVNLLMGFVPFFTSGIGIMFVLLFLNGWFQGMGWPPSGRVLVHWFSVSERGSKTALWNVAHNVGGGIMAPIAAWGITTTAFINFGYLKGFEGVFIYPALLALIIAAISYILIRDTPQSQGLPPIEIYKNDFATSDKKTLETELTTKEILFKYVLNNKWVWAIAFANIFVYFVRYGVLDWAPVYLSEEKHFDLKASGWAYFLYEWAGIPGTLLCGYISDKLFKGRRGPAGFFFMLGVTVFVLIYWLNPPGNAWLDNVSLIAIGFLIYGPVMLIGLQALDYVPKKAAGTAAGLTGLFGYLFGAVMANIVLGAVVDKFGWDVGFILLTAISVFAMLSFILTWNKVGQETVHH

SEQ ID NO: 29011 - protein, 1131 aa, Glycine max
MSTSRPSQSSSNSRRSRHSARMAQATVDAKIHATFEESGSSFDYSSSVRVSGTADGVNQPRSDKVTTAYLRGKMIQPFGCLLAIDEKNHMQTCKVIAYSENEPEMLTMVSHAVPSVGDHPALGIGTDIKTLFTAPSVSGLQKALGCADVSLLNPILVHCKTSGKPFYAIVHRVTGSLIVDFEPVKPYEVPMTAAGALQSYKLAAKAITRLQSLPSGNMERLCDTMVQEVFELTGYDRVMAYKFHEDDHGEVIREITKPCLEPYLGLHYPATDIPQASRFLFRKNKVRMIVDCHAKHVRVLQDEKLQFDLILCGSTLRAPHSCHAQYMANMDSIASLVLAVVVNDNEEDGDTDAVQPQKTERLWGLVVCHNTTPRFVPFPLRYAREFLPQVFADHVHKEIELEYQIIEKNILHHPGHLLCMLMRDAPLGIASESPNIMDLVKCDGAALIYRNKVWRLGVTPSEPQIREIALWLSEYHMDSTSFSTDSLFDAGFPSALSLGDVVCGMASVRVTAKDMVFWFRSHTAAEIRWGGAKHEAGEKDDSRRMHPRSSFKAFLEVVKARSLPWKEYEMDAIHSLQIILRNAFKEDTESLDLNAKAINTRLRDLKIEGINDLKIERMQELEAVTSEIVRLDYTATVPILAVDVDGLVNGWNIKIAELTGLPIGEATGKHLLTLVEDSSTDRVKKMLNLALLGEEEKNVQFEIKTLGSKMDSGPISLVVNRCASRDLRDNVVGVCFVAHDITAQKNVMDKFIRIEGDYKAIVQNRNPLIPPIFGTDEFGWCCEWNPAMMKLTGWKREEVMDKMLLGEIFGTQMAACRLKNQEAFVNLGVVLNKAMTGSETEKVPFGFFARNGKYVECLLSVSKKLDVEGLVTGVFCFLQLASPELQQALHIQRLSEQTASKRLNALSYMKRQIRNPLCGIVFSRKMLEGTDLGTEQKQLLRTSAQCQQQLSKILDDSDLDTIIDGYLDLEMAEFTLHEVLVTSLSQVMEKSNGKSIRIVNDVAGHIMMETLYGDSLRLQQVLADFLLISINFTPNGGQVVVAGSLTKEQLGKSVHLVKLELSITHGGSGVPEVLLNQMFGNNGLESEEGISLLIRAKLLKLMNGDVRYLREAGKSAFILSAELAAAHNLKA

SEQ ID NO: 29012 - protein, 1156 aa, Glycine max
MLQQAERRIPPFRRRKSTPHEQRLSHHSSNNNNNIDSMSKAIAQYTEDGVHAVFEQSGESGRSFNYSESIRIASESVPEQQITAYLVKIQRGGFIQPFGSMIAVDEPSFRILGYSDNARDMLGITPQSVPSLDDKNDAAFALGPQSVPSLDDKNDAAFALGTDVRALFTHSSALLLEKAFSAREISLMNPIWIHSRTSGKPFYGILHRIDVGIVIDLEPARTEDPALSIAGAVQSQEALVRAISQLQSLPSADVKLLCDTVVESVRELTGYDRVMVYKFHEDEHGEVVSESKRPDLEPYIGLHYPATDIPQASRFLFKQNRVRMIVDCHASAVRVVQDEALVQPLCLVGSTLGAPHGCHAQYMANMGSIASLVMAVIINGNDEEGVGGRSSMRLWGLVVCHHTSARCIPFPLRYACEFLMQAFGLQLNMELQLAAQSLEKRVLRTQTLLCDMLLRDSPTGIVTQSPSIMDLVKCDGAALYFQGNYYPLGVTPTEAQIRDIIEWLLAFHGDSTGLSTDSLGDAGYPGLPRLGMQFVGWQVAYITEKDFLFWFRSHTAKEIKWGGAKLILRTRMMGQRMHPLSSFKAFLEVVKSRSLPWENAEMDAIHSLQLILRDSFKDAEHRNSKAVVDPHVSEQELQGVDELSSVAREMVRLIETATAPIFAVDVDGHVNGWNAKVSELTGLPVEEAMGKSLVHDLVFKESEETVNKLLSREEDKNVETKMRTFGKEHQNKAAFLVVNACSSKHFTNNVVGVCFVGQNVTGQKIVMHKFINIQGDYKAIVHSPNPLIPPIFASDDNTCCLEWNTAMEKLDPSNENVTVGGVDVIGKMLVGEVFGSCCQLKGSDSITKFMIVLHNALGGQDTDKFPFSFLDRHGKYVQTFLTANKRVNMEGQIIGAFCFLQIMSPELQQALKAQRQQEKEFLGRMKELAYICQGVKKPLSGIRFTNSLLEATSLTNEQKQFLETSVACEKQMLKIIRDVDLESIEDGSLELEKGEFLLGNVINAVVSQVILLLRERNLQLIRDIPEEIKTLAVYGDQLRIQQVLSDFLLNIVRYAPSPDGWVEIHVRPRIKQISDGLTLLHAEFRMVCPGEGLPPELIQDMFNNSRWGTQEGLGLSMSRKILKLMNGEVQYIREAERCYFYVLLELPVTRRSSKKC

SEQ ID NO: 29013 - protein, 130 aa, Cenarchaeum symbiosum
MPATNILANLFVTLYNTEARRRGDCQVYPTSKLGVEVLGTLKKAGYIGEFEHVEDSRGGKFSVHLLAKITKCGAISPRFKVKKGEYTFWEQQYLPSYDRGMLVVTTNQGVMSHHEAAERGIGGFLIGYVY

SEQ ID NO: 29014 - protein, 227 aa, Medicago truncatula
MGSICSCLSVDDFEDYMNPHSHVYRNCVCVGCFLQNISAVYSSIFHRREMQALPSSVQGAASMTNTASLDNSLAEIYRSPPRPLPYDADPRHFRSQHDGLVSRREKGSSHLNEESEPLRVDVDVDPESLSSSGKWKESTGKDGSKEYRSKSSVRLSSAKLTTGAALVYASSEEEDVCPTCLEEYTEENPKIVTKCNHHYHLGCIYEWMERSDSCPVCGKVMLFDESP

SEQ ID NO: 29015 - protein, 411 aa, Anaplasma platys
MKENAVLMCGDKKVSLPMLSGTDGIQLIDITTLYRDHKVLTYDPGFMSTAACSSEITFIDGEKGILRHRGLDIADLIGIKGGFCSVAHLLLYGVLPSDTVFEQFLAAIGAQHALSSDVLGVISSFRRDAHPMAILMACFSPLAAKYHGDNRGNEELAVLAIAQVPSLVAAIYRHRMGLELVSPDPSLSYTGNFVKMMFGALEKTRADAIEEALDAIFIMHADHEQNASTATVRMAGSAGTELFACLAAGTATLWGPAHGGANEAVIRMLESIGSPDKVEEFIGFVKDNNSKVRLMGFGHRVYKSYDPRAKILGQISRSVLDNLGCSDELLGVAEELERCALQDEYFVERKLYPNVDFYSGIVLRAMGVPVEMYTTFFALARTAGWVSQWCELLRGSESLKICRPRQLYAGK

SEQ ID NO: 29016 - protein, 375 aa, Prunus armeniaca
MTFTLHKKEILIDILVRLPAKSLVRFLCTCKLWGDLIGSSSFVSAHLNRNVTKRAPVYLLCLHHPNFERQNDTDDPYDIEELQWSLFSKETFEQFSKLTHPLGSTEYYGVYGSSNGLVCISDEILNFDSPIHIWNPSVRKFRTPQMSTNINVKFSYVALQFGFHPLVNDYKAVRMMRTNKNSLAVEVYSLRTNSWKMIEAIPPWLKCTWQHYKGTFFNGVAYHIIEKGPIFSIMSFDSGSEEFEEFIAPDAICSSWGLCIDVYKENICLLLQFYSSEEEGMRKADLWVLQEKRWKQLCPFIYPFHYYSPIGFSIDNELLVERKDFARGIGDLHLCNDKSKQVLETGIELAAMKYGKIEFLFVITYIESMVLLNYY

SEQ ID NO: 29017 - protein, 738 aa, Ostreococcus tauri
MASHRISEGGAHAPSLDPIVARAFGAFDHTFTVCDATKPDCPIVYASDGFLRMTGYAAAEVIGYNCRFLQGEKTNKNDVRELREAIKNGDRWSVRLLNYKKDGTPFWNYLVVAPVKLADGTVVKYIGVQTDVTEVKDADTGERGIEFDEKGQPVPSRYDARAAAATLGRVSEVEQAVRTAEGLGNQAQRRTGMDLASTLERIEQSFVITDPSLPDHPIVFASDGFMEFTGYSVDEILGRNCRFLQGPKTDRAAVAKIREAIENGEECTVRLLNYTKTGEEFWNMFTLAPVRDEQGIVRFFAGVQVDITAHDPQTEHETVAEITFKEEDNDANVQVSKSAAQLVAGAAAKDKEFEPPWKHMSGHMLQPKPHQLENRRHWEALWRVTNYNDRPLTIDDFVPIRRIGQGDVGTVHLVALAKEKDVRFALKILTKQEIIDRNKLHRLQTESTILNQIDHPFVATLFASFQTSTHVYFLMEYCEGGELYDFLQKAPGKRLSEEATKFYAAEVLVSLQYLHLLGFVYRDLKPENVLLRRNGHIMITDFDLSFCASCQPHIKVRPGNPTWYPGQRATAHAKKKKLKPPRLPKSGSNPTIVAEPFTFTNSFVGTEEYLSPEVLNGTGHSGAVDWWELGIFMYEMAYGTTPFKAATRDETFSNITNAKLTFPDNIPMSEDFKDCVRKLLQRDSTSRLGTLGGAEEIKSHPFFSCVNWGLLRWEEPPYVPKPRRAAPVRDEEIFEMEI

SEQ ID NO: 29018 - protein, 377 aa, Prunus armeniaca
MAFTLRKKEILVDILVRLPAKSLVRFLCTCKSWSGLIGSSSFVSIHLNRNVTEHAHVYLLCLLHPNFERLADPDDPYVKQEFSWSLFSNETFEESSKITHPLGSTEHYGIYGSSNGLVCISDEILNFDSPIHIWNPSVKKFKTPPMSTNINIKFSLVSLQFGFHPRVNDYKAVRMMRTNKNVLAVEVYSLSTDSWKMVEAIPPWLKCTWQHHKGTFFNGVAYHIIQKGPLFSIMSFDSGSEEFEEFIAPDAICRSLGLCIDVYKEHICLLFGFYGCEEEGMDKIDLWVLQEKRWKKLCPFIYDPLDYCYRIIGIGIDNELLMETEDFLRGVGYLHLCNNESKQVLETGIELAVMKYGEIEFSYTITYIESLVFLDKY

SEQ ID NO: 29019 - protein, 755 aa, Desulfovibrio desulfuricans
MSTSRRDFLKYFAMSAAVAAASGAGFGSLALAADNRPEKWVKGVCRYCGTGCGVLVGVKDGKAVAIQGDPNNHNAGLLCLKGSLLIPVLNSKERVTQPLVRRHKGGKLEPVSWDEALDLMASRFRSSIDMYGPNSVAWYGSGQCLTEESYVANKIFKGGFGTNNVDGNPRLCMASAVGGYVTSFGKDEPMGTYADIDQATCFFIIGSNTSEAHPVLFRRIARRKQVEPGVKIIVADPRRTNTSRIADMHVAFRPGTDLAFMHSMAWVIINEELDNPRFWQRYVNFMDAEGKPSDFEGYKAFLENYRPEKVAEICRVPVEQIYGAARAFAESAATMSLWCMGINQRVQGVFANNLIHNLHLITGQICRPGATSFSLTGQPNACGGVRDGGALSHLLPAGRAIPNAKHRAEMEKLWGLPEGRIAPEPGYHTVALFEALGRGDVKCMIICETNPAHTLPNLNKVHKAMSHPESFIVCIEAFPDAVTLEYADLVLPPAFWCERDGVYGCGERRYSLTEKAVDPPGQCRPTVNTLVEFARRAGVDPQLVNFRNAEDVWNEWRMVSKGTTYDFWGMTRERLRKESGLIWPCPSEDHPGTSLRYVRGQDPCVPADHPDRFFFYGKPDGRAVIWMRPAKGAAEEPDAEYPLYLTSMRVIDHWHTATMTGKVPELQKANPIAFVEINEEDAARTGIKHGDSVIVETRRDAMELPARVSDVCRPGLIAVPFFDPKKLVNKLFLDATDPVSREPEYKICAARVRKA

SEQ ID NO: 29020 - protein, 281 aa, Hordeum vulgare
MAIAAAAGASTMSLLPISHLKQLQLQRRARPGRVLVLGRRRRHVVPRARLFGPAIFEASKLKVLFVGVDEEKHPGKLPRTYTLTHSDVTARLTLAVSHTIHAAQLQGWYNRLQRDEVVAEWKKVQGAMSLHVHCHISGGHFLLDLIAPLRYYIFRKELSVVLKAFVHGDGSLFSQHPELEEATVWVYFHSNNPNFNRVECWGPLSDAAAPYDDEAAVDSPAADAAMAATAVNTAADEQATRAGQWPRRCPGQCDCCFPPECLIPWPHEHEMAADAGQAPPQ

SEQ ID NO: 29021 - protein, 1290 aa, Bacteroides thetaiotaomicron VPI-5482
MNKKILILSFLSVLFLAAGPIRAAIDVTNLRTEQLKNPSGIDTRQPRLGWRIESDEQNVMQTAYHILVASSPELLAQGKGDMWDSGKVETDASQWITYQGETLKRNAPYFWKVKVYTNKGESDWSSPAFWSMGLFNEADWQGQWIGLDRAAPGDSETQWSRLAARYLRKEFALKKEIKRATVHIAGMGLYELFINGQRIGDQVLAPAPTDYRKTILYNTYDVTSQLQQENAIGVTLGNGRFYTMRQNYKPYKIPTFGYPKLRLNLIVEYADGSKETIATNTSWKLTTEGPVRSNNEYDGEEYDARKELGNWTQTDYDDTKWMPAERVSIPSGTLRAQMMPGMKVTETLKPVSIQKMGDKYIMDTGQNLAGWVRFRIKGQAGDSIRLHFAERLESDGEIFTKNLRDAHCTDIYVVSGREPQGATWAPRFVYHGFRYVEISGYPDAKTEDFVVEVVEDEMDHTGSFSCSDKTLNQVVRNAFWGIRSNYKGMPVDCPQRNERQPWLGDHAMGSWGESMFFDNHAMYNKWARDIREAQREDGCIPDVAPAYWNYYSDNVTWPATLPLVCDMLFTNYGDIRPIEDNYPAIKKWISHIREYYMTKDYIITKDKYGDWCVPPESLEMIHSQDPARKTDGALIATAYYLKVLQLMHRFASLQGLTADAKEWEDLEHKMKDAFNAHFLHIKEGTSLVPGHTLYPDSVFYGNNTVTANILPLAFGLVPKAHIKEVAKNAVTTIITTNKGHISTGVIGTQWLMRELSRRGHTDVAYLLATNDTYPSWGYMAAQGATTIWELWNGDTANPGMNSGNHVMLLGDLLPWCFNNLAGIRADRWKSGYKHIVFQPAFEIQELSNVDASYMSIYGKITSRWKKTPMHLEWDIELPANTTGEVHLPDGRKEKIGSGKYHFSVDIPTRNAAIISDEFLYEKASFPECHGATIVELKNGDLVASFFGGTKERNPDCCIWVCRKPKGAKEWTAPKLAADGVFSLKDSQAALAGIDSTCTPVVDAKGKLTARRKACWNPVLFQIPGGDLILFYKIGLNVGDWTGWLVRSKDGGKTWGKREALPEGFLGPIKNKPEYINGRIICPSSREGKGGWRIHFEYSDDKGKTWKTTESVPAELSVPTQNRKKGGINVDDQEAGEAIQGEGAQPILAIQPSILKHKDGRLQVLCRTRNAKIATSWSSDNGETWSKVTLSNVPNNNSGTDAVTMSDGRHILIYNHFSTLPGTPKGPRTPLCIAISEDGINWKPILTLEDSPISQYSYPSIIQGKDGKLHAIYTWRRQRIKYTEIDLSKFK

SEQ ID NO: 29022 - protein, 281 aa, Zea mays
MAAAASTMSLLPISQPRKQQQQGAGAVVVFQRRPWDARRRRYVVPTARLFGPAIFEASKLKVLFLGVDEGSSKHLHAHHPAPAPLLPRTYTLTHSDVTASLTLAVSHTINRAQLQGWYNRLQRDEVVAEWKKVRGRMSLHVHCHISGGHLLLDLIAGLRYYIFRKELPVVLEAFVHGDGDLFSRHPELEEATVWVYFHSNLARFNRVECWGPLRDAAAPAPAEDDSTAPAAASIAMEGQMPVGEWPHRCPQQCDCCFPPHSLIPWPNEQDMAAAAGQVRQQ

SEQ ID NO: 29023 - protein, 232 aa, Ostreococcus tauri
MGDFEAARTLGGYLVERFGEDSARARAARAAAERAAGETEKAEKMIEEGLERSPYDQRLMRSRVACALDRGDEREAIERLCEYLETHGADEEAWSALGKLYAGRGEYDKALFCYEEVVCAMPFDANAHRKMAEVLYTAGGRENVRDAKNHFALAIDFTSGKDVRAMYGAILCAKRLRETETDDTDGVVPKGEGAALADAAAERLLQRYAMENESMLRVVRPQIKRLVAPSEG

SEQ ID NO: 29024 - protein, 637 aa, Ostreococcus tauri
  misc_feature (491)..(497): Xaa can be any naturally occurring amino acid
  unsure (1)..(637): unsure at all Xaa locations
MPDADAEDGGPREGAERATRASTSSRPSEHEHLSNAILDDFTRGAVPSRSSTPPIPPLAPRQYEAMLRQQRASGVSPHGIDDDAERRSAARENEPSARRAANERVELDAGASAVRDLLGFTGYESSTATHTPAASIAGLEDVRGANGEADLEQVVVGKPATGVGNYDKPPGDELEPVKPAATTGRAKVGWVRINAQGNVNKLSMEKTKIATLLRGKTTHQTTSSAKTSPEKSISQATAAEEFPFEFIALEVALEMVCNSLEVEANKVELDSKPALEALRKRVDNVNLERVRRMKTRLVRVSGRVSKVREEIQRYLDDDSDMRDMYLTRKAKQEQETLTREESTDTPTGNASTQQRSTGGRPPLEHALSMSSGGGPVPRSPLGIPTTAEGVHPYFDHFDDDKDLQELEDLLETYFTHIDSTHRSLNGLNEYIDDLEDLIEIELDSQRNRLIQLELILTTATLCLTCFSVVVGIFGMNIKNNIENRHDMFLVXXXXXXXPTHRLFQLHTALFHNRRRHLRRFLNRYESRGGITPHSDGAVYAEDVSILTLRGTALIEFWPSEGEITGRPIASVLLEPRSVLTYKGTAYRLRHGIRETDADVVTEETANARALGLNPGARVERNPRGRVSVVFVRKRTVV

SEQ ID NO: 29025 - protein, 361 aa, Campylobacter upsaliensis RM3195
MPADLNDYFNKKNGNSNGKNNHRQNFNFKAPVFNFKGFGKFAPVIYTLIIIVLILIVAKPFVIINSGEMGIKARTGQYDPNPLEPGLHFFLPFIDRVIVVDTRVRQINYASLEGTNENLGIGTGVINKNSISVLDSRGLPVSIDVTVQYQLNPIQVPQTIAVWSLNWENKIIDPVVRDVVRSVVGRYTAEELPTNRNAIATQIEEGIRKTIVAQPNEPVELRAVQLREIILPAKVKEQIERVQIAKQEAERTKYEVERANQEALKKAALAEGEANATIISAKGKATAVKIEADAQAYSNKEIAQSLNTPLLNLKQIETQKAFNEALKVNQDAKIFLTPGGAVPNIWVDTKDAKKQTAISPN

SEQ ID NO: 29026 - protein, 379 aa, Alkaliphilus metalliredigenes QYMF
MRCDFNVPMDKEGKITDDIRIRGAMPTVEYLLENKAAVILMSHLGRPKGEAQAKFSLKPVADRISQLLGKEVIFADDDVVIGERTKELAKQLAPGQVLLLQNVRYRKEEEKNEEAFSKELASLADLYVNDAFGTAHRAHASTAGVAKFLPATMGFLIEKEVDFMGKALEAPERPFVAILGGAKVSDKIGVIENLIDKVDVLLIGGGMAYTFLKAMGYEIGTSLLEAEKVDLAKMLIKKAQANHVDLLLPIDTVVAREFKADATYDTVSIESMPKDMMGLDIGKDTISLFTEKIKTAKTVIWNGPMGVFEMPAFAVGTKEVARAMAENDAITIVGGGDSAAAAEQLGFADQMSHISTGGGASLEFLEGKILPGIDVLENK

SEQ ID NO: 29027 - protein, 358 aa, Triticum aestivum
  misc_feature (166)..(166): Xaa can be any naturally occurring amino acid
  unsure (1)..(358): unsure at all Xaa locations
MAASDESPMVRPTVQELTAAGVEEPPRQYVLPEQDRHGDLLAADEFPEPTPLIDLSRLTDADEAERLRAALQTWGFFLATNHGIEDSLMDAMMSVSREFFRQPAEEKQKCSNLVDGNGKDYQVEGYGSDKVVSEDQVLNWSDRLHLRVEPEDERNFAKWPSHPESXFFRDVLQEYASRTKKIRDLVLRSIAELLEIDEDYFVNQISNKASGFARFNYYPPCPRPDLVLGLRPHSDGGLLTILFNDDNVGGLQIQRDGRWYNVPTKPHTLLINLADCLEIMNNGIFRSPFHRVVTNVEKDRLSLAVFYAVDAETMLEPAPGLLDDKRPSRYRKMLAKDFVAGLFEHFRQGKRFIDTLKI

SEQ ID NO: 29028 - protein, 248 aa, Alkaliphilus metalliredigenes QYMF
MRKPIIAGNWKMNKTVAETLQFINEIRDQAETTDVEVVLCCPFTALSEAKKALGASKIKLGAQNMHWEDNGAFTGEISAEMLKELGVDYILIGHSERRQYFNETDETVNKKIKKALEQKLMPILCVGETLQEREAAQTFDVIKNQITIDLEGILPDSMKDIVIAYEPIWAIGTGKTASSQDANHVIAYIRQLIQEKYDDGISETVRIQYGGSVKPENATEIMNEEDIDGALVGGASLKADAFLGIVNF

SEQ ID NO: 29029 - protein, 247 aa, Coix lacryma-jobi
VGEGVTDLAPGDHVLPVFTGECKECAHCKSAESNMCDLLRINTDRGVMIGDGKSRFSINGKPIYHFVGTSTFSEYSVMHVGCVAKINPEAPLDKVCVLSCGISTGLGASINVAKPPKGSTVAIFGLGAVGLAAAEGARIAGASRIIGIDLNPNRFEEAKKFGCTEFVNPKDHNKPAQEVLAEMTNGGVDRSVECTGNIHAMIQAFECVHDGWGVAVLVGVPHKDAEFKTHPMNFLNERTLKGTFFGN

SEQ ID NO: 29030 - protein, 580 aa, Mycobacterium tuberculosis H37Rv
MPEFRVWAPKPALVRLDVNGAVHAMTRSADGWWHTTVAAPADARYGYLLDDDPTVLPDPRSARQPDGVHARSQRWEPPGQFGAARTDTGWPGRSVEGAVIYELHIGTFTTAGTFDAAIEKLDYLVDLGIDFVELMPVNSFAGTRGWGYDGVLWYSVHEPYGGPDGLVRFIDACHARRLGVLIDAVFNHLGPSGNYLPRFGPYLSSASNPWGDGINIAGADSDEVRHYIIDCALRWMRDFHADGLRLDAVHALVDTTAVHVLEELANATRWLSGQLGRPLSLIAETDRNDPRLITRPSHGGYGITAQWNDDIHHAIHTAVSGERQGYYADFGSLATLAYTLRNGYFHAGTYSSFRRRRHGRALDTSAIPATRLLAYTCTHDQVGNRALGDRPSQYLTGGQLAIKAALTLGSPYTAMLFMGEEWGASSPFQFFCSHPEPELAHSTVAGRKEEFAEHGWAADDIPDPQDPQTFQRCKLNWAEAGSGEHARLHRFYRDLIALRHNEADLADPWLDHLMVDYDEQQRWVVMRRGQLMIACNLGAEPTCVPVSGELVLAWESPIIGDNSTELAAYSLAILRAAEPA

SEQ ID NO: 29031 - protein, 511 aa, Alkaliphilus metalliredigenes QYMF
MKNPVALVILDGLGNREGELGNAVKKANLPNYHRLMSQYPHTEVEASGLAVGLPEGQMGNSEVGHLNIGAGRVVYQELTRISRAIETGDFFKNEHFLKLLRKLKTSGKALHLMGLVSDGGVHSHMNHIVALLKLAKREGLKRVCLHCFLDGRDTPPQSGLDYIKSLEASIAEIGVGRIVTISGRYYAMDRDQRWERVQQAYDAMTLGKGRLAEGAITAVEMAYSLKETDEFVIPTVIPNDEGEFELIEPDDGIIFFNFRPDRAREMTRALMDETFEGFKREKGYFSLNFVSMTSYDKTIENAEVAYPPQSLANTLGEYISKQGIKQLRMAETEKYAHVTFFFNGGVEIANIGEQRKLVPSPKVATYDLQPEMSAYELTEELIKEIDKDQYDFIVVNFANPDMVGHTGIEIAVIKALETVDECLGKVIDKLIEKGGKAIVTSDHGNAEEMIDEVTGGPVTSHTINPVPLILVGEEQTSLRDDGKLCDIAPTLLEMMNLSKPLEMTGKSLIKK

SEQ ID NO: 29032 - protein, 528 aa, Triticum monococcum subsp. aegilopoides
MAHVHVDELLHEAAAAAPRSLLIASAVLFSLVVVPLLLRIISKQGAASDAMLLSLLPSPPTKLPIIGHLHLMGDLPYVSLAGLAAKYGPELMLVHLGAVPTAVVSSPRTAEAVLRTHDHIFASRPRSMVFDIIMYGQTDSCFAPYGEHFRKARKLVTVHMLNARKIRSQRPAREEEVQLVIVKIAKAAAAREAVDMSELLHSYVNDLVCRAVSGKFSQEEGRNKLFRELTDINAALLGGFNILDYFPSLGRFELVCKMACAKARRVRKRWDLLLDKLIDDHAARMVSREDEAQPAQEEDKDFIDVSLSLQQEYGLTRDHIKAILIDMFEAGTDTSYMTLEFAMAELIRKPHLMKKLQEEVRRNVPNGQEMVAEDDLPNMTYLKAVIKETLRLHPPVPLMIPHFSLDACTVDGYTIPANTRVVINAWALRRHSSYWENENEFQPERFMNGAGVDLKPNEFHYLPFGFGRRMCPGVHSASATVETMLANLMYRFDWKLPPGLKEEDIDMTEVFGITVSRKEKLILVPVTA

SEQ ID NO: 29033 - protein, 376 aa, Burkholderia thailandensis E264
MAKRDYYEVLGVAKNASDDEIKKAYRKLAMKYHPDRNPDSKDAEEHFKEAKEAYEMLSDSQKRAAYDQYGHAGVDPNMGAAGAQGFGGFADAFGDIFGDIFGQAAGGGRGRGGPQVYRGADLRYSMEITLEQAAHGYDTQIRVPSWASCGICHGSGAKPGTKPETCPTCHGQGTVRMSQGFFSIQQTCPKCHGTGTYIPEPCVHCHGSGKVKETKTLEVKIPAGIDDGMRIRSAGNGEPGINGGPSGDLYVEIHIKPHPVFERDGDDLHCQMPIPFTTAALGGEIEVPTLAGRASFTVAEGTQSGKTFRLRGKGIKGLRSSIAGDLYVHVQVETPVKLTDQQRDLLKQFEKSLAEGGPRHSPQSKSWFDRVKSFFE

SEQ ID NO: 29034 - protein, 1006 aa, Yarrowia lipolytica CLIB122
MCQNLIRWRLKYENILWSHLLANYTTSLVYHQLLMTMSRLVRRLPGRIPTFRVAHSLSLSALRHYATATNIDGKQMAKDIRLELHDEIKQIQAKKPHFQPKLIIIQVGERPDSSAYVRMKLKAAREAQIDCELRKFSEDMAEDHLLEELDILNDDPSVHGILVQLPLPKHINETRITDSVITAKDVDGFGPLNVGELSKRGGNPAFVPCTPKGVMEMLDRSGIELRGKNAVVIGRSDIVGTPVASLLKGADATVTVCHRYTENLPAIVKNADVVVAAIGAPNFVKGEWLKPGAVVVDVGINYVKDETKKSGQRLVGDVDFDSAKEVASFITPVPGGVGPMTVAMLVNNVVTAAKRQSLEQQKMQVKPLPLKLRTPVPSDDAISRAQIPKNVKTVAKEAGLTEHEFEPYGAYKGKVSLTTLDRLKDRKDGKYVLVAGITPTPLGEGKSTTTVGLVQAMCAHLGKLAFANVRQPSMGPTFGIKGGAAGGGYAQVIPMDEFNMHLTGDIHAISAATNLLAAAIDTRMFHESSQKDAALYKRLVPSVKGKRQFIPSQLQRLEKLGINKTNPNDLTDEEISKFVRLDIDPETITWKRVVDCNDRLLRGITVGEGPSEKGRTRETGFDISVASECMAILALSNSLADMRRRLGNMVVASSREGLPVTCDDIGAGGALTALMKDAIKPNLMQTLEGTPVFVHAGPFANISIGASSVLADKIALKLAGTKTKGDEPGYVVTEAGFDFTMGGERFFNIKCRDSGLVPDAVVIVATVRALKLHGGGPEVKPGAQLAPEYQNENVDLVTAGAKNLGKQIENARSFGVPVVVAINQFATDTPAEIEAIRTAALKAGAAEAIVSNHWEKGGEGAIDLAKGVVKVCSQTDNVEKNPNFKFLYDIDTSAEEKLNTIAKEMYGAKGIELSPLARKKIDTYTAQGFGNLPICIAKTQYSLSHDPALKGVPKDFVVPIRDVRASVGAGYLYALAADIMTIPGLPTRPGYMNVEVDSKGQIEGLF

SEQ ID NO: 29035 - protein, 527 aa, Triticum monococcum subsp. aegilopoides
MALEAANHYLQLPGVHGASTPAVLLTVLLLLIIRLAWVRTATASTRFGKQQKLPPSPPGKLPIIGHLHLLGSQTHISIRDLDAKHGRNGLLLLRIGAVPTLFVSSPSAAEAVLRTHDQIFASRPPSMAADIIRYGPTDIAFAPYGEYWRQARKLLTTHMLSAKVVHSFRHGRQEEVRLVINKIREAATSGTAVDMSELLSGYTNDVVCRAVLGESHRKEGRNRLFSELTEINVSLLGGFSLENYIPPNMVMADVLLRLVSVKAQRLNKRWDDLFNEIIEEHLHPSKPSSGEQQAADFIDLLLSLKEEYGLTTDNIKAILVDMFEAGIETSYLTLEYGMAELMNNRHILTKLQEEVRSQGKKLDMITEEDLSSMAYLRATIKETLRMHPPAPFLLPHFSTADCKIDGYLIPANTRVLVNAWALGRDPSSWERPEDFWPERFLQDQDGDVDTQMRGKDLRFLPFGFGRRICPGMNFGFATMEVMLANLMYHFDWDVPNMVGTGAGVDMAESFGLTLHRKEKLQLVPQIP

SEQ ID NO: 29036 - protein, 577 aa, Gibberella zeae PH-1
MFGGSSNNSAGNKSESDSKSDKSPSPEPGTGLSAPSPIKTTDQAASGEKRSGNGSPPTRQDVGGPSDKKRRSSSVSSRASSLLASAKNSLNFSSQSSRGGGSEVNSQTSLQKLGKQDPALAVPQGQHNNSAGDSMPGPKSTFRVGVWEDRNKKCRRTMEDTHAFLYNFVQTPALNDASAKDKPEGDDLVTSDMVESDNGYFAIFDGHAGTFAADWCGKKLHIILEDIIRKNPNALIPEVLDQAFTAADAQLEKLPLKNSGCTAAVAVLRWEDRASNDRSAIKPVKPEEPIEMDKANDGSSNEEATKATNSKGKGSGRQRVLYTANVGDARIILCRGGKALRLSYDHKGSDEVEGKRIAAAGGLILNNRVNGVLAVTRALGDAYMKKLVTGHPYTTETVIQPDSDEFIIIACDGIWDVCSDQEAVDLVRNVNDPISASKQLVDYALNRFSTDNLSCMVVRLDQNKEAAVEVEGAASQVSEADKIVSETKQKIAEGIAPAVGVSATSNAPQSQPPIAVQEGDFVPTSLDDIVTEEPPHVADPKSDDVPILNKAAVLEARKDKPAEEKPVEEQETPPGQE

SEQ ID NO: 29037 - protein, 274 aa, Nicotiana tabacum
MPLILSGIDVVAMARTGSGKTAAFLLPMLEKLKQHVPQAGVRALILSPTRDLALQTLKFTKELGRFTDIRVSLLVGGDSKGSQFEELAQSPDIIIATPRRLMHHLSEVDDMSRRTVEYVVFDEADCLFSMGFAEQLHRILTHLGENRQTLLFSATLPSALAEFAKAGLRDPQLVRLDLDTKISPDLKLAFFTVRHEEKHAALLYLIREQISSDQQTLVFVSTKYHVEFLNILLREEGIEPSVCYGDMDHDARKIHISRFRARKTMVLIVTDVAD

SEQ ID NO: 29038 - protein, 489 aa, Marinobacter sp. ELB17
MSLELKNPELLRDRAYINGQWTAARSGKTFDVTNPANGEHLANVPDMDETDTRIAIESAETAWPAWRSAPAKERAKILRKWFDLLMENQEDLARLMTAEQGKPLAESRGEVGYGASFIEWFAEEAKRAYGDVIPSHGKDKRILVIKQPIGVVAAITPWNFPIAMITRKVAPALAAGCPVVVKPAEDTPLSALAITALAEQAGVPAGLINIITCSKPNAAAVGGELTGNPVVRKISFTGSTPVGKLLMRQASDTVKKVSLELGGNAPFIVFDDADLDAAVIGLMASKYRNTGQTCVCANRVYVQSGVYDAFAEKLKVAVSKMVVGAGLEGDTEQGPLINKPALDKVKRHIADATSKGAKIILGGQPHALGGTFFEPTILIDATQDMLIASEETFGPVAPLFRFETEEEAIAMANDSVFGLSAYFYSNNIHRIWHVAEALESGMVGINEGIISTEVAPFGGVKESGLGREGSHYGLDEYMELKYLCLGGMR

SEQ ID NO: 29039 - protein, 269 aa, Oceanospirillum sp. MED92
MTKTILITGSTDGIGLATALRLAEEGHHILLHGRSEKKLAEAQNKLKQVEGSGGVSCYQADLSVMADVVRFAEKVKAEQTHIDVLINNAGIFKTEERITSDGLDVRFAVNTVAPYLLTEKLLPMLGNQGRVINLSSAAQSEVNLEALLGVVSVEQDFNAYAQSKLAITMWSRVLAKSLTAGPAVIAVNPGSMLGTNMVQKGFGVSGNDISIGVNILTALALDDKYQQCSGQYFDNDAGHFADPHIDALDQHKSVAVVDAIKNILTELKL

SEQ ID NO: 29040 - protein, 373 aa, Prunus armeniaca
MTFTLCKKEILVDILVRLPAKSLVRFMCTCKSWSDLIGSSSFVSTHLNRNVNKHAHVYLLCLHHPNFECVVDPDDPYLEEEVQWSLFPNETFEECSKLNHPLGSTEHYGIYGSSNGLVCISDEILNFDSPIHIWNPSVRKLRTLPISTNIIKFSHVALQFGFHPGVNDYKAVRMMRTNKNALAIEVYSLRTDSWKMIEAIPPWLKCAWQHYKGTFFNGVAYHIIEKGPIFSIMSFDSGSEEFEEFIAPDAICRPSEVCIDVYKEQICLLFGFYRCEEMGMDKIDLWVLQEKRWKQLCPFIYPWGFCYRITGISIDNELLMGRRDFLKGVADLYLCKYESKQVLETGIKLGIMTYGEIEFLFSFTYMESLVLLN

SEQ ID NO: 29041 - protein, 445 aa, Clostridium perfringens ATCC 13124
MFGFFSPAPAIPRLPKDKVSSAYKAYRIRMFLMIFIGYTGYYLVRKNFAVASPYLIDNYGFSKTQIGLISMGLAVSYGLSKFILGNLSDKSNVKKFICFGLIASSVLSVLMGFARTVPIFLILMVFNGFFQGMGAPPCSIVLGKWFSQKERGLKMGIWNTSHNIGGGLIAPIATLCLLIFGQNHFQSIFFVPAIICTIVALFCYVIGADTPASVGLPPVEEYRNDYPEVKAEVNPTTLSSKEIMVKYVLKNKYVWYLALANIFVYLIRQGVVNWIPIYLKESKGFSAANANWAMFLFEYAAIPASILLGWLSDVVFKGKRAPLSILCMIGVIFATVAYWQTSSTLVTMISVAFIGCFIYGPQLLIGMNLIDVVPNFAVGSATGFSGLCGYLLGEFMADFVLGMIADSFGWNGAFIFIIVGAFIALLLLALTLKIKKNPQVEDKIA

SEQ ID NO: 29042 - protein, 511 aa, Sulfolobus solfataricus P2
MKRVLILTLLPLLLINTTFHANTTTPIRHVIIIIEENHSFDNLFGTYPFGYPPILNNITLSLMYPYGLYENYTQLQGAKNGVLYWISVPDIPWLPIAYSHPYYSNAYSTRDPYEGWDSYHGDYWFDTDKGFVYYSGPQSLAYFSYQQTWILWDYAEEYVLADDYFSPVLGLTEPNRIAYLTGFSPNFYSDDATNVIPFNYSIMYQLQLNNVSWGYFVYKLNGIPWPLDAFNQINMSHIYDLKNFFGDLKNGSLPAVSWVMLIGGESDEYDMHPPHNITAGEIMIANITNAVMESQYWNSTVIFITFDEGGGYYDQVIPPSINHYGLGQRIPLLIISPYAKEGYIDNYTLSGYTLLAFIDYNWHLPWLTKYVEDSDLQGLLQAFNFSTKPRAPIILTPSNWTYPLPLQYPIHYGYIATVPNYKGYAEIYPMPEMAFLLPLDVIAFVLLFISFKKRTLIKLTFLLFVVSLGISGYIYEINNIYQFISEYYFAASFIGFLIGGVLLARQYSRGK

SEQ ID NO: 29043 - protein, 456 aa, Bacillus anthracis str. Ames
MYHLQKDIRDKNLPIDTLLIEASGKLGGKIQTVRKDGFTIERGPDSFLARKESAARLVKELGLGDELVNNQAGQSFILVNNRLHKMPSGSMMGIPTQITPFLFSGLFSPIGKLRAGFDLLMPRSKPVSDQSLGHFFRHRLGNEVVENLIEPLLSGIYAGDIDEMSLMSTFPQMYQIEQKHRSISLGMRTLAPKAEKAEPKKGIFQTVKTGLESIVESLELKMHEGTIIKGTRIEKVAKQGDGYAITLSNGKEIEADAVVVASSHKVLPSMFAQYKQFRFFRNIPSTSVANVAMAFPKSAIQRDIDGTGFVVSRNSDYTITACTWTHKKWPHTTPEGKTLLRCYVGRPGDEAVVEQTEEELVQLVLEDLRKTMDITEDPEFTVVSRWKEAMPQYTVGHNERMKKLTTFMEKELPGIYLAGSSYAGSGLPDCIDQGEKAAKRVLSHLEKVMNTELIAQ

SEQ ID NO: 29044 - protein, 357 aa, Saccharomyces cerevisiae
MSQNSNPAVVLEKVGDIAIEQRPIPTIKDPHYVKLAIKATGICGSDIHYYRSGGIGKYILKAPMVLGHESSGQVVEVGDAVTRVKVGDRVAIEPGVPSRYSDETKEGSYNLCPHMAFAATPPIDGTLVKYYLSPEDFLVKLPEGVSYEEGACVEPLSVGVHSNKLAGVRFGTKVVVFGAGPVGLLTGAVARAFGATDVIFVDVFDNKLQRAKDFGATNTFNSSQFSTDKAQDLADGVQKLLGGNHADVVFECSGADVCIDAAVKTTKVGGTMVQVGMGKNYTNFPIAEVSGKEMKLIGCFRYSFGDYRDAVNLVATGKVNVKPLITHKFKFEDAAKAYDYNIAHGGEVVKTIIFGPE

SEQ ID NO: 29045 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEEIQLLYEEGIKPWKSASWVPPSRRGASSRETEAKKKSWKEVLKFPKSFN

SEQ ID NO: 29046 - protein, 187 aa, Zoysia japonica
TYTLTHSDVTAKLTLAVSHTIHAAQLQGWYNRLQRDEVVAEWRKVRGNMSLHVHCHISGGHFLRDLIAPLRYYIFRKELPVVLKAFVHGDGSLFSSHPELEEATVWVYFHSNLPRFNRVECWGPLCDAAAPVEEEGQQNDDRLPAGEWPRRCPQQCECCFPPHSLIPWPNEHDMAPTDAPAAGQTQQ

SEQ ID NO: 29047 - protein, 228 aa, Gibberella zeae PH-1
MNILEWAFGKRMTPAERLRKNQRMLDKAIRELDQTRVKLEKQEKTLIQQIKTSAKNGQMGACKIQAKDLVRTRRYVEKFYSMRSQLQKISLRLQTYRTNEDMMQAMKGATRALGSMNKQMNLPQLQRIAMEFERENDIMDQRSEVMDDVFDDAMDVGVEEEGDEVVEQVLEEIGVDFNQALGETPTALGTAAVPEGKIAQAVGGGGGGGGGGDPVDDDLQARLDSLRK

SEQ ID NO: 29048 - protein, 337 aa, Nostoc punctiforme PCC 73102
MAISLKPLRNQVVVITGASSGIGLVTARMAAKQGAKLVLAARNEDALRQLVDEIRAKGGQAIYVVADVGQEEDVNRIAERAIAEFGGFDTWVNNAGVSIFGRCMDVSIPDMKRMFDTNFWGVVYGSRAAVNHFKQRKSGSGALINVGSFLGDRAVAVQSTYSASKHALHGWTDALRTELEAEGAPVSVTLIHPGRIDTPYNEHARSYMPKQPAHRGMIYPPEAVTEAILYAAEHPKRDMFVGFQAKALAVLAGISPRLTDKLIELWAFPSQQSDRPSRDREDSALYRAGYGMHERGTHQGWIRSGSLYVKAEKHPVTTTIIVVGLGTLIWWFTSFAV

SEQ ID NO: 29049 - protein, 1469 aa, Arabidopsis thaliana
MDYNPNLPPLGGGGVSMRRSISRSVSRASRNIEDIFSSGSRRTQSVNDDEEALKWAAIEKLPTYSRLRTTLMNAVVEDDVYGNQLMSKEVDVTKLDGEDRQKFIDMVFKVAEQDNERILTKLRNRIDRVGIKLPTVEVRYEHLTIKADCYTGNRSLPTLLNVVRNMGESALGMIGIQFAKKAQLTILKDISGVIKPGRMTLLLGPPSSGKTTLLLALAGKLDKSLQVSGDITYNGYQLDEFVPRKTSAYISQNDLHVGIMTVKETLDFSARCQGVGTRYDLLNELARREKDAGIFPEADVDLFMKASAAQGVKNSLVTDYTLKILGLDICKDTIVGDDMMRGISGGQKKRVTTGEMIVGPTKTLFMDEISTGLDSSTTFQIVKCLQQIVHLNEATVLMSLLQPAPETFDLFDDIILVSEGQIVYQGPRDNILEFFESFGFKCPERKGTADFLQEVTSKKDQEQYWVNPNRPYHYIPVSEFASRYKSFHVGTKMSNELAVPFDKSRGHKAALVFDKYSVSKRELLKSCWDKEWLLMQRNAFFYVFKTVQIVIIAAITSTLFLRTEMNTRNEGDANLYIGALLFGMIINMFNGFAEMAMMVSRLPVFYKQRDLLFYPSWTFSLPTFLLGIPSSILESTAWMVVTYYSIGFAPDASRFFKQFLLVFLIQQMAASLFRLIASVCRTMMIANTGGALTLLLVFLLGGFLLPKGKIPDWWGWAYWVSPLTYAFNGLVVNEMFAPRWMNKMASSNSTIKLGTMVLNTWDVYHQKNWYWISVGALLCFTALFNILFTLALTYLNPLGKKAGLLPEEENEDADQGKDPMRRSLSTADGNRRGEVAMGRMSRDSAAEASGGAGNKKGMVLPFTPLAMSFDDVKYFVDMPGEMRDQGVTETRLQLLKGVTGAFRPGVLTALMGVSGAGKTTLMDVLAGRKTGGYIEGDVRISGFPKVQETFARISGYCEQTDIHSPQVTVRESLIFSAFLRLPKEVGKDEKMMFVDQVMELVELDSLRDSIVGLPGVTGLSTEQRKRLTIAVELVANPSIIFMDEPTSGLDARAAAIVMRAVRNTVDTGRTVVCTIHQPSIDIFEAFDELMLMKRGGQVIYAGPLGQNSHKVVEYFESFPGVSKIPEKYNPATWMLEASSLAAELKLSVDFAELYNQSALHQRNKALVKELSVPPAGASDLYFATQFSQNTWGQFKSCLWKQWWTYWRSPDYNLVRFIFTLATSLLIGTVFWQIGGNRSNAGDLTMVIGALYAAIIFVGINNCSTVQPMVAVERTVFYRERAAGMYSAMPYAISQVTCELPYVLIQTVYYSLIVYAMVGFEWKAEKFFWFVFVSYFSFLYWTYYGMMTVSLTPNQQVASIFASAFYGIFNLFSGFFIPRPKIPKWWIWYYWICPVAWTVYGLIVSQYGDVETRIQVLGGAPDLTVKQYIEDHYGFQSDFMGPVAAVLIAFTVFFAFIFAFCIRTLNFQTR

SEQ ID NO: 29050 - protein, 401 aa, Oryza sativa (indica cultivar-group)
MQRNGVMECSVCHSKVVAPSPRSVSRAYDKHRSKISSKYRALNFLLVSGDCILVGLQPILVFMSKVDGKFQFSPISVNFLTEVTKVIFAIVMLIIQSRKQKVGEKPLLSLSTFVQAARNNALLAVPALLYAINNYLKFIMQLYFSPATVKMLSNLKVLVIAILLKFIMRRKFSIIQWEALALLLIGISVNQLSSIPDGTKSFGLAVTTIAYIYTLIFVTVPSLASVYNEYALKSQFDTSIYLQNLFLYGYGAIFNFLGILGTVIFQGPESFDILQGHSRATMFLICNNAAQGILSSFFFKYADTILKKYSSTVATIFTGLASAAFLGHTLTVNFLLGISIVFISMHQFFSPLAKVKDDKPAGALEPEDAQNHRSSDSSFVNMTAGAADDCLLDENVTLLQL

SEQ ID NO: 29051 - protein, 524 aa, Triticum monococcum subsp. aegilopoides
MALEAAHHYLQLAVGHGTSSPAGLLLVVVPLLLLLLASVRSSTKASRKLRLPPSPPGSLPIIGHLHHIGAQTHISLQHLVDKYGHNGLLFLRAGAVPTVIVSSPSAAEAVMRTHDHILASRPWSMASHILRYNTTDVAFSPLGEYWQHTRKLVNTHLLSAKKVHSFRHGRQEEVCLVVDKIREAATNAPSTAVDMSEFLAAYTNDVVSRSVLGATHRKKGRNTLFREMTETNVDLLVGFNLENFIPRWPLTEVLFRLVCWKVQRHLNKWDALLEEVIKEHINLKQDNSADFIHVFLSLQQEYGLTDDNVKSLLMNIFEAAIETSYLVLEYAMAELINNRHVMKKLQTEVRTFASSRGEKLDMITEEDLSSLPYLKATMKEALRLHPPGPLLLPHYSTADCNIDGYDIPAKTRILVNGWAIGRDPTAWERPEDFMPERFLQDGQEKSGNLGQDFKYLPFGSGRRICPGANFALATMEIMLVNLMYHFDWEVPNGKEGTGGKISMAETFGLMLRRNEKLYLVPKIV

SEQ ID NO: 29052 - protein, 197 aa, Triticum aestivum
  misc_feature (143)..(143): Xaa can be any naturally occurring amino acid
  misc_feature (154)..(154): Xaa can be any naturally occurring amino acid
  unsure (1)..(197): unsure at all Xaa locations
MGAAATATATAVRLHAAATRRAAPRRPARLAVRADAARAATALTQDDLNLLAAVRAVEQVQSGMVLPLGTGSTAAFTVAEIGALLASGKLSGIVGVPTSKRTFEQATSLGIPLSTLDDHPVIDLAIDGADEVDPNLNLVKGRXGGALLREKMVXEAASGKFVVLTDETKLVNRLGREAASPLPGGSCAISAWKPQPK

SEQ ID NO: 29053 - protein, 162 aa, Burkholderia thailandensis E264
MTAIQQFFKTFFLTELLKGLALTGRYTFKRKFTVQFPEEKTPISPRFRGLHALRRYENGEERCIACKLCEAVCPAMAITIESETRADNTRRTTRYDIDLTKCIFCGFCEESCPVDSIVETQILEYHGEKRGDLYFTKEMLLAVGDRYEKEIAAAKAADARYR

SEQ ID NO: 29054 - protein, 529 aa, Candida albicans SC5314
MTSETVIAPSLSTAQNDGTFTYDKVKSTAKERKHLNLKNPSDANEIKSKIWNYYSLSELIQYLGQKENDDFKYKRITLQFPDNLICDSATIVHELQRELNIVPQANQDTGESNTAQRVWILADTSYSACCVDEVAAEHVRSDLVVHFGDACLNEIDKLQAVFVLGKPTLDVDAIVKQIKTAYSTEQKVVLMSDAPHTYLLPEIAKQLPDYDILIADLPKTSRAKIIGYTPPPTGHKKFNRVFNTDTVEFGEYELFHITSPESPRLLQLTTNFASVTTYDPISGTVSTGPFPNLMRRYKYVHQARMAGTVGILVNTLSLANTKVLLNTIKEEIKEAGKKHYIFVVGKPNVAKLANFESVDIWCILGCDHQGIIIDQINEYYKPIVTPYELLLGLSDELSWTGKWVVDYKSVLEEYGNEVIQQNEDPDTDEDLPPVFDPVTGRYVSTSKPLRQINHLMVTSSEQGGVDDHDNQLVKRFSNAVAIKGTVSTSAIHLQNRHWTGLGSDYTEDENATGALVEDGRKGIARGYDI

SEQ ID NO: 29055 - protein, 481 aa, Zea mays
  misc_feature (99)..(99): Xaa can be any naturally occurring amino acid
  misc_feature (184)..(184): Xaa can be any naturally occurring amino acid
  unsure (1)..(481): unsure at all Xaa locations
MASAAAPPTSLSLAARAATRAAAAAAAPLRRGGLATACQPARSLAFAAGDARLAVHVASRCRQAFSGRGTRAMATMAKKSVGELTEADLEGKRVFVRAXDLNVPLDENQNITDDTRIRAAIPTIQYILSKGAKVILSSHLGRPKGFTPKFSLAPLVGRLSELLGIQVQKADDVIGPEVEKLVAXLPNGGVLLLENVRFYKEEEKNDPEFAQKLASLADLYVNDAFGTAHRAHASTEGVTKFLQPSVAGFLLQKELDYLVGAVSSPKRPFAAIVGGSKVSSKIGVIESLLEKCDILLLGGGMIFTFYKAQGLPVGASLVEEDKLELATSLLAKAKEKGVSLMLPTDVVIADKFAPDANSQIVPASAIPDGWMGLDIGPDSVASFNAALDTTKTVIWNGPMGVFEFDKFAVGTEAVAKKLAELSGKGVTTIIGGGDSVAAVEKVGVADVMSHISTGGGASLELLEGKELPGVVALNEAATVTV

SEQ ID NO: 29056 - protein, 245 aa, Oryza sativa (indica cultivar-group)
MAIATTTLPLAPLALALAPPSSPISQCSLLLLRPRAPAALSLRPSARLLVAVAAREPELGGSGGGGGGAGDGSGSGGGGDSEKPRGGGGDEEGEGEEEKMGQGLSMSQKITLAYAALVGENQNTYSTFRFSSLLLEFWFLKSSLYQNNDDTTTTGGAMGYMKSGSQKSLAAGGISALVLYFVHTQLPVRPVFASSIGLGISAALLSVMGSRFKKSGKIFPAGVVSLVSLVMVGGYIHGILRSTHA

SEQ ID NO: 29057 - protein, 402 aa, Brassica napus
  misc_feature (112)..(112): Xaa can be any naturally occurring amino acid
  misc_feature (141)..(141): Xaa can be any naturally occurring amino acid
  unsure (1)..(402): unsure at all Xaa locations
MATKRSVGTLKEADLKGKSVFVRVDLNVPLDDNSNITDDTRIRAAVPTIKYLMGNGSRVVLCSHLGRPKGVTPKFSLKPLVPRLSELLGVEVVMANDSIGEEVQKLVAGLPXEGGVLLLENVRFYKEEEKNDPEFAKKLAXLADVYVNDAFGTAHRAHASTEGVAKYLKPSVAGFLMQKELDYLVGAVANPKKPFAAIVGGSKVSTKIGVIESLLSTVDILLLGGGMIFTFYKAQGHSVGSSLVEEDKLDLAKSLMEKAKAKGVSLLLPTDVVIADKFAPDANSKIVAATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELLEGKPLPGVLALDDA

SEQ ID NO: 29058 - protein, 533 aa, Burkholderia vietnamiensis G4
MNARTLPFGPPGHDGHDGHDGPDETTDIAIIGTGFAGLGMAIRLRQTGATDFVVLEKAASVGGTWRDNHYPGCACDVQSHVYSFSFAPNPRWTRMFAPQPEIRAYLEDCVQRFGIGPHLRMNHELQRAEYDEAAQRWRLTFANGKRLSARVLVSGMGGLSRAALPAIAGIETFEGRAFHSQQWDHAYPLEGKRVAVIGTGASAIQFVPQIAPRVKSLALFQRTPPWIMPKPDRNLTRVEKWLFRTLPFTQKLVRSGIYWMLESRVLGFAIHPSLMKNVQKLALRHIRKQIPDPELRRTVTPNYTLGCKRVLISNDYYPALSRKNVDVITTGIDHIEADAVVTTDGKRHEVDCLIYGTGFQVADPYPRGAIIGRGGLDIVDAWRDGAHAYLGTTLPGYPNFFMIVGPNTGLGHNSMVFMIESQIEYILGALRAMQRERADAIEVRPLVEAQYNSALQGKLKKAIWSTGGCKSWYLDPRTGKNTTLWPGFTWRFRQATAHFSIADYHAYRAPQHAASARPAAAPAASTSTSADAA

SEQ ID NO: 29059 - protein, 1133 aa, Oryza sativa
MGGAHSREDLDLTSSDDEDDDEEYDAQTATSAASREDILRTSTPSSLEFLDAKLKALDLKYQAPNAAKLYLHVGGASASARWVPAERRATYAFVDKATAAGDSDCGGPRWVLEVGPGPRVSAPVGPALQLKALPAQRRADFAAGGSVWALRLPTDAAFRRFRQEYDRCLFENTYGVEATDEGRKEVFGADFAAWARPGESDDAVWADAEDSFTPPVATPARDLLEEFEEEAGDGSIQSLALGALDNSFLVGGSGIQVVKNFRHGVHGKGVSVRISDGRGGGNAYMTPQKALLMRGETNMLLMSPGETGTRHSNGVHHVDIETGKVVAQWRFEKDGTDITMRDIANDSKGAQLEPSGSTFLGLDDNRLCRWDMRDSRGRVQTIGSSSESPVLQWSQGHQFSRGTNFQCFASTGDGSIVVGSVDGKIRLYSKSSMRMAKTAFPGLGSPITHVDVTYDGKWILGTTDTYLILICTIFKDKDGKEKTGFSGRMGNRIAAPRLLKLSPLDSILAGSENKFHGGQFSWVKDSNHECYRDQEGLKSCYCYKVVLKDESIVDSRFMHEKFATTDSPEAPLVVATPMKLTAVPFVVRESTGWRGRRGQGAMGGGTAVQVAGWRGDTDGVAMGNASEEAATPVDLQWGRHGRRPDGGGASTPAISSTSEGAAAPAVGAAQAESGWWRRAAEEQWREQWGGADGGASTPAISNCRPEQSIRGVSGVEMKWESAGGQRNCQQLGGGVFGGDAHHLFDEMSTCPRGDSAAVLRVTVSQIIYPVTSEVLHQVYNTYGAVAVQVLAVSTWQVKALVSFMSSHDAERARSATHGRDIYDGGCLMDVQHVQMFPGDGATTTHTTCLTMVPSSATARPAAKSTAATPERVFPATTASSIPSITSAAMVTSVPFNETKKAETDMDKAVENLDKTIQDLCTKIDRMLEAFRHTKVDLSLSKDSTRDVAALSANTDPTSIALEVSTEAGSTNHVDTAKLGMGTTIECSMKCENQLADDDGGKDMAKEEWMELMEVDTKFTTMYLCFRDPLLIINAIPPRNWSWCLSRDYFGVVGLSFVSLKLEVLYGCFDRSSEYTASPPPVPPWRAAIPRNKAEMTSGSRPLPWLDPQLCQGSGGVVEGKGSIFLGSVYLKGN

SEQ ID NO: 29060 - protein, 117 aa, Prochlorococcus marinus str. MIT 9301
MFETGGMPSSHSALITGAASGVGYELGFDSSIFALSVAVALIVMYDASGVRKSAGIQAVEINKLSKKLDPKSELLLKENLGHTKIEVIVGSFLGPLITLPGMFFLGSPLKIFDLIIN

SEQ ID NO: 29061 - protein, 1143 aa, Lotus japonicus
MASASRRGGGGGGSGSGSVVERGKEEEKLKRGGGGGGGESVMMRKAIAQYTEDARLHAVYEQSGESFDYSHSLRVTVESVPEQQITAYLARIQRGGYIQPFGCMIAVDDPSFRLLAYSDNARDMLGITPQSVPSIDDDSSSSSFALGTDVRSLFSPSSAVLLDKAFAAREISLMNPLWIHSRTSGRPFYGILHRVDVGVVIDLEPARSDDPALSIAGAVQSQKLAVRAISQLQSLPGGDVKLLCDAVVQSVRELTGYDRVMVYKFHEDEHGEVVAESKRADLEPYMGLHYPATDIPQASRFLFKQNRVRMIVDCHASPVGVVQDEALMQPLCLVGSTLRAPHGCHAQYMANMGSIASLVMAVIINGNDDDAVGVGGRSSMRLWGLVVCHHTSARCIPFPLRYACEFLMQAFGLQLNMELQMAAQSLEKRVLRTQTLLCDMLLRDSPAGIVTQSPSIMDLVKCDGAALYCQGSYYPLGVTPSESQIRDIIDWLLAFHGDSTGLSTDSLADAGYPGASSLGDAVCGMAVAYITEKDFLFWFRSHTAKEIKWGGAKHHPEDKDDGQRMHPRSSFKAFLEVVKSRSSPWDNAEMDAIHSLQLILRDSFKEDEHSDSKAVVNTHLAELELQGVDELSSVAREMVRLIETATAPIFAVDVEGHINGWNAKVSELTGLPVEEAMGKSLVRDLVYKESEETVDRLLSRALKGEEDKNVEIKLRTFGPEHQDKAVYVVVNACSSKDYTNNIVGVCFVGQDVTGQKVVMDKFINIQGDYKAIVHSPNPLIPPIFASDDNTCCLEWNNAMEKLTGWGRADVIGKLLVGEVFGSCCQLKGSDAITKFMIVLHNALGGQDTDKFPFSFLDRHGKYVQTFLTANKRVSIDGQIIGAFCFLQIVSPELQQALKVQKQQEKNCFARMKELAYICQEVKNPLSGIRFTNSLLEATGLTDEQKQFLETSAACEKQMLKIIRDVDLESIEDGSLELERGEFLLGNVINAVVSQVMVLLRERNLQLIRDIPEEIKTLAVYGDQLRIQQVLADFLSNVVRYAPSPDGWVEIHVYPKIKQISDGLTLLHAEFRLVCPGEGLPSELVQDMFHNSRWVTQEGLGLCMSRKILKLMNGEVQYIREAERCYFFVLLELPVTRRSSKGVN

SEQ ID NO: 29062 - protein, 725 aa, Burkholderia thailandensis E264
MREHAGDARLPSGELLADHATGTSTIMQRLNVDPPATQAAALFALAPYLSDPEKQIAERFGDEVAHLVTDVRKLLRLGTVSLRAAQSVPVDAGRDAQAERRAQIEALRKMLLAFAQDIRVVLIRLASRLQSLRHYAAAKIEPPPDVARETLEIYAPLANRLGIWQLKWELEDLAFRFEDPVTYKRIAKLLDEKRVEREAYVADAIAQLQRELAAAHIQAEVSGRPKHIYSIWRKMRGKELDFSELYDVRAFRVIVPDIKDCYTVLGIVHHLWQPVPKEFDDYISRPKPNGYKSLHTVVIGDDGRAFEVQIRTHEMHRFAEYGVAAHWRYKEAGARGYGGQFSASEKYDEKIAWLRQLLAWKDEIADSGGADASGHEAWAQLRETTLDDDHIYVLTPQARVIALPQGATPVDFAYHLHSELGHRCRGARVDGAMVPLNTPLANGQTVEIVAVKEGGPSRDWLNPQLGYLSSSRARQKVRAWFNAVDQQENVAHGRALVEKTLQREGKTSVNLEHLAAKLGFKSPDELFSVVGKEEFSLRNVEQALSDAPAPEPEPEAPAHFEKRASGANVAHGASTGVLVVGVDALLTQLARCCRPAPPDPISGFVTRGKGMSIHRSDCATFRRMAERAPERVLQTTWSADVLGGRGASVYPVDLMIEASDRQGLLRDISEVFAREKMNVIGVKTQSRRNAAFMQFTVEVSSASQVQRACTLLGEVQGVVRAARKA

SEQ ID NO: 29063 - protein, 336 aa, Aspergillus niger
MAPKVGINGFGRIGRIVFRNAINHGEVDVVAVNDPFIETHYAAYMLKYDSTHGQFKGTIETYEEGLIVNGKKIRFFAERDPAAIPWGTTGADYIVESTGVFTTQEKAAAHLKGGAKKVVISAPSADAPMFVMGVNNTSYTKDINVLSNASCTTNCLAPLAKVINDKFGIVEGLMTTVHSYTATQKVVDAPSSKDWRGGRTAAQNIIPSSTGAAKAVGKVIPTLNGKLTGMAMRVPTSNVSVVDLTCRLEKATSYDEIKKALKDASENELKGILGYTEDDIVSSDLNGDDHSSIFDAKAGIALNSNFVKLVSWYDNEWGYSRRVVDLIAYISKVDAQ

SEQ ID NO: 29064 - protein, 331 aa, Candida albicans
MAIKIGINGFGRIGRLVLRVALGRKDIEVVAVNDPFIAPDYAAYMFKYDSTHGRYKGEVTASGDDLVIDGHKIKVFQERDPANIPWGKSGVDYVIESTGVFTKVEGAQKHIDAGAKKVIITAPSADAPMFVVGVNEDKYTPDLKIISNASCTTNCLAPLAKVVNDTFGIEEGLMTTVHSITATQKTVDGPSHKDWRGGRTASGNIIPSSTGAAKAVGKVIPELNGKLTGMSLRLPTTDVSVVDLTVRLKKAASYEEIAPAIKKASEGPLKGVLGYTEDAVVSTDFLGSSYSSIFDEKAGILLSPTFVKLISWYDNEYGYSTKVVDLLEHVA

SEQ ID NO: 29065 - protein, 337 aa, Claviceps purpurea
MAVKVGINGFGRIGRIVFRNAVEHPEIEVVAVNDPFIDPEYAAYMLKYDSSHGVFKGEIKKDADGLIVNGKKVKFHTERDPSAIPWKASGAEYIVESTGVFTTTEKAKAHLTGGAKKVIISAPSADAPMYVMGVNEKTYDGKADVISNASCTTNCLAPLAKVIHDKYTIVEGLMTTVHSYTATQKTVDGPSGKDWRGGRGAAQNIIPSSTGAAKAVGKVIPDLNGKLTGMSMRVPTPNVSVVDLTVRIEKGATYDEIKATVKEAANGSLAGILGYTEDDIVSSDMNGNTNSSIFDAKAGISLNKNFVKLIAWYDNEWGYSRRVLDLLAYVAKADASK

SEQ ID NO: 29066 - protein, 338 aa, Blumeria graminis f. sp. hordei
MAPIKVGINGFGRIGRIVFRNAAQSCEVEVVAVNDPFIEPEYAAYMLKYDSTHGQFNGDIQTVEDGLVVNSRNVKFYNKRNPEEIPWAETGAEYIVESTGVFTTTEKAKAHLKGGAKKVIISAPSADAPMFVMGVNHKSYTTDLEVISNASCTTNCLAPLAKVINDEFTIIEGLMTTIHSYTATQKTVDGPSAKDWRGGRTAAQNIIPSSTGAAKAVGKVIPALNGKLTGMAMRVPTANVSVVDLTCRIEKSATYDEIKKAIKIAAGNELQGILSYTEDEIVSTDLIGNNHSSIFDAKAGISLNDNFVKLVAWYDNEWAYSRRVIDLISYIAGKDGSK

SEQ ID NO: 29067 - protein, 331 aa, Kluyveromyces marxianus
MVRIAINGFGRIGRLVLRIALSRKNIEVVAINDPFITVDYAAYMFKYDSTHGRFDGEVSHDGKSLIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 29068 - protein, 428 aa, Burkholderia vietnamiensis G4
MNDNNSLDSAQTRPHRGSWLRRLGPGLVTGAADDDPSGIGTYSQAGAQFGLELLWSLLLTYPLMTAIQLVSARIGRVTGKGLASNMRAHYPPWLLYATVVLLIVANVINIAADLAAMGAAVNLLLHGPQELYVVFLGALSALLQIFVPYDRYARLLKWTALALLAYVAVALIVPVDWGEVGRALVRPRFQLTAAYLTTVVAVLGTTISPYLFFWQASQEVEELRAKPNQKSLRRAPHQAPAQLQRINFDTWVGMGVSNVIAFFITLTAAATLNRHHIAVKTSADAARALEPIAGHFAYILFALGIIGTGLLALPVLAGSAAYAAAGTFRWRNSLALKVGVAPEFYAVIALAIIGGVAITFMHFDPIRALYWSAVINGVTAVPIMIVMMLMARSRRIMGEFAVRGVLAWGGWIATAAMAIAATGVFVPG

SEQ ID NO: 29069 - protein, 677 aa, Zea mays
LKERGGVLERSQADERGGDASQEAVLPGVRRGDREQRQVPETLGRILRGERGVLECFRIPEQLTGVDQIHSALLLVARGGIWLACPWSKWIGSAWSLGEHNIKLWFLDISAFLFFSLGERINDVVALKPNKADAGSASLGQGVVYRLKDSSITVAFDDIPEDGLNSPLRLEKLANEVTYRRMKDALIELSKAVQTGPCANLVPVLFGEKAPMRSKDAMKFSPFNKNLDDSQKEAISKALGSRDVFLLHGPPGTGKTTTIIEIILQEVKRGSKILACAASNIAVDNIVERLARYRTKLVRLGHPARLLPQVLDSALDAQVLRADNSSLAGDIRKEMKVLNSKLLKAKDRNTKRDIRKELKTLAKEERKRQQLAVTDVLKNADVVLTTLTGASSKKLNGITFDLVVIDEAAQALEVACWIALLKGPRCILAGDHLQLPPTIQSVEAEKKGMGKTLFERLTEAYGEEITSMLTVQYRMHEHIMSWSSKELYNNKIKAHSSVAGHMLYDLEEVTRSSSTEPTIVLIDTTGCDMEEVKDEEESTMNEGEAAVSIAHAKLLVESGVNASDIGIITPYAAQVTCLKMMRNKDAKLKDLEISTVDGFQGREKEAIIISMVRSNSKKEVGFLSDHRRMNVAVTRARRQCCLVCDVETVSSDRFLKRLVEYFEENGEYLSASEYQSS

SEQ ID NO: 29070 - protein, 394 aa, Rhodococcus sp. RHA1
MSQREWIEKDFYKELGVSSHASADEIKKAYRKLARDLHPDANPGDTKAEERFKSVSEAHAVLSDPAKRKEYDEARRLFASGGFGQGGGGFNPGAGGFGQGGFDINDLFGGGGAAAGDGGFGDIFGGLFNRGAGGGGATRTTNRPRRGSDVETETTLEFREATLGVTVPLRLTSPSPCTTCHGSGAKPGTSPRVCPRCNGTGIVSRNQGAFGFSEPCDDCRGTGSIIDSPCEVCHGNGVTNRTRTITVRVPAGVSDGQKIRLAGQGEAGLRGAPSGDLFVTVRVRPDKVFGRNGDDLTLVVPVSYGELVLGTTVSVPTLEGRVGVKIPAGTADGRVLRVRGRGVPKRAGGAGDLLVTVKVAVPQKLDDPATEALKTYLEAEKASGFDPRAGWAGA

SEQ ID NO: 29071 - protein, 507 aa, Sulfolobus solfataricus P2
MDSTIMDYNLNIRSIFWRIEKLYKDREIISRTYEGIVHYTYSDFALRVRKLATFLKTNGIAGEAVASIAWNTHRHLELYFAVPLLGGVLHTVNVRFHESEMDYVIKSMGDKAIFMDKDINYKNSTLPTFIFDERYDEDVNSQESTSDFPDVDERQGAIACFTSGTTGKPKGVIYSHRSVFIHSLSLLAADALGISSSDTVMPIVPMFHISAWDLPFSSLMTGAKLVLPGPRPKAEDIVKLIKEFKVTVGVGAPTVWIDVVNYVERENVDLPLKVVVTGGAEPPLGLIKKLKELGVKTYHAWGMTETEAIATVNKSDNIERMSEQGYPIPAFEIALMGPEGNELPWDGKSTGELVARGAFVTKKYLNDKSDAQTKWFRTGDVARINPDGSVKVIDRLKDLIKSGGEWISSVDLENAIMSYEKVLEAVVVGVKDERWGERPIALVVKKPGMDVNEYEIIEYLKSLNRFPKWWLPDKIIFVDSIPKTSTGKLDKKLVREQLRSMLEEKKY

SEQ ID NO: 29072 - protein, 354 aa, Triticum aestivum
AAPISPNPSSFAVEEYLVATCGLTQPQAVKASKKLSHLKSPAKPNAVLALLAGLGLSGADAAAVVAKDPRLLCAKVDKTLAPVIAGLTGLGLSSPEIGQLVSLARTRFRCRPVVPRLQYYLPLFGSFDNFLRLLKRESNLLSIDLDKVVKPNVVFLRECGLGDCDIAKLSIRVPRMLITNLERVRAMVARAETLGVPRRSGMLKEALQAVAFLSEEKIAAKLDYLKNTFRWSDAEACIAVRKYPCVLKKSKESLKRKSEFLVSEVGLEPVSIAHRPVILCLSLEGRVRPRYYVLKFLKENGLVDRDLSFHTAVNRPEKYFMEKLISPHKEAAPHLAEDYATACKGEMPTNFRFV

SEQ ID NO: 29073 - protein, 352 aa, Saccharomyces cerevisiae
MSDWKVDPDTRRRLLQLQKIGANKKCMDCGAPNPQWATPKFGAFICLECAGIHRGLGVHISFVRSITMDQFKPEELLRMEKGGNEPLTEWFKSHNIDLSLPQKVKYDNPVAEDYKEKLTCLCEDRVFEEREHLDFDASKLSATSQTAASATPGVAQSREGTPLENRRSATPANSSNGANFQKEKNEAYFAELGKKNQSRPDHLPPSQGGKYQGFGSTPAKPPQERSAGSSNTLSLENFQADPLGTLSRGWGLFSSAVTKSFEDVNETVIKPHVQQWQSGELSEETKRAAAQFGQKFQETSSYGFQAFSNFTKNFNGNAEDSSTAGNTTHTEYQKIDNNDKKNEQDEDKWDDF

SEQ ID NO: 29074 - protein, 630 aa, Arabidopsis thaliana
MDEDEFPLKRRLRSRRGRASSSSSSSSSYNNEDLKTQPEEEDEDDGVTELPPLKRYVRRNGERGLAMTVYNNASPSSSSRLSMEPEEVPPMVLLPAHPMETKVSEASALVILNDEPNIDHKPVISDTGNCSAPMLEMGKSNIHVQEWDWETKDILNDTTAMDVSPSSAIGESSEHKVAAASVELASSTSGEAKICLSFAPATGETTNLHLPSMEDLRRAMEEKCLKSYKIVHPEFSVLGFMKDMCSCYIDLAKNSTSQLLETETVCDMSKAGDESGAVGISMPLVVVPECEISGDGWKAISNMKDITAGEENVEIPWVNEINEKVPSRFRYMPHSFVFQDAPVIFSLSSFSDEQSCSTSCIEDCLASEMSCNCAIGVDNGFAYTLDGLLKEEFLEARISEARDQRKQVLRFCEECPLERAKKVEILEPCKGHLKRGAIKECWFKCGCTKRCGNRVVQRGMHNKLQVFFTPNGKGWGLRTLEKLPKGAFICEYIGEILTIPELYQRSFEDKPTLPVILDAHWGSEERLEGDKALCLDGMFYGNISRFLNHRCLDANLIEIPVQVETPDQHYYHLAFFTTRDIEAMEELAWDYGIDFNDNDSLMKPFDCLCGSRFCRNKKRSTKTMQILNKA

SEQ ID NO: 29075 - protein, 420 aa, Oryza sativa (japonica cultivar-group)
MARGIRMKPTYVPHVVSPAAQSPWIYVVVWYQNYENPFHNSPVVVFVIYVEFIVSPVRRYRSTPRCRGDCYHSSQSDSRRKKKKQQQQSSQPVRRARSNRGSKRRRREDSTVRLYRLMGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKKDSQLHSFARARWRNWIGIGWQEYLSPVLRSPDKGVVRYGRGDSRRETCLHVWRSLLSRAPSIPPGSKGRPLLRFCLPLQFYYCCPYRVRLASVYLKQSHINSAHHSLR

SEQ ID NO: 29076 - protein, 226 aa, Geobacter metallireducens GS-15
MLSAVIFDFDGIIVDTEPLHYRAFQAILEPLGLGYAWEEYVNLYMGFDDRDAFREAFRVHGRTLNDHELELLIDRKAAAFQEIISSGVAPYPGVVELIRSINGTFPLALCSGALRCDILPILAGLGLSNAFDVMVTAEEVTASKPDPASYALAVERLAAAFVDRGILPGRCIAIEDTPAGIASATGAGIPVIAVTNSYPAEMLSGAVRVVDSLAGLALADIENLAR

SEQ ID NO: 29077 - protein, 336 aa, Emericella nidulans
MAPKVGINGFGRIGRIVFRNAIEAGTVDVVAVNDPFIETHYAAYMLKYDSQHGQFKGTIETYDEGLIVNGKKIRFHTERDPANIPWGQDGAEYIVESTGVFTTQEKASAHLKGGAKKVVISAPSADAPMFVMGVNNETYKKDIQVLSNASCTTNCLAPLAKVINDNFGIIEGLMTTVHSYTATQKVVDGPSAKDWRGGRTAATNIIPSSTGAAKAVGKVIPSLNGKLTGMAMRVPTSNVSVVDLTVRTEKAVTYDQIKDAVKKASENELKGILGYTEDDIVSTDLNGDTRSSIFDAKAGIALNSNFIKLVSWYDNEWGYSRRVVDLITYISKVDAQ

SEQ ID NO: 29078 - protein, 1045 aa, Saccharomyces cerevisiae
MSLPLKTIVHLVKPFACTARFSARYPIHAIVVAVLLSAAAYLSVTQSYLNEWKLDSNQYSTYLSIKPDELFEKCTHYYRSPVSDTWKLLSSKEAADIYTPFHYYLSTISFQSKDNSTTLPSLDDVIYSVDHTRYLLSEEPKIPTELVSENGTKWRLRNNSNFILDLHNIYRNMVKQFSNKTSEFDQFDLFIILAAYLTLFYTLCCLFNDMRKIGSKFWLSFSALSNSACALYLSLYTTHSLLKKPASLLSLVIGLPFIVVIIGFKHKVRLAAFSLQKFHRISIDKKITVSNIIYEAMFQEGAYLIRDYLFYISSFIGCAIYARHLPGLVNFCILSTFMLVFDLLLSATFYSAILSMKLEINIIHRSTVIRQTLEEDGVVPTTADIIYKDETASEPHFLRSNVAIILGKASVIGLLLLINLYVFTDKLNATILNTVYFDSTIYSLPNFINYKDIGNLSNQVIISVLPKQYYTPLKKYHQIEDSVLLIIDSVSNAIRDQFISKLLFFAFAVSISINVYLLNAAKIHTGYMNFQPQSNKIDDLVVQQKSATIEFSETRSMPASSGLETPVTAKDIIISEEIQNNECVYALSSQDEPIRPLSNLVELMEKEQLKNMNNTEVSNLVVNGKLPLYSLEKKLEDTTRAVLVRRKALSTLAESPILVSEKLPFRNYDYDRVFGACCENVIGYMPIPVGVIGPLIIDGTSYHIPMATTEGCLVASAMRGCKAINAGGGATTVLTKDGMTRGPVVRFPTLIRSGACKIWLDSEEGQNSIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVKSVLKSDVSALVELNISKNLVGSAMAGSVGGFNAHAANLVTALFLALGQDPAQNVESSNCITLMKEVDGDLRISVSMPSIEVGTIGGGTVLEPQGAMLDLLGVRGPHPTEPGANARQLARIIACAVLAGELSLCSALAAGHLVQSHMTHNRKTNKANELPQPSNKGPPCKTSALL

SEQ ID NO: 29079 - protein, 330 aa, Zea mays
  misc_feature (90)..(90): Xaa can be any naturally occurring amino acid
  unsure (1)..(330): unsure at all Xaa locations
MESPISRTNLNCISLADPNVQKSVALLKQACLDSGFFYVVDHGISQEFMDEVFAQSKKFFDLPHSEKMKLLRDEKNRGYTPMLDEILDPXENQVNGDYKEGYYIGVEVPADDPEANRPFYGPNQWPSKEVLPKWREVMEQYHREALRVAKSVARIIALALDLDVDFFDRPEMLGESIATLRLLHYEGKVSDPAKGVYGAGAHSDYGLITLLATDDVVGLQICKDKNAQPQLWEYVAPLKGGFIVNLGDMLERWSNGVFRSTLHRVVLDGRERYSIAYFVEPSHDCVVECLPTCKSESNPPKFPPITCSAYLSQRYKDTHADLKSYDDSKA

SEQ ID NO: 29080 - protein, 470 aa, Geobacter metallireducens GS-15
MTPQEVVSFAKENGALMVDFKFMDFVGTWQHISVPITEFSEDTFEEGQGFDGSSIRGWQPIHASDMILLPDPDTAKMDPFVAVPTLSLICNVFDPITKEDYTRDPRNIARKAEAYLKSTGIGEIAFFGPEAEFFIFDEVRYDSSSNQSFYMVDSVEGAWNSGREEFPNLGYKPRHKEGYFPLSPTDSQNDLRNEMVMELQKVGIRVECQHHEVATGGQAEIDMRFSSLVDMADQLQWFKYVIKNVAYRNSKTVTFMPKPLYGDNGSGMHCHQSIWKNGQNLFAGDKYGGLSQMALWYIGGIIKHAKALCAITNPTTNSYKRLVPGFEAPVNMAYSSRNRSASIRIPMLSTNPKAKRIEYRTPDPSCNGYLAFAAMLMAGLDGIENKIDPGQPLDKDIYGLSPEELKDIPSAPGTLEDALNALRDDHEFLLKGDVFTPDVIEKWIEYKMEAEVNPVRMRPVPLEFALYYDI

SEQ ID NO: 29081 - protein, 378 aa, Alkaliphilus metalliredigenes QYMF
MSKRDYYEILGVSKDVDEQELKRAYRKQAMKYHPDRNPDDPEAESKFKEANEAYEILSSPEKKARYDQYGHAGVNGNGGGPQGFGGGGGFEDIFGDIFDMFGGGGGFSSGRRRSGPQRGSDIQYEMSITFEEAAFGAEKTVEFYKQDNCGTCHGSGAKPGTDAKSCSHCNGTGEVRYAQRTPLGQIVNVRPCEHCHGEGKIVEEPCTACSGKGKVKKHKKIKVKVPAGVDTGSAIPLRGEGEPGTKGGPYGDLYVVLRVLPHRLFVRDGYDVICEMPITFVQATLGDELEVPTLEGKVKYKIAEGTQSGTVFRLKNKGIVHPKGYGKGDQYVKVIIEVPKKLSDKQKEMLKQFAAASGEDIHEQRRSFFEKVKDAFSS

SEQ ID NO: 29082 - protein, 267 aa, Glycine max
MSHFGRSGPPDISDTYSLLVLNITFRTTADDLFPLFDKYGKVVDIFIPKDRRTGESRGFAFVRYKYADEAQKAVERLDGRMVDGREITVQFAKYGPNAERIHKGRIIETSPRSRRSRSRSPRKRHRDDYRDRDYRRRSRSRSYDRYERDRHRGRDKDYRRRSRSRSASLDYKGRGRGRYDDERNSRSRSRSVDSRSPARRSPSPRRSPSPQRSTSPQRSTSPRKSPRGESPANRSCEERSPTPRSVSPRGRPDASRSPSPRNSNGDE

SEQ ID NO: 29083 - protein, 302 aa, Gibberella zeae PH-1
MPYVSAARYGKDNVRVCKVDRDSSTGVQTVTEMTVCCLLEGEIETSYTQADNSVVVATDSIKNTIYITAKENPVNPPELYASILGSHFIEKYKHIHVANVSVKTVRWARLDVDGKPHPHSFFKDGEETRNVEVRVSRQEGIEIKSSLVGLTVLKSTGSAFHGFVRDEYTTLPETWDRIFSTDVDATWKWKKFDSVDAVKQFAPKFDTVREAARNITLKTFAEDASASVQATMYKMSDLILESVPEVATVTYSLPNKHYFEIDLSWHKGIKNTGKDAEVYAPQSGPNGLIKCEVSRDSLQSKL

SEQ ID NO: 29084 - protein, 333 aa, Pichia pastoris
MAITVGINGFGRIGRLVLRVALSRADIKVVAINDPFIAPEYAAYMFKYDSTHKAYKGEVSASGNKINIDGKEITVFQERDPVNIPWGKAGVDYVIESTGVFTTLEGAQKHIDAGAKKVVITAPSKDAPMFVVGVNEEKYTSDLNIVSNASCTTNCLAPLAKVVNDTFGIESGLMTTVHSMTATQKTVDGPSHKDWRGGRTASGNIIPSSTGAAKAVGKVIPELNGKLTGLAFRVPTVDVSVVDLTVNLKKETTYEEIKSVIKAASEGKLKGVLGYTEDAVVSSDFLGDERSSIFDASAGIQLTPSFVKLISWYDNEYGYSTRVVDLLQHVAKA

SEQ ID NO: 29085 - protein, 338 aa, Trichoderma atroviride
MSIKVGINGFGRIGRILLSNALEKPELSVVAVNDPFIEPTYAAYMLKYDSSHGLFKGDIEVDGQNLVVNGKPIRFYSERDPANIKWSETGAEYIVESTGVFTTIDKAKAHLNGGAKKVIISAPSADAPMFVMGVNHKDYDGTPTVLSNASCTTNGLAPLVKIVNDNFGIVEGLMTTVHSYTATQKTVDGPSGKDWRGGRGAAQNIIPSSTGAAKAVGKVIPAMNGKITGMSFRVPSANVSVIDLTVRLEKAASYEEITSAIKKAADGELKGIMAYTSDEVVSTDMLGNNNSSIFDIKAGISLNPNFVKLVSWYDNEWGYSRRVLDLLEHVAKVDASKK

SEQ ID NO: 29086 - protein, 334 aa, Clostridium pasteurianum
MTKVAINGFGRIGRLALRRILEVPGLEVVAINDLTDAKMLAHLFKYDSSQGRFNGEIEVKEGAFVVNGKEVKVFAEADPEKLPWGELGIDVVLECTGFFTKKEKAEAHVRAGAKKVVISAPAGNDLKTIVFNVNNEDLDGTETVISGASCTTNCLAPMAKVLNDKFGIEKGFMTTIHAYTNDQNTLDGPHRKGDFRRARAAAVSIIPNSTGAAKAIAQVIPELKGKLDGNAQRVPVPTGSVTELISVLKKNVTVEEINAAMKEAANESFGYTEDEIVSADVVGISYGSLFDATLTKIVDVDGSQLVKTVSWYDNEMSYTSQLVRTLEYFAKIAK

SEQ ID NO: 29087 - protein, 335 aa, Aspergillus fumigatus
MDVVLDVLDTFVFDKLYALLLPAKSFDLLDQDSVVDYNSHINRYVTLTPSQYAVESSLARDNILQQFLSLFITIWAFGLLLYLTTASLSFALVFDKRAMQHPKFLRHQIRLEIGQALRAMPVMAALTAPLFLAEVRGYSKLYGFPTGSPFPLYTYLQYPLFIAFTDFAIYWIHRGLHHPAIYKRLHKPHHRWIISTPYASYAFHPVDGWCQSLPYHVYPFLFPLQKAAYLGLFVFVTIWTVMIHDGEYALDSPVINGSACHTIHHYYFNYNYGQFTTFWDRIGGSYRRPNRELFDKQQRLQQTEIQRQVEEMERLVKEVEGSDDRCYEQDTKKTS

SEQ ID NO: 29088 - protein, 332 aa, Streptomyces aureofaciens
MTRIAINGFGRIGRNVLRALLERDSDLDVVAVNDLTEPATLARLLAYDTTSGRLGRPVTVEGNVLVVDGRRITVTAEREPANLPWAELGVDIVLEATGRFTSAKAARAHLDAGAKKVLVSAPADGADITLAFGVNTDAYDPDLHTIVSNASCTTNALAPLAKVLDDLAGIEHGFMTTVHAYTQEQNLQDGPHRDPRRARAAAVNIVPTTTGAAKAIGLVLPNLDGKLSGDSIRVPVPVGSIVELNTTVARDVTRDEVLDAYRAAAQGPLAGVLEYSEDPLVSSDITGNPASSIFDSELTRVDGRHIKVVAWYDNEWGFSNRVIDTLQLLAAR

SEQ ID NO: 29089 - protein, 271 aa, uncultured bacterium
NSRLCMSSAVAGYTRSLGSDGPPCSYEDLDHCTVAFLIGTNTAECHPVLFQRLLKRKKRHPGSVTIVVIDPRQTDTAKAADIHLAVAPGSDLALLHGIAHLVMRENGQDPTFIDDCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPEHRAEVEQTWGFPQGKIAPDPGLTAWQQVEAMERGELDLWWVA

SEQ ID NO: 29090 - protein, 271 aa, uncultured bacterium
NSRLCMSSAVAGYTRSLGSDGPPCCYDDLDHCSVAFMIGTNTAECHPVLFQRLLKRKKRNPGSLKIVVVDPRRTDTAKAADIHLPIAPGSDLALLHGIAHLILRENGQDPAFIDDHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVANDQHRQVVEQAWNLPAGSIAAKPGLAAWQQIEAMERGELDLWWVA

SEQ ID NO: 29091 - protein, 309 aa, Arabidopsis thaliana
MSSSAKKQTLFISTLIISWYSSNIGVLLLNKFLLSNYGFKFPIFLTMCHMSACAILSYISIVFLKLVPLQHLKSRSQFLKVATLSIVFCASVVGGNISLRYLPVSFNQAVGATTPFFTALFAYLMTFKREAWVTYGALVPVVAGVVIASGGEPGFHWFGFIMCISATAARAFKSVLQGILLSSEGEKLNSMNLMLYMSPIAVIALLPVTLFMEPDVISVTLTLAKQHQYMWILLLVNSVMAYSANLLNFLVTKHTSALTLQVLGNAKGAVAVVISILIFQNPVTVMGIGGYSITVLGVVAYGETKRRFR

SEQ ID NO: 29092 - protein, 271 aa, uncultured bacterium
NSRLCMSSAVAGYTRSLGSDGPPCCYDDLDHCSVAFLIGTNTAECHPVLFQRLLKRKKRNPGSVTIVVVDPRRTDTAKAADIHLPIAPGSDLALLHGIAHLVLRENGQDPAFIDDHTENYEAFFDVVARWTPRRVARFCNLPEKRLREVAQLFHRRENVLSLWSMGVNQRQEGTAVVCGLINLHLLTGQIGKEGAGPFSLTGQPNAMGGREAGGLSHLLPGYRLVANDQHRQDVEQAWKFPAGSIAATPGLAAWQQIEAMERCEIDLWWVA

SEQ ID NO: 29093 - protein, 393 aa, Rhodococcus sp. RHA1
MRAVTWQGKRKVSVDTVPDPVIEQKTDAIVEITTTNICGSDLHLYEVLGAFMSEGDILGHEPMGIVREVGSEVTDVKVGDRVVIPFQISCGNCHMCDRKLFTQCEITQNRDEGTGAALFGYSKLYGSVRGGQAEYLRVPHVKNTHITVPDGPPDSRFVYLSDVLPTAWQAVEYADIPDGGSVVVLGLGPIGDMAARIAAHNGFRVIGVDLVPERLARPQARHIETVDLTDAEGELGDVIREMTGGRGPDSVIDAVGMEAHGSPGAKLLQQVTSYLPDALAGPLMSTVGIDRLHALYSAIDIVRRGGTLSLIGVYGGMADPIPMLTLFDKQIQVRMGQANVKRWVPDILPLLTDADPLGVDTFATHELPLDHAPHAYEIFQKKEDGAVKILLKP

SEQ ID NO: 29094 - protein, 457 aa, Prochlorococcus marinus str. MIT 9301
MEEKQSFLKQKIDLESPNRNIIPITTSIDSDGKLSVGGCSIEELVKKYDSPLYILDEITLRNSCKAYKKALEKYYPGKSLPIYASKANSSIFMSSLVSSEGLGLDAVSEGELLTAIKGGVPNEKIVFHGNNKSDKELEFAVRNNIKVIVDNDYDLERLDEISNAFNHDLEIMIRFTPGIECHTHEYIRTGSFDSKFGFGIEYLNILFNRISNTKHLKLKGLHAHIGSQIFELDPHKDLGEIMVKVILEAKKFGHNVEELNVGGGLGIRYTESDDPPSIDEWVKTISSSVVEACKKNNLDFPTLMCEPGRSIVSTAGITIYKIGAFKEIPGIRTYLSVDGGMSDNPRPITYQSNYSACLVSNPFNINSKNKYTIAGKHCESGDVLFKEIELAECKTGDLICVFGTGAYNNSMSSNYNRIPRPATLLVKDGEAEIIQKRESPLDLLKYDVLPDRFIKQN

SEQ ID NO: 29095 - protein, 294 aa, Shewanella oneidensis MR-1
MINGSIVALITPMNSDGSVDFASLERLVEFHIDQGTDAIVAVGTTGESATLPMNEHVTVVAQTVKFAAGRIPVIGGNGANATAEAIELTKSLSKVGVAAMLGVTPYYNKPTPKGLVAHYKAVAASTDIPQILYNVPGRTAVDMKPETVAELVSVSNIIGVKEATGDVSRVKRLRELCGNDFMLYSGDDATASEFLLLGGNGVISVANNIVPKAFKAMCDAALAGNAELAASIDEPLRGLYSTLFCEANPIPVKWAAHRMGLIECGHIRLPLTELSEQCHGLLLEAMTRAQIEVK

SEQ ID NO: 29096 - protein, 979 aa, Sulfolobus solfataricus P2
MSLVSIKLVIDNKEVLANEGETILSTLKRNGIYIPHICYNEGLVPIESCDSCLVEVNGKLVRACSTRVEDGMSISVNSKRAMEARKTAISRILRYHKLYCSICENNNGDCVLHEAVIKLNINSQKYVEKPYQTDESGPFYIYDPSQCILCGRCVEACQDFAVNEVIWINWDLNPPRVVWDNGNPIGNSSCVNCGTCVTVCPVNALMEKSMLGEAGYLTWINKDLKKKAIEAIGKAEDNFSLLMTFSEIEAKARESQIKKTKTVCIYCGVGCSFEIWTKGRKILKIEPKPESPANGILTCVKGKFGWDFVNSSERITKPLIREGDKFREASWDEAISYIAKRLKEIKERYGPDSIGFIASDKMSNEEAYLLQKLARAIIGTNNVDNSARYCQSPATVGLWRTVGIGADSGTIRDIENANLIVIVGHNTTESHPVIGSKVKRAKKINGSKIVVIDVRKHEIAEKADLFIKPKPGTDAAVLAGVAKYLIDQGWIDKEFIDKRVNGFEEFKESIKGFTLDYVEDITGVPRDQIIKLAEMIHNANSVAVLWGMGVTQHLGGADTSTIISDLLLITGNYGKPGSGAFPMRGHNNVQGVSDFGCLPNYLPGYQKLEDENVIAKFEEAWGVKLNRNPGLQIPQMIEGVLEGKIHALYIVGEDTVMVDCGTPLTRQALEKVDFLVVQDMFITETAKLADVILPAAASLEKDGTFVNTERRIQRFYKAMEPIGDSKPDWEIIQMVANALGANWSYNHPAEIMNEIAKLGPIFAGVNYSRLEGFNSLLWPVNEDGSDTPLLYTNAFATKDGKAILYPLSWKPPELKDEVHKVTVNTGRVLEHFHVGNMTRRVEGLRRKVPETFVEVSKELASKYSIKNGDLVLVKSKFGGEIKARAIVSDRVEGEEIFIPLYASDPSKGVNNLTGLVIDKASGTPGYKDTPVVIEKIEEGKGESPLPLDNWRFHVNERRRQIGIEVEKKWKREEFKPLTG

SEQ ID NO: 29097 - protein, 575 aa, Gibberella zeae PH-1
MASSARAMTALSRVGHMAPSSRIAARALSTVSKTSARPSVAMRLNNTGRIAFRRAYADEAPKPRPGKIRRTLRWTWRITYLSFGALVGYTCYVIYDDRHPQEQFQPDPSKKTLVVLGSGWGSVGLLKNLDTENYNVIVVSPRNYFLFTPLLPSCTTGLIEHRSIMEPVRTILRHKKGAVKYYEAEASSVDPDRKIIKIKDNTEGKGPQSETEIPYDMLVIGVGAENATFGIPGVRENSCFLKEIGDAQLIRKKIMDCVERASFKGQSQEEIDRLMHMVVVGGGPTGVEFAGELRDFFEEDIKKLIPDISHRFKVTLIEALPNVLPSFSKQLIEYTENTMREENIDIKLKTMVKKVTEDFVEAEFAGPDGSKQTLRIPYGLLVWATGNAVRPIVRDLMGKVPAQKDSRRGLAVNEYLVVQGTRDIWAVGDCAVAGYAPTAQVASQEGSFLARLFNNMAKTDTQEERIKELSSSLNLKQGNSAEIAAEIESLEKQLRRIKDVKPFRYSHQGSLAYIGSEKAVADVPWFNGNIASGGGLTYLFWRSAYLSMCFSTRNRVLVAVDWLKSKAFGRDVSRE

SEQ ID NO: 29098 - protein, 149 aa, Zea mays
  misc_feature (69)..(69): Xaa can be any naturally occurring amino acid
  unsure (1)..(149): unsure at all Xaa locations
ASFPVSRKQSLDITSIASNGGRVSCMQVWPPINMKKYETLSYLPDLSDEQLLSEIEYLLKNGWVPCLEXFETEHGFVYRENHKSPGYYDGRYWTMWKLPMFGCTDATQVLAEGQEAKKAYPQAWVRIIGFDNVRQVQRIRFIGYKPEGY

SEQ ID NO: 29099 - protein, 300 aa, Aspergillus fumigatus
MDVALEFLDPLILDKAYAWLLPSEPNVPDPTSRWDRDNVYRQVISILVLTQLGATSLYLFFSALSYYFVFDRRLEYHPRFLPNQVRQEIKSSLSAIPFINILTLPWFLAEVRGKSMLYRSVSDYGWPWLVVSSILYMAFNDIGIYWIHRLEHHPSVYKYIHKPHHKWIVPTPWAALAFHPLDGYVQSLPYHVFVFICPMQRHLYMVLFAAVQIWTILIHDGDMISGHWTEKFINSPAHHTLHHMYFTVNYGQYFTWADAYFGSHRAPEPALDPLHDALKVMRAKGLVDEQGNPIKKPKGE

SEQ ID NO: 29100 - protein, 251 aa, Symbiobacterium thermophilum IAM 14863
MLEQIQDFARALQASRYAVALTGAGASTESGLPDFRSNTGLWKDVDPVSLISMTALRRRPVDFYRFYRMRFSHLWGAQPNPVHKVLAALQREGLLKRLITQNVDGLHQAAGSPDVIELHGSLRECQCLRCGRRFPSRLIDVEVETEADIPRCPECGGVLKPGVVLFEEALPADAIEAAIEAAMKADLFLVVGSSLEVGPANQLPVLAVQHGGRLAIFNLTPTFLDPRATWIFREKAGQALGALAAELGISL

SEQ ID NO: 29101 - protein, 592 aa, Arabidopsis thaliana
MFRRKSRSISPRRHRSRSVTPKRRSPTPKRYKRQKSRSSTPSPAKRSPAATLESAKNRNGEKLKREEEERKRRQREAELKLIEEETVKRVEEAIRKKVEESLQSEKIKMEILTLLEEGRKRLNEEVAAQLEEEKEASLIEAKEKEEREQQEKEERERIAEENLKRVEEAQRKEAMERQRKEEERYRELEELQRQKEEAMRRKKAEEEEERLKQMKLLGKNKSRPKLSFALSSKMTTMSDLDEIMVAEILCRTPMTCLKTVRSVCKKWNALSKKWFFFGKAKQFLGFMMMDSRVCSLRFDLRKDLVVEPPSIKQVSILDQIEVSKIFHSDGLLLCIIKNDTTRLLVWNPYLEQTRWIQPRHNFHILDCYAIGHDKNRKHKILRFVDDFLPVENVVFGGNTYFFAKERYIFEGKGPEEIDITETEDFLLCFDFTAERFGPRLPLPFHSYYAETVTLSCVKEDQLSVLCQRQPSEPSEILEIWVSTNIQPNAVSWSIFLKVDMRPLTGFQFNDMAGSFFIDQENKVAVVFDLDPSQICRYQTAYIIGQEYGGYFNSVNIGEVPNLWIPGSVGYADTTSCIPPVCSSYVPSLVQIG

SEQ ID NO: 29102 - protein, 355 aa, Ralstonia eutropha JMP134
MKIAVLPGDGIGPEIVAEAVKVLNALDEKFEMETAPVGGAGYEAEGHPLPENTLKLAKEADAILFGAVGDWKYDSLERALRPEQAILGLRKHLQLFANFRPAICYPELTGASSLKPELVAGLDILIVRELNGDIYFGQPRGVREAPDGLFKGAREGFDTMRYSEPEIRRIAHVAFQAAAKRGKKLCSVDKANVLETFQFWKDIVIDVSKEYPDVELSHMYVDNAAMQLVKAPKSFDVIVTGNMFGDILSDEAAMLTGSIGMLPSASLDANNKGLYEPSHGSAPDIAGKGVANPLATILSAAMMLRYSLNKAEQADRIENAVKKVLAQGYRTGDILTPGCKQVGTREMGEAVLAAL

SEQ ID NO: 29103 - protein, 567 aa, Magnaporthe grisea 70-15
MPGTSRIPQSLRDGLISVKRNRPTSVVQLLSIDLLRNIVFTLFVLRWTRRAFWKLRGRGLLGWLAELYAAMRVTAYGWLLRAPGVRNKVRSEVDTALSKLSKKTLPPPEAPRYLQIPKQGWTNEAVRAELESLANMDHTRWEDGYVSGAVYHGEDELISLQTDAYGKFTVANPIHPDVFPGVRKMEAEVVAMVLSLFNAPVGAAGVSTSGGTESILMAVLSARQKAYNERGVTEPEIILPETSHTAFRKAAEYYKIKVNFVACPAPDYQVDVSRVRRLINANTIMLVGSAPNFPHGIIDDISGLSKLAVRYKIPLHVDCCLGSFLVPFLERAGFETRPFDFRLKGVTSISVDTHKYGFAPKGNSTVLYRTAELRKYQYFVCPDWSGGVYASPGIAGSRPGALIAGCWASMMAVGEAGYLAACVEIVGAAKKLVDHINASPSLAAELEIIGKPLSSVVAFRARNLNIYDIADAMGEKGWHLNSLQNPPAMHVAFTLPTAKVWERLATDLEACVEGEREKERARIAEGKGAKGAAVGDSAALYGVAGSLPNKSVVVELANGFLDLLYKT

SEQ ID NO: 29104 - protein, 279 aa, Triticum aestivum
  misc_feature (166)..(166): Xaa can be any naturally occurring amino acid
  misc_feature (174)..(174): Xaa can be any naturally occurring amino acid
  misc_feature (255)..(255): Xaa can be any naturally occurring amino acid
  unsure (1)..(279): unsure at all Xaa locations
MATPTVEKPDGVEIREVWAENLEAEFAVIREIVDDYPYVAMDTEFPGVVCRPLGTFKSNADFNYATLKANVDMLKLIQLGLTFSDERGGLPALGPDGRPCVWQFNFRGFDPRTDVAAADSIDLLRRSGIDFARHAAEGADSRRFAELLMSSGVVLNAEDQGGTFHXGDDSGYLXKLHTGSNLPDTSSGFFDLIRIYFPVIYDIKHLMRFCNSLHGGLNKLAELLDVERVGICHQAGSDSLLTALSFNKLKESYFXGLTEKYAGVLYGLGTEGGETTSVH

SEQ ID NO: 29105 - protein, 317 aa, Escherichia coli
MSERHLPDDQSSTTDPYLITSVEQTLAEEGARLQNLSKQLDSGQYQRVLNLIMNCKGHVILSGMGKSGHVGRKMSATLASTGTPSFFIHPAEAFHGDLGMITPYDLLILISASGETDEILKLVPSLKNFGNRIIAITNNGNSTLAKNADAVLELHMANETCPNNLAPTTSTTLTMAIGDALAIAMIRQRKFMPNDFARYHPGGSLGRRLLTRVADVMQHDVPAVQLDASFKTVIQRITSGCQGMVMVEDAEGGLAGIITDGDLRRFMEKEDSLTSATAAQMMTREPLTLPEDTMIIEAEEKMQKDKCLNVIGDQQGK

SEQ ID NO: 29106 - protein, 357 aa, Enterococcus faecalis V583
MQKESIYGLTREQLVDWFLAHGEKKFRATQVWEWLYTKRVASFSEMSNISKSLMTLLEENFSLNPLKQVIVQEAQDGTVKYLFELPDKNMIETVLMRQEYGLSVCVTTQVGCNIGCTFCASGLLKKQRDLTAGEIVAQIMWVQHYFDERGLDERVSHVVVMGIGEPFDNYANVMNFLRTINDDKGLAIGARHITVSTSGLVPKIREFADSGLQVNLAISLHAPNNEVRTSIMRINRSFPIEKLMAAIDEYIEKTNRRVTFEYIMLSQVNDRPEHAQQLADLLRNKKKLSYVNLIPYNPVSEHDQYSRSSKEAVLKFYDVLKKNGINCVIRKEHGTDIDAACGQLRSKQMKKEKVKNQ

SEQ ID NO: 29107 - protein, 421 aa, Streptomyces tubercidicus
MVDAHQTFVIVGGGLAGAKAAETLRAEGFTGRVILICDERDHPYERPPLSKGFLLGKEERDSVFVHEPAWYAQAQIELHLGQPAVRLDPEAKTVRLGDGTLIAYDKLLLATGAEPRRLDIPGTGLAGVHHLRRLAHAERLRGVLASLGRDNGHLVIAGAGWIGLEVAAAARSYGAEVTVVEAAPTPLHGILGPELGGLFTELHRAHGVRFHFGARFTEIVGQDGMVLAVRTDDGEEHPAHDVLAAIGAAPRTALAEQAGLDLADPEAGGGVAVDATLRTSDPYIYAAGDVAAADHPLLDTRLRVEHWANALNGGPAAARAMLGQDISYDRVPYFFSDQYDVGMEYSGYAPPGSYAQVVCRGDVAKREFIAFWLGEDGRLLAGMNVNVWDVAETIQQLIRGGVRLEPGELADPEVPLTSLLP

SEQ ID NO: 29108 - protein, 271 aa, uncultured bacterium
NSRLCMSSAVAGYTRSLGSDGPPCCYEDLDHCSVAFLIGTNTAECHPVLFQRLLKRKKRDPKGLTIVVVDPRCTDTAKIADHHLAIAPGTDLALLHGLARLVIEDNGFDSDFIDAATEGFSDYTKTIHAWSAQETAKLCGITEQELRDVGRLWSRKAGILSLWSMGVNQRREGTAVVSGLINLHLLTGEIGKPGAGPFSLTGQPNAMGGREAGGLAHLLPGYRLVANPEHRSEVEQAWGLASGSIAAEPGLSAWQQVEAMERGELDLWWVA

SEQ ID NO: 29109 - protein, 271 aa, uncultured bacterium
NSRLCMSSAVAGYTQSLGSDGPPCCYDDLDHCSVAFLIGTNTAECHPVLFQRLLKRKKRNPGSVTIVVVDPRRTDTAKAADIHLSIAPGSDLALLHGIAHLILRENGQDPAFIDDHTENYEAFFDVVARWTPRRVARFCNLPEKRLREVAQLFHRREDVLSLWSMGVNQRQEGTAVACGLINLHLLTGQIGKEGAGPFSLTGQPNAMGGREAGGLSHLLPGYRFVANGQHRQDVEQAWDFPAGSIAATPGLAAWQQIEAMERGELDLWWVA

SEQ ID NO: 29110 - protein, 219 aa, uncultured bacterium
NSRLCMSSAVSGYTQSFGSDGPPCCYDDLDHCKVAFLIGTNTAECHPVLFQRLLKRKKRNPGSLKIVVVDPRRTDTAKAADIHLPIAPGSDLALLHGIAHLILRENGQDPAFIDDHTENYEAFFDVVARWTPRRVARFCNLPEKRLREVAQLFHRRENVLSLWSMGVNQRQEGTAVVCGLINLHLLTGQIGKEGAGPFSLTGQPNAMGGREAGGLSHLL

SEQ ID NO: 29111 - protein, 563 aa, Photobacterium profundum SS9
MTEQKLSDNERLKRESNFLRGTIADDLQDRITGGFTADNFQLIRFHGMYQQDDRDIRAERAKQKLEPLHNVMLRARMPGGIITPTQWLAIDKFAEESSLYGSIRLTTRQTFQFHGVLKPNIKLMHQTLNSIGIDSIATAGDVNRNVLCTTNPIESELHQEAYEWAKKISEHLLPKTRAYAEIWLDGEKVEGGDEEPILGSNYLPRKFKTTVVIPPQNDVDVHANDLNFIAIADNGKLVGFNVLVGGGLAMTHGDKTTYPRRADDFGFIPLVNTLEVAAAVVTTQRDWGNRSNRKNAKTKYTLDRVGVDVFKAEVEKRAGITFEASRPYEFTDRGDRIGWVEGIDGKHHLALFIENGRLLDTPGKPLKTGVAEIAKIHKGDFRMTANQNLIVAGVPAADKNKIEKIARDHGLIDDGVSEQRKNSMACVAFPTCPLAMAEAERFLPDFVTDVEGVLAKHGLAEDDNIILRVTGCANGCGRAMLAEIGLVGKAPGRYNVHLGGNRNGTRVPKMYRENITVPQIMDEIDQLVGRWANEREDGEDFGDFTVRTGIIEPVLVSKRDFYA

SEQ ID NO: 29112 - protein, 219 aa, uncultured bacterium
NSRLCMSSAVAGYTRSLGSDGPPSCYEDLDHCSVAFLIGTNTAECHPVLFQRLLKRKKRNPGSITIVVVDPRKTDTAKAADIHLPIAPGSDLALLHGIAHLVLRENGQDPAFIDDHTENYDAFFDIAARWTPRRVALFCNIPEKRLRDVAQLFHRRERVLSLWSMGVNQRREGTAVVQGIINLHLLTGQIGKEGTGPFSLTGQPNAMGGREAGGLSHLL

SEQ ID NO: 29113 - protein, 515 aa, Rhodococcus sp. RHA1
MTATTTQHAAAPDGGGDERHLRVVVVGAGLSGIAAAVKLERAGITDFVVLEKSDRVGGVWRENTYPGCGVDIPAPVYSFSFHPNPRWRSNFALQPELLSYIEDTVDTFGLQSRISMQTDVREAAWSDERRRWILDTSRGTIVAQHVIFAAGPITEPSTPAVPGIDRFDGDVFHSARWNHDVDLTGKRVAVVGTGASAVQFIPEIQPDVEELYVFQRTPAWVVPRLDFPFPRIAQWAFARVPAVQRALRRLLDVILRTLTWVMRCERTARLLNPIGTRWLARQVPDPALRAALTPNFTLGCKRLLLSNTYLPALTKSNVELIPHALAEVDGRVVVGADGTRREVDVIIFGTGFDVSHPPIASRIRGRDGTLLSEKWSKSPEAYLATTTPGAPNAYIMLGPNILVYNSFLGLAETQLDYVIDGLTTAERQGIEVLEVRDQPFRRFNDAVQKGLEPTVFNNGGCSSYYLDADGRNFAAWPWSTGSLRRRLARFDLENYAIRPYRTEQSPALHPSGKSR

SEQ ID NO: 29114 - protein, 272 aa, Pyrus x bretschneideri
QNWGFFELVNHGISTELLDTVEKMTKDHYKKTMEQRFKEMVAAKGLDAVQSEIHDLDWESTFFLRHLPSSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGEWVDVPPMHHSIVINLGDQIEVITNGKYKSVMHRVIAQSDGTRMSISSFYNPGDDAFISPAPAVLEKKTEDAPTYPKFVFDDYMKLYSGLKFQAKEPSF

SEQ ID NO: 29115 - protein, 256 aa, Pyrus x bretschneideri
VSHGIPTEFLDTVERLTKEHYKQCLEQRFKELVASKGLEGVQTEVKDMDWESTFHLRHLPQSNISEVPDLKDEYRNVMKEFALKLEKLAEQLLDLLCENLGLEQGYLKKAFYGTKGPTFGTKVSNYPPCPNPDLIKGLRAHTDAGGLILLFQDDKVSGLQLLKDGEWVDVPPMRHSIVINLGDQLEVITNGKYKSVEHRVIAQTDGTRMSIASFYNPGSDAVIYPAPTLVEKEAEEKNQVYPKFVFEDYMKLYAGV

SEQ ID NO: 29116 - protein, 550 aa, Photobacterium profundum SS9
MLKNINPTHTQAWKDLTAHYEDAQDLQLSDLFANDSERFNKFSATFGSDILLDYSKNLITEETLTKLFALAEQTELKAAIAEMFSGEKINKTEDRAVLHSALRNRSNTPVVVDGEDVMPKVNAVLEKMKAFTARIVDGDWKGYTGQEITDVVNVGIGGSDLGPYMVSEALVPYKTRLNMHFVSNVDGTHIAETLKDLNPETTLFLIASKTFTTQETMTNAHSARDWFLATAQDQAHVAKHFAALSTNVGSVSEFGIDTDNMFEFWDWVGGRYSLCSAIGLSICLSIGFDNFVELLDGAHEMDQHFAQAPLEENLPVILALIGIWYNNFHGAESEAILPYDQYLHRFAAYFQQGNMESNGKCVDRGGNPVDYQTGPIIWGEPGTNGQHAFYQLIHQGTKLIPCDFIAPSISHNPLTDHHPKLMANFFAQTEALAFGKTKEQVEAEFVAAGKTLDEVKDLVPFKVFDGNRPTNSILIKQVTPKVLGSLMALYEQKIFTQGVIWNIFSFDQWGVELGKQLANQILPELNDADSIAGHDSSTNGLINAYKQWRK

SEQ ID NO: 29117 - protein, 327 aa, Burkholderia thailandensis E264
MFRRLPLTMPLNPKIAQVLDMIERAKRPDYHEQTPAQARAAYEKSAPILDVAPAPMFSIEELRVPSRDGGAFGARLYLPVEPSLAEPLPALVYYHGGGFTVGSVNTHDALCRMFARDAHCAVLSVDYRLAPEHKFPTAVDDAEDALVWLHAHASRFGIDQARLAVGGDSAGGTLATVCAVLARERGIALALQLLVYPGTTGHQQTASHARLAKGYLLSADTIQWFFDHYVRDASDRDDWRFAPLDGTRGAPSFERVAPAWIATAEYDPLSDEGDAYADKLRAAGNRVTLVAYAGMIHEFFKMGGFVPEVRLAHADAAGALRAAFDGA

SEQ ID NO: 29118 - protein, 239 aa, Pyrus x bretschneideri
MGRGRVELKRIENKINRQVTFAKRRNGLLKKAYELSVLCDAEVALIIFSNRGKLYEFCSSSSMLKTLERYQKCNYGAPETNVSTREALELSSQQEYLKLKARFEALQRNQRNLLGEDLGPLSSKDLESLERQLDMSLKQIRSTRTQCMLDQLTDLQRKEHMLNEANKTLKERLFEGYHALQLNANADEYGRQQAQAAQGDVFFHPLDCEPTLQIGYQNDPISVVTAGPSLSNYMGGWLP

SEQ ID NO: 29119 - protein, 462 aa, Marinobacter sp. ELB17
MTGDFVSDSADYDLIVIGAGSGGVRLARMSAQRGARVAVVESRYLGGTCVNVGCVPKKLFVYGAHVHDELEDAAGYGWQVPLADVKFNWPTLLANKNTEIERLKGIYGRLLENAGVTIINGSARLSGPNTVIVGDKSYSAKHITVATGSWPVVPDIPGKEHLLTSNEMFFLPELPQHAVVWGGGYIAVEFAGILAGLGVKTTLLYRGDLFLRGFDDDIRTFTAQEMMKKGVDLQFNVTIESVTGASGDYSVLLNNGETLKTGLVLAATGRRALVDSLGLAELGVALNDSGHVVVNDYFQTEVPSITALGDVIGTPQLTPVALAQAMVLSRRLFGDGEGEMDYAAIPTAVFCQPNIGTVGLTEQEARLAGHSLRVYRSEFRPMKYILSGRDERCMMKLVVDKRTDKVLGAHMVGPDSGEITQGLAVAIKAGATKAQFDATMGIHPTSAEEFVTMREPVQVDPD

SEQ ID NO: 29120 - protein, 240 aa, Symbiobacterium thermophilum IAM 14863
MGVTNFFGEAWRTGKSIVTGLGITFREMMFRPAITVFYPEQRDDVPPWFRGIPVLKTDLRTGEYKCTSCMQCAQACPVNVITIEWHQDPETKKKVCDRFAIDMSRCMLCNFCVEACPFDSLVMGYDYELCKVNPENLVFEFEDLLRLGLKYSKAEEPGPKATRSSTPPWVFHGLTNATEDDIQDIHGYLGRPPLPKGYEPELKPQFRKPAEEAAEAQQAEAAGQPAAEPGKTNGEEAGQP

SEQ ID NO: 29121 - protein, 695 aa, Sinorhizobium meliloti
MNVSQQIEPRAAAWERNMADAIRFLSMDAVEKANSGHPGMPMGMADAVTVLFNRFIRIDPSLPDWPDRDRFVLSAGHGSMLLYSLHHLIGFADMPMAELSSFRQLGSKTAGHPEYGHALGIETTTGPLGQGMSTAVGMAMAEQMMASRFGSVLCNHFTYVVAGDGCLQEGISHEVMDLAGHLKLRKLFVLWDDNRISIDGSTDLSTWMNQFARFRAASWDAQAVDGHDPEAVAKALERARRTRKPSLIACRTRIGKGAASMEGSHKTHGAALGDKEIAATREKLGWPHPPFFVPPEIRAAWAKVAARGRTAREAWDIRLDASRSKKRYEQTIRRQFDGELGDLLAKFRSAHRTRATKVATRQASQMALEVINGATALTIGGWADRTGSNLTMTSQTQPISPGNFKGRYLHYGIRQHGMAAAMNGIALHGGFIPYGGTFLVFSDYARGAMRLSALMGLPVIYVKKKDSIGLGEDGPTHQPVEHLAMLRATPNLNVFRPADIIETAECWEIALGEKNTPSVLALSRQALPMLRRTEGNENQSALGAYVLREARGNRDITILATGSEVEIAVAAAERLQAEEGIAAAVVSMPCWEKFEVQDLAYRRKVLGDAPRIAIEAAGRLGWDRWMGPDGAFVGMTGFGASAPAGDLYRHFGITADHVVAEALELLRRAYSETLPIGARIGPHPSAHTVRSSQEA

SEQ ID NO: 29122 - protein, 384 aa, Symbiobacterium thermophilum IAM 14863
MNVERTQELLVNMGPQHPSTHGVLRLMIKLDGEQVTWCEPDIGYLHRCFEKLAEQKTYPQVIPFTDRTDYLAAMLNELCYVEAVEKLFGDAIQVPERAQYIRVMLAELQRITSHLLALGSMAMDLGATTPFLYCWRDREKLYSLFERITGGRMLYNYLRIGGVRNDLPEGILGTPQDGEDKADKTIWGFINYFDSYVYPEWKALVTGNRIFQYRTKNIGVLTAEQAIAYSCSGAVLRGSGVKWDLRKNLPYAIYDRFEFDIPVGQNGDSFDRWWVRQEEMYQSSRIVKQCLEWLAENPGPVMAPKMPRVLKPPKGEVYHRIEGARGEVACYVVSDGSTNPYKVKWRSPAFTHLQLMPLLCPGHKIADIIAILGSIDVVLGEVDR

SEQ ID NO: 29123 - protein, 672 aa, Rhodobacter capsulatus
MDLAALRAKTPDHWKLATAIRVLAIDAVQAANSGHPGMPMGMADVATVLFRNHLKFDAKAPNWADRDRFVLSAGHGSMLLYALLHLTGYEQATLDEVKNFRQWGARMAGHPEYGHLEGVETTTGPLGQGISTAVGMAIAEKSMAARFGKKLVDHKIWVIAGDGCLMEGISQEAIGLAGKQELDNLIVLWDNNNITIDGRVTVSDVTDQKARFAASGWDVLSCDGHDAEDIDRALTAAKKAKRPVLVDCKTLIGFGSPNKADSYAVHGAPLGDAEIKLTREAYGWEHGPFVIPAEIKAEWEAIGAKGAAERAEWEARLAALPAGKRAEFERQMARGVAPKLAGAIRAFKKAQSEAAPKVATRKASEMVLAAVNPVVPETIGGSADLTGSNLTKTSDIEDFMPGNHKGRYMRYGIREHAMAAAMNGMWLHGGVRPYGGTFFCFTDYARGAMRLSSLMGVPTVYVMTHDSIGLGEDGPTHQPVEHLAICRATPNTWTFRPADVIETAEAWELALSSERTPSVLALSRQNLPTLRTKHEAKNLTAKGAYVIAEAEGKRQAILMATGSEVEIALKARALLQAEAIGTRVVSMPCMELFAAQDEAYRKRILPAGGVRVAVEAAIRQPWDRWLLGERGMERKAGFVGMEGFGASAPAERLYAEFGITPEAIAAKVKSLL

SEQ ID NO: 29124 - protein, 156 aa, Symbiobacterium thermophilum IAM 14863
MDFLKERFPDAQFETHINGDTEILVPADRYEEVVRACYEAGFTFCSVVTAIDWQDRLTLVTSLARINPDEVGVRNIHIKVDLPRQGAHIPSIANLYPGANWHERETYDMYGIRFDGHPNHRRILLPDNWQGGHPLLKDFADRRPKRPRLVRHRFAE

SEQ ID NO: 29125 - protein, 403 aa, Enterococcus faecalis V583
MNKKHVVILGAGYAGLKTLRELQKGAKDVEITLVDRNNYHYEATDLHEVAAGTQPAEKITYNIMDVVDEKMTTFIQGTVKTIDAATQTVALEDGQTINYDYLVVSLGFESESFGIPGVQEHALQMVDVKTALNVYEHIQEQMRQYKATQNEEFLKIVVCGAGFTGIELLGSLVENKPKFAEIAGVSADQIQIYCVEAVTRLLPMFNEKLANYGVQLLKDSAIHLLLGKPIKEIKPGAVVYQDNEAGDLAELSAKTIIWTTGVSGSHVVGDSGFEARRGRVMVQPDLTDANHSNVYIIGDCSAVMDTETNRPYPTTAQIALKMGAHAAKNIQAQLKGEATKPFSFKSQGSVCSVGNTRALGIVGKTDIKGYPASFMKKIIMNKALFETGGTKEMMAKGRFDLYH

SEQ ID NO: 29126 - protein, 383 aa, Cryptococcus neoformans var. grubii
MSTEGQVITCKAAIAWEAGKPLSIETVEVAPPKDGEVRIKILYTGLCHTDAYTLSGNDPEGAFPVILGHEGGGIVESVGKGVDEVKVGDHVVPLYTAECRECKFCKSGKTNLCGRVRATQGKGVMPDGTSRFKCKGQDILHFMGCSTFSQYTVVSKFSVVAINPKAPLKTSCLLGCGITTGYGSATKSPGIEGSNVAIFGVGCVGLSVLQGAKAKGCKRIFAIDTNPKKKEWAEKFGATDFVNPKDLPEGKTIVDYLIEETDGGLDFTFDATGNVGVMRNALEACHKGWGVCNIIGVAPAGAEISTRPFQLVTGRVWKGTAFGGVKGRTELPGIVEDYLAGKLWVNEFVTHNETLEGINKGFDDMHAGDCIRCVVDMGFNEAP

SEQ ID NO: 29127 - protein, 347 aa, Triticum aestivum
MAAAAAEVSNKRVVLKRHVTGFPTEDDMELVPATARLAVPPGSAAVVLKNLYLSCDPYMRSRMSRHDEPSYVPDFVQGEVLTALGVSKVVESGHQDYKPGDLVWGMTGCEEYTLITNLESHFKINHPELPLSYYTGVLGMPGFTAYAGFFEVAKPKKGDYVFVSAASGAVGQLVGQLAKITGCYVVGSAGSDEKVNLLKTKFGFDDAFNYKKEQDLTATLKRYFPEGIDIYFENVGGAMLDAVLLNMRLHGRVAVCGMISQYNLEQPEGVRNLFCIVAKRIRMEGFMVTEYYGNYRKFEEEMAGYLKEGKITYVEDVAEGIESYPTALIGLFYGRNTGKQLVAVARD

SEQ ID NO: 29128 - protein, 326 aa, Enterococcus faecalis V583
MNTFWKSFPDVERSLTETCELIEQTLHTRNEDIEEALVTLARSGGKLLRPAFFFLFAQLGDEEKQEKQQLLKIAASLEILHMATLIHDDIIDDSPLRRGAVTIQSQYGKDVAVYTGDLLFTEFFTLIADAMNGSEFMKINAQGMKRLLLGELDQMSHRFDRRMSIPAYLRSVNGKTAELFSLSCLEGAYFGHSSKEVQRLAKRIGRHIGIAFQVYDDILDYTADTETLKKPALEDLSQGVYTLPLLFAYQAAPDVFSPYLDKGRAITLEEAAEVAALVNDYHGVTEAQAFAKKVTNKAITDIQQLPDGTAKETLLSLTELLLHRSF

SEQ ID NO: 29129 - protein, 610 aa, Rhizobium etli
MNIVAPQLTPVVTTGSLPASTKIVKPGTLYPDLRVPMREISLHPTSGEPPVTVYDSSGPYTDPAHVISIDAGLPRLRESWIKARGDVESYDGRIVKPEDNGFATGERLTPEFPVRNTPLKAKAGRAVTQLAYARAGIVTPEMEFIAIRENLGRQAAKEALARDGESFGAHVPDFVTPEFVRREVAEGRAIIPANINHPESEPMIIGRNFLVKINANIGNSAVTSSMAEEVEKMVWAIRWGADTVMDLSTGRNIHNIREWIIRNSPVPIGTVPLYQALEKVNGIAEDLTWEVYRDTLIEQAEQGVDYFTIHAGVRLAYIPLTVNRVTGIVSRGGSIMPTWCLHHHKESFLYEHFEEICDICRAYDVSFSLGDGLRPGSIADANDAAQFAELETLGELTKIAWAKDCQVMIEGPGHVPMHKIKENMDKQLEVCGEGPFYTLGPLTTDIAPGYDHITSGIGAAMIGWFGTAMLCYVTPKEHLGLPDRSDVKTGVITYKIAAHAADLAKGHPAARIRDDALSRARFEFRWEDQFNLSLDPDTARSFHDETLPKEAHKVAHFCSMCGPKFCSMRISHDIRAEAQKEGLEAMAAKYRDGGDLYMPVAEVAKTPAGE

SEQ ID NO: 29130 - protein, 219 aa, uncultured bacterium
NSRLCMSSAVAGYTRSLGSDGPPCSYEDLDHCSVAFLIGTNMAECHPVLFQRLLKRKRKNPGSVNIIVVDPRRTDTAKAADIHLPIAPGSDLALLHGIAHLVLRENGQDPAFIDDHTENYDAFFDVAARWTPRRVARFCNIPEKRLREVAALFHRREKVLSLWSMGVNQRREGTAVVQGLINLHLLTGQIGKQGAGPFSLTGQPNAMGGREAGGLAHLL

SEQ ID NO: 29131 - protein, 241 aa, Zea mays
MDFIGSLLPRFRYIAIDAEYPGTVHGAPAGAGLSPAARYYAVVKANVEELPVLQLGLTICDEEGNLPVVMDVDGLPLQIAWEFHFSDFDVARDPHSVESVNFLRAQGFDFVRARAHGVASADFAGKLAALLASVPRWCQPPAWVAFGGAFDFAFMVKMLSGGQPLPENPQDMYMAEHCGRPELCVGGLRTVAAILGVPQLDPAPPSLAGPKSHTACRIYYNVMRMLEHDGAGYDGLIDGLY

SEQ ID NO: 29132 - protein, 379 aa, Treponema denticola
MPASKRDYYEVLGVDKKASNDDIKKAYRKLAIKYHPDKNQGDKAAEEKFKEATEAYEILIDEKKRSMYDQFGHAGVDGMSGGGGYDPSAFQGFEDIFGGSFSDIFENLFGGGFSSRSSGFGGRHAGPVRGSNLRYDLQISFVDAVYGKKAELSYTRNEKCSECHGTGSESGSSKRMCPDCKGTGQVRQSTGFFSISRPCPTCGGEGSIIEKPCKKCGGNGLERKKQRIIVTIPAGVENGKRITIPSQGNAGQAGGDYGDLFVFIFVQAHPYFERNGIDLYCAVPISMTQAALGGEINIKSLDEKTLRLKIPAGTQNGKLLRIRGEGVPTGIGRKGDLYIQIQVQIPSKLSSNSKKLLQEISAIEGENENPNLIPLKDLP

SEQ ID NO: 29133 - protein, 219 aa, uncultured bacterium
NSRLCMSSAVAGYTRSLGSDGPPCSYEDLDHCSVAFLIGTNMAECHPVLFQRLLKRKRKNPGSVNIIVVDPRRTDTAKAADIHLPIAPGSDLALLHGIAHLVLRENGQDPAFIDDHTENYDAFFDVAARWTPRRAARFCNIPEKRLREVAALFHRREKVLSLWSMGVNQRREGTAVVQGLINLHLLTGQIGKQGAGPFSLTGQPNAMGGREAGGLAHLL

SEQ ID NO: 29134 - protein, 171 aa, Prochlorococcus marinus str. MIT 9301
MKFLKLIPILFIFFGNIPYKNEVHAEIKNPKDFRVFSNESKKLSISNVEYFIKEGDKYIKNGDFEKAKDSYLDARKLAKQLASFYSDLNSSFKGIDARIPNEMQRKGKETLQILAETNERLASMYIKTEKPEVAVPLLVETIRIMSPNTPEGKEAYERLIQLGFVETKYKG

SEQ ID NO: 29135 - protein, 219 aa, uncultured bacterium
NSRLCMSSAVAGYTRSLGSDGPPCSYEDLDHCSVAFLIGTNMAECHPVLFQRLLKRKRKNPGSVNIIVVDPRRTDTAKAADIHLPIAPGSDLALLHGIAHLVLRENGQDPAFIDDHTENYDAFFDVAARWTPRRVARFCNIPEKRLREVAALFHRREKVLSLWSMGVNQRREGTAVVQGLINLHLPTGQIGKQGAGPFSLTGQPNAMGGREAGGLAHLL

SEQ ID NO: 29136 - protein, 957 aa, Ralstonia metallidurans CH34
MNARDDFDYGTPASDAETQVTLEIDGVSVTVPAGTSVMRAAAEAGVGVPKLCATDSLKAFGSCRLCLVEIEGRRGYPASCTTPVEAGMKVRTQSEKLGDLRRGVMELYISDHPLDCLTCPTNGNCELQDMAGVVGLREVRYNDGAGTAPPIATHTHLAKDESNPYFTYDPSKCIVCNRCVRACEETQGTFALTISGRGFDSRVAAGTSQPFMESDCVSCGACVQACPTATLTETSVIQLGQASHSKITTCAYCGVGCSFKAEMKGNEVVRMVPYKDGAANEGHACVKGRFAWGYATHKDRILKPMIRARITDPWREVSWEEAIGYAASQFRRIQAEHGKDSIGGIVSSRCTNEEGYLVQKLVRAAFGNNNVDTCARVCHSPTGYGLKTTIGESAGTQTFRSVAKADVIMVIGANPTDGHPVFASRMKRRLRAGARLIVVDPRRIDLVESPHIRADYHLQLRPGTNVAVVTSIAHVIVTEGLLAEQFIAERCEDRAFQQWRDFVALPENSPEALEAETGVPAEQLRGAARLYATGGNAAIYYGLGVTEHAQGSTTVMAIANLAMATGNIGREGVGVNPLRGQNNVQGSCDIGSFPHELPGYRHVSDSTVRGSFEAAWNVEINPEPGLRIPNMFEAAITGSFRGLYCQGEDIVQSDPNTQHVAEALSSMECIVVQDIFLNETAKYAHVFLPGSSFLEKDGTFTNAERRISRVRKVMPPKAGYSDWEATILLSNALGYPMHYNHPSEIMDEIARLTPTFAGVSYKKLEELGSIQWPCNAEAPEGTPTMHVDTFVRGKGKFIITKYVPTSEKVNRKYPLILTTGRILSQYNVGAQTRRTHNVHWHDEDRLEIHPHDAEERGIKDGDWVGIQSRAGETVLRAIVSERMQPGVVYTTFHFPESGANVITTDNSDWATNCPEYKVTAVQVMPVAQPSTWQRNYHAFNEEQLAHLRAAGEPTPTR

SEQ ID NO: 29137 - protein, 142 aa, Vibrio cholerae O1 biovar eltor str. N16961
MALERTFSIIKPDAVKRNLIGEIYHRIEKAGLQIIAAKMVHLSEEQASGFYAEHEGKPFFEPLKEFMTSGPIMVQVLEGENAIARYRELMGKTNPEEAACGTLRADYALSMRYNSVHGSDSPASAAREIEFFFPESEICPRP

SEQ ID NO: 29138 - protein, 373 aa, Vibrio cholerae O1 biovar eltor str. N16961
MTTEKINLLDFDRKGLRTFFAEELGEKAFRAEQVMKWIYHFGCDDFDQMNNINKQLREKLKAKCEIRAPYVSEAQHSADGTIKWAMRVGDQDVETVYIPEDDRATLCVSSQVGCALECKFCSTAQQGFNRNLRVSEIIGQVWRAAREIGLEKETGRRPITNVVMMGMGEPLLNMKNLIPALEIMLDDLGFGLSKRRVTVSTSGVVSGLEQMIGQIDVALAISLHAPNDKLRSEIMPINDRWNIEAFLEVVRRYIASSNANRGKVTVEYVLLDHVNDGTEHAHELAELLKGTPCKINLIPFNPYPGSPYKKPSNSRIDRFQKTLMQYEHTVTIRKTRGDDIDAACGQLVGDVIDRTKRTKAKQFDGQAIPVKTL

SEQ ID NO: 29139 - protein, 633 aa, Musa acuminata
MEGCDCIEPQWPADELLVKYQYISDFFIALAYFSIPLELIYFVKKSSFFPYRWVLIQFGAFIVLCGATHMINLWTFTMHSRTAALVMTVAKISTAVVSCATALMLVHIIPDLLSVKTRELFLKNKAEELDREMGIIRTQEETGRHVRMLTHDIRSTLDRHTILKTTLVELGRTLDLAECALWMPSRSGLNLQLSHTLHHQMPLGSVVSINLPVVNQVFSSNRAVRIPHTCPLARIRPQTGRYVPPEVVAVRVPLLHLSNFQINDWPELSAKSYAIMVLMLPSDSARKWHIHELELVEVVADQVAVALSHAAILEESMRARDLLMEQNVALDSARREAEMAIRARNDFLAVMNHEMRTPMHAVIALSSLLLETELTPEQRLMIETVLKSSNLLAALINDVLDLSKLEDGSFELEIANFNLHAVFREVINLIKPIAAVKKLSVSVTLAPDLPLCAVGDEKRLMQTILNVAGNAVKFTKEGHISITASVARSDSSRDPRAPEFSPVTSDRHFDLRVQIKDSGCGISPQDLPHIFTKFAHSRNSANKASNGSGLGLAICRRFVNLMEGQMWLESEGIGKGCTATFIVKLGICDPSGNLQQILQTTPSHGDANLPGPRAKFDDENGKFTPMMRYQRSV

SEQ ID NO: 29140 - protein, 670 aa, Debaryomyces hansenii CBS767
MMKGFKNRLSRNKGQSTGKKGEKKLDKDKDSKSDSSSRKASSSSSIASKLSGSGSNAKSSSPSISRHNSGNSIKSSSSGGSATAMGQTSHLPQLPNQSQQDSPRILINDSENNDSPTMVTTAGSNTQPVTPTPTSPTTVTNTSPNASNSPFDQVQIKPGHVPHSQTGSAIHPHGYPLNTNILSPTRDNFDIDLIVTPKRHSSSRFEPSTSDRYQEIVKLPNFDEILPEEQISLFIQKIDQCNIMFDFSDPTYDGRGKEIKRITLQELIHFILNNRFTYTDEMYKHVVGMFKKNLFRPIPPPVNPIGDIYDPDEDEPVSELAWPHMQAIYEFFLRFIESPDFTHQIAKQYIDHEFILKILELFDSEDPRERDCLKTTLHRIYGKFLSLRSFIRKSINNVFLQFVYETERFNGIGELLEILGSIINGFALPLKDEHKIFLVRILIPLHKVKSLSLYHPQLAYCIVQFLEKDPMLTEDVIMGLLRFWPKINSPKEPGITNGTVQQRLLENPESPTDANGNLIDRGLILNDLNNHSIDHNTNVNDSLNPNMHDITDEEYYDSFSSPQQVQGDLDEFGTPNQIPPHNSATSNWNRSIHLLAFGALKVFMDHNPILYDHCTMLYHQSLEEQRAREVARKDGWKKVEEYVNLLRLQQSSLALSGKNSNDNGASVASH

SEQ ID NO: 29141 - protein, 634 aa, Musa acuminata
MDGCDCIEPQWPADELLIKYQYISDFFIALAYFSIPLELIYFVKKSSFFPYRWVLMQFGAFIVLCGATHLINLWTFALHSKTLAIVMTVAKVSTAVVSCATALMLVHIIPDLLSVKTRELFLKNKAEELDREMGLIRTQEETGRHVRMLTHEIRSTLDRDTVLKTTLVELGRTLDLKDCMLWMPSHSGTSLQLSHTLHHQIPTGSAVPINLPVVNQIFSSNHAMIIPHTCRLARIWPLSVRHVPPEVAAVRVPLLHLSNFQMSDWSELSTKSYAVMVLILPSDSARKWHVHELELVEVVADQVAVALSHAAILAESMRARDLLTEQNVALYLARQEAELAIRARNDFLAVMNHEMRTPLHATITLSSLLLETELSPEQRSMVETVLKSSSLLATLINDILDLSRLEDGSLELEIGDFNLHSVFREVMNFIKPIAAVKKLQVSLMLSPDLPLYAIGDEKRLMQIMLNVAANAVRFTKEGDISLTASVARTDYLRDFRALDFYPVASDGHFYLRVQIKDTGCGISYQDLPNLFTKFSQSQNVSSQGYSGNGLGLAICERYVSLMQGHIWVESDGIGKGCTATFVVRLRLCENPDGSQQKILPLPWKKQTQKFSSSRGMPTDPGGLIRLKTRYQKSV

SEQ ID NO: 29142 - protein, 635 aa, Musa acuminata
MENCDCIEPQWPADELLIKYQYISDFFIALAYFSIPLELIYFVKKSSFFPYRWVLIQFGAFIVLCGATHLINLWTFTVHSKTLAIVMTIAKVSTAVVSCATALMLVHIIPDLLSVKTRELFLKNKAEELDREMGLIRTQEETGRHVRMLTHEIRSTLDRDTILKTTLVELGRTLGLEECALWMPSRNGSSLYLSRTLHHQLPTGSTVPINLPVVNQIFSSNHAMIIPHTCQLAKIRPSSGRYVPPEVAAVRVPLLHLSNFQINDWSELSAKSYAVMVLILPSDSARKWHVHELELVEVVADQVAVVLSHAAILEESMRARDLLMEQNVALDYARQEAELAIRARNDFLAVMNHEMRTPLHAIITLSSLLLETELNPEQRSMVETVLKSSSLLATLINDILDLSKLEDGSLELEIGIFNLHSVFREVVNFIKPIAAVKKLSVSLTLSPDLPLCAIGDEKRLMQILLNIVGNAVKFTKEGHISLTASVARADYLRDFRASEFYPVSSDGHFYLRVRVKDTGCGISSQDLPHLFTKFAPGRNVASRGFSGSGLGLAICKRYVSLMQGHIWLESEGIGKGCMATFVVKLGICENPDGSQQKIVLLPWTKHGQEDTSSSRGMPKDPKAFIPLKPRYQRSV

SEQ ID NO: 29143 - protein, 152 aa, Candida glabrata CBS 138
MSNNERTFIAIKPDGVQRGLIGKILGRFETRGYKLVGIKLIQADQKLLEQHYAEHIGKPFFGPMTAFMSSGPILATVWEGKDAVKQGRAMLGATNPTQSAPGTIRGDFGIDLGRNVCHGSDSVESANREIGIWFKKEELVEWKPSNLAWIYE

SEQ ID NO: 29144 - protein, 452 aa, Neurospora crassa
MLPSRGLLRSTPALGLARASFKAPSSRQFGTALRSSFPQGSRRIGGPLGTTATAAASHQLLSSLRQVRYASTGPDAAVAADAATAAAAAPSSSPVDAVAATPVELTGSDLLNLPEQIGFLKTLGLDYGWGVTSMMQWLTEHVYVYSGLPWWATLAAVAAIVRVAIFKPSLGASQESQKMQDLNKNPKYAAIMAKVKEASFDTTKQNDLVKYRQEMALMTKNAGINYFKVFIPFIQVPIGFGMFRLIRGMAALPVESLETGGTLWFPDLTVADPYFALPIASACLFVASMRARMMKSMGLVLVPVSIFATAWLPAALQWYFLVSAIGQYFQASIFHLPAFRRWVGLPELVPGGMRGPSPFAKAAAPSSTIQYVAPRTMDTTATPVDSGSILGDIKDSSNFVKEKLEDWKKKNDNTNIHSRAKEYEERRALEEHEAYLARLELKKQKQKGRKNH

SEQ ID NO: 29145 - protein, 433 aa, Symbiobacterium thermophilum IAM 14863
MTARYERSAALYERAVARIVGGVNSPARSFKSVGGGAPVFMARGQGPYLYDVDGNRYIDYIGAFGAGMFGHGHPELVAAVARAAEGGTIYGTPNPWEVELAERIHQALPSMERIRFVTTGTEAVMSAVRVARAFTGRPKIIKMEGCYHGHSDFALIAAGSGPSQLGTPDSAGVTEGVAQDVITVPYNDLDSLGEALDVWGPQVAAVLVEPIVGNFGVAMPKPGYLEGVKRLAHAHGALLIFDEVITGFRVAYGGAQTLLGIEPDLTTLGKIIGGGLPLAAYGGRAEIMDWVAPLGPAYQAGTLAGNPLCMQVALTGLEILSRPGVYERLDADAAYLADGLVRSARSHGHTVQLGRAGSMFTLFFCDEPVVDYRTAQRSDPAKFAAMFRGLLDRGIALAPSRFEAWMLTVQHTRADLEETLQIADEVFAQMAGQ

SEQ ID NO: 29146 - protein, 219 aa, uncultured bacterium
NSRLCMSSAVAGYTRSLGSDGPPSCYEDLDHCSVAFLIGTNTAECHPVLFQRLLKRKKRNPGSITIVVVDPRRTDTAKAADIHLPIAPGSDLALLHGIAHLVLRENGQDTAFIDDHTENYHAFFDIAARWTPRRVARFCNIPEKRLRDVAQLFHRRERLLSLWSMGVNQRREGTAVVQGIINLHLLTGQIGKEGAGPFSLTGQPNAMGGREADGLSHLL

SEQ ID NO: 29147 - protein, 219 aa, uncultured bacterium
NSRLCMSSAVAGYTRSLGSDGPPCSYEDLDHCSVAFLIGTNMAECHPVLFQRLLKRKRKNPGSVNIIVVDPRRTDTAKAADIHLPIAPGSDLALLHGIAHLVLRENGQDPAFIDDHTENYDAFFDVAARWTPRRVARFCNIPEKRLREVAALFHRREKVLSLWSMGVNQRREGTAAVQGLINLHLLTGQIGKQGAGPFSLTGQPNAMGGREAGGLAHLL

SEQ ID NO: 29148 - protein, 176 aa, Zea mays
  misc_feature (158)..(158): Xaa can be any naturally occurring amino acid
  misc_feature (164)..(164): Xaa can be any naturally occurring amino acid
  unsure (1)..(176): unsure at all Xaa locations
MRTMVDLGKQRGRHHMQTIHTATTVDCASELRHRRTLRSFIECMLPYCCTYQQPSPSYQNDTVSVSSSSSSSSSSDHSSSSSHSNSIVSGTFFGHRRGRVSFCLQEDAAVGSSPLLLLELAVPTAALAKEMDQAGVLRIALECDRRRSTNSRNSRVSXIFDVPXVWSMYCNGREDG

SEQ ID NO: 29149 - protein, 296 aa, uncultured bacterium
NSRLCMSSAVSGYLQSFGSDGPPCCYDDLDLTDCAFLIGTNTAECHPIVFNRLRKHHKRNPQVKLIVVDPRFTETAQVADLHLAIRPGTDITLQNGIGHLLLKWGALDQSFIHQSTQGFADYTEVLRHYEPSIVAERCGITEADLETAARTWAESQSVLSLWSMGLNQSSEGTAKVCSLINLHLLTGQIGRPGAGPFSLTGQPNAMGGREAGGLAHILPGYRLVKNPQHRQEIEQFWSLPEGQISPSRGLTIGEMIPALEHNQVGLLWIAATNPAVSLPDLNRTKAALQRSPFTVY

SEQ ID NO: 29150 - protein, 528 aa, Nostoc sp. PCC 7120
MDAKALWQRYQEWLYFHEGLGLYLDVSRMRFDDAFVKSLLPKFDKAFADMAELEKGAIANPDENRMVGHYWLRNPDLAPTPEIAQEIVQTLEQIEAFAEKIQTGAIHPPKANRFTDIISIGIGGSALGPQFVAEALAPEFPPLKIHFIDNTDPAGIDRILTHLRNHLASTLVLVISKSGGTPEPRNGMIEVKKAYAGQNLDFAQYAVAITSTGSNLDKVAQSEGWLATFPMYDWVGGRTSEMSSVGLVPAALQGIDVRAMLEGAKEMDDATRVPEVKNNPAALLALSWYYSGNGKGEKDMVVLPYKDSLLLFSRYLQQLVMESLGKEKDLDGNTVYQGIAVYGNKGSTDQHAYVQQLREGVPNFFATLIEVLEDRHGASPEIDPGVTSGDYLSGFLLGTRQALYENQRDSITVTIPQVNARTVGALVALYERTVGLYASLVNINAYHQPGVEAGKKAAAVILDLQTKVVGLLQKEKTALSLEQIAEKIGAADQVEAIYKILRHLQANQRGVVFQGNLGQPSSLKISLS

SEQ ID NO: 29151 - protein, 835 aa, Ostreococcus tauri
MTSTDQRPRRRRLLDRARRPHHFPRLGASRTRLRAISRSVRSGDTHSRSVGVREHPSEMSGHGAVRASASVPTKLAQRRVRNKTTTRAATKTAGPPANLERLRIETPWDRAKDALKRDFGATEEELKRAEALSDEDLSKAYYMMQLCRDFENECNQAYMAGKIRGFMHLDNGQESIPALLNDAIRKDDLKHSYYRDHCHAIACGVDSGAVMAELFGKDGGTCRGTGGSMHVYDMDTNFQGGWALVAEQLPYAVGAARSIVLDKMLGRDDAQDRITVVFVGEGGAQNGRMAECLNAAAKENLPILFLVIDNGRAINTFTKDVAANQEVFNQGKHYGVPGVLVDGQNVQDVLKVGRTVINHVRTKGPAILQVHTFRFNGHSPADPEHERNRKDEKRWARAECDPIKIFENSADAARIDLKKETERAKAETQRALAFADASPPPPPGLAAELEYPDPSGAVDYSAREPVEGLESARTVTEKIIPAETLKLLEARIEALRAMCTDPRGISIGDAVNLAILEEMLRDPTTVAHAEDLQAGSSYNIPANTQQAFGTLRAADEIIDEGHFMGKALGEAMNGYRPIVELMNANFGIYGMAELSSAGNTYATTGGQFKMPMTVIGAGGTAPNQSLGAEHSQPFHAYIMGIPGLKICSASKPQEAYGLAKSMIRDNGPGVLLLPVKMMKSRGPVIPDSFLPLHKSTVHHLASDEAVKNEKAVTIVTYLHGVKECEEAMAELAQKGIDADFIELTCLKPVDWKTIQTSLERTHKLVILDESTRTGGVGATLSAIVSENLFDELDAPVMRLCMEDAPVPYASEMEKTVVKRAADLVAAVTYLIEKKA

SEQ ID NO: 29152 - protein, 202 aa, Bacteroides thetaiotaomicron VPI-5482
MEITSAEFVISNTDVKKCPTGVFPEYAFIGRSNVGKSSLINMLTARKGLAMTSATPGKTMLINHFLINQSWYLVDLPGYGYARRGQKGKDQIRTIIEDYILEREQMTNLFVLIDSRLEPQKIDLEFMEWLGENGIPFSIIFTKADKLKGGRLKMNINNYLRELSKEWEELPPYFISSSENRTGRTEILDYIENISKEVYKNK

SEQ ID NO: 29153 - protein, 517 aa, Vibrio cholerae O1 biovar eltor str. N16961
MTKNIHDQRILILDFGSQYTQLVARRVREIGVYCELWSWDVEEADIREFNPDGIILSGGPESVTEANSPRAPQYVFDSGVPVFGVCYGMQTMAEQLGGRVATSDEREFGYAQVKISGESALFKDLDLTQDVWMSHGDKVVEIPADFVKIGETDTCPYAAMANEEKKYYGVQFHPEVTHTKNGLQMLENFVLGVCGCERLWTSESIIEDAVARIKEQVGNDEVILGLSGGVDSSVVAMLVHRAIGSKLTCVFVDNGLLRLNEGEQVMEMFGDKFGLNIIKVDAEERFLKALEGIDEPEAKRKTIGRVFVEVFDEESKKLSNAKWLAQGTIYPDVIESAASKTGKAHVIKSHHNVGGLPDDMKMGLVEPLRELFKDEVRKIGLELGLPYNMLYRHPFPGPGLGVRVLGEVKKEYCDLLRRADAIFIEELHAADLYNKVSQAFTVFLPVRSVGVMGDGRKYDWVVSLRAVETIDFMTAHWAHLPYEFLGKVSNRIINEVNGISRVVYDISGKPPATIEWE

SEQ ID NO: 29154 - protein, 135 aa, Glycine max
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGER

SEQ ID NO: 29155 - protein, 556 aa, Streptococcus mutans
MKTDIEIAQSVDLRPITNVVKKLGIDFDDLELYGKYKAKLTFDKIKAVEENAPGKLVLVTAINPTPAGEGKSTITIGLADALNKIGKKTMIAIREPSLGPVMGIKGGAAGGGYAQVLPMEDINLHFTGDMHAITTANNALSALIDNHLHQGNELGIDQRRIIWKRVVDLNDRALRHVTVGLGSPINGIPREDGFDITVASEIMAILCLATNVEDLKERLANIVIGYRFDRSPVYVRDLEVQGALALILKEAIKPNLVQTIYGTPAFVHGGPFANIAHGCNSVLATSTALRLADYTITEAGFGADLGAEKFLDIKAPNLPTSPDAVVIVATIRALKMNGGVAKDALNQENVEAVKAGFANLARHVENMRKYGVPVVVAINEFITDTNDEIAVLRNLCAAIDVPVELASVWANGADGGVDLANTLINTIENNPSHYKRLYDNNLSVEEKVTEIAKEIYRADKVIFEKKAKTQIAQIVKNGWDNLPICMAKTQYSFSDDPKLLGAPTGFDITIRELVPKLGAGFIVALTGDVMTMPGLPKKPAALNMDVAADGTALGLF

SEQ ID NO: 29156 - protein, 256 aa, Shewanella sp. ANA-3
MKSIYKLSLVALAVIGLSACNQEEKATNASTNVELTTEAQKEAYSVGASIGRYMSGHIKEQEELGLPVDRALIVTGFTNGLNDQLKLTEEEMQTILQGLDKKLNDKRTEQAKAIAAKNIEDGKKFLEENKAKPGVVTTESGLQYEVLTPGSGDKPAAEDTVEVDYVGTLLDGTEFDSSYKRGQTAKFPLNRVIPGWTEGVQLMPVGAKYKFVIPANLAYGDRDTGTIPPNSTLIFEVELKSIEKAQAAPAAEPAKK

SEQ ID NO: 29157 - protein, 786 aa, Frankia sp. EAN1pec
MSPIHTLQAEDPPIDLSGGAVGLVAGVAIVAALALLVAAYLVREVLAANAGTPKMIEVGRAVQEGAAAYLRRQFRTLAGFVIVIPFVLLLLPADDTGARVGRSVFFVVGAVFSALVGFVGMSLATRANTRTAAAAIESGERAAMRIAFRTGGVVGMFTVGLGLLGAAVVVLAFRDTAPQVLEGFGFGAALLAMFMRVGGGIFTKAADVGADLVGKVEQGIPEDDPRNAATIADNVGDNVGDCAGMAADLFESYAVTLVAALILGVKAFGENGLVYPLLIPAVGVLTAIIGIFAVSPRDGDRTGMTAINRGFFISAVVSAIGVVIVSMVYLPGSFAEFPGLEGSTQSGDPRVIAISAVLIGIVLAAAIQLLTGYFTETNRRPVLGVAEASTTGPATNILAGIGVGLESAVYSALLIGAAVFGAYLLGSGSVTIALFAVALAGTGLLTTVGVIVSMDTFGPVSDNAQGIAEMSAGPEGIDERAGAILTSLDAVGNTTKAITKGIAIATAVLAATALFGSFTDTVTTALADAGASTEAARGTVGGLNIAYPDALVGLIIGAAVVFLFSGLAINAVGRAAGRVVMEVRNQFRTKPGIMEGTEKPDYGAVVDICTRDSLRELVTPGTLAVMAPIAVGFGLGYPPLGAFLGGAIAAGVLMAVFLANSGGAWDNAKKLVEDGNYGGKGSDVHAATVIGDTVGDPFKDTAGPSINPLLKVMNLVSLLIAPLVVKFSVGEDENTAARIGIALAAVVVIVAVVATSRRRGSSVGDGPPTPSAPPTRTPPSGSEVKV

SEQ ID NO: 29158 - protein, 345 aa, Oryza sativa (indica cultivar-group)
MAATNKKIVLRNHVTGFPKESDMELVAATGAAPSRVPEGTDGAVLVKNLYLSCDPYMRGRMSSHDGSYVDAFVVGEAITGYGVGKVVDSSHPGFKAGDLVWGMTGWEEYSLIKDPIRALFAIRHPDLPLSYYTGLLGMAGFTAYVGFHEICAPREGERVYVSAASGAVGQLVGQFAKLMGCYVVGSAGSDDKVRLLREKFGFDDAFNYKKESDLSAALKRCFPEGIDIYFENVGGAMLDAVLLNMRVRGRVAACGMISQYNLEHPDPVHNLTAIVTKRLRIEGFIVSDHYARYREYEEKAARYVKEGKIAYVEDVAEGLENAPAALIGLFSGRNVGKQVVVVARE

SEQ ID NO: 29159 - protein, 95 aa, Glycine max
RNSRVDPRVRMGADYYQTESEIASLLAEGKVPIGIGRNTKIRNCIIDKNAKIGKDVIIANKDGVQEADRPEDGFYIRSGITIIMEKATIEDGTVI

SEQ ID NO: 29160 - protein, 347 aa, Guillardia theta
MPRLILLLVVLGICSANYASRNAPMAGPRKFLGDGELPSVLNSRELLPESQTTVPQALRLRGGGLPYRYQDNWSDIVVRMPIDEPIKSKDIHYKLTPSMLELGLKGQEPFIKDELWGLVKVDECLWEIEMDNKLGRHVALQLKKAKGEKWDFLLKKEDIPPDMTVTEKCFLDIQIDGEAVGRIVIGLYGKTCPRTAYNFRALCTGEVQVDPEKHKRTQAANATLTYKGTKFHRIIPSFMVQGGDFTKGDGTGGESVYGGRFEDESFQIKHSREGLVSMANAGADCNGAQFFITTASAAHLNGKHVVFGEVLEGYEFVQKIEDCGSNSGKPSRRSSLWIAALSASRNR

SEQ ID NO: 29161 - protein, 281 aa, Symbiobacterium thermophilum IAM 14863
MRERSGTLSGLGGLKLYYRCWEPEHVQGNLVLVHGAGEHVGRYEHVAAWFAGRGFAVWAMDHRGHGRSEGTRMHVDRFSDYLVDLAAFVKLAAEAHGRPVMIGHSMGGLIAYRYAAAHPETISALVLSSPWFLSRAKVSRLEQALAPVLAVISPRLQVKSGIPPEICTRDAERIALDQKDPLRCQTATPRWFVECTRAAAECRTRVAFPEGLPALFLVAGTDHLVDPEATRAVFDRIGHGDKRFKLYPEKYHEIFNDPGREEVFAEILDWLRAHGLAPQAD

SEQ ID NO: 29162 - protein, 403 aa, Arabidopsis thaliana
MDAKKLDTGPRDAINWLPDEILGKILSLLATKQAVSTSVLSKKWRTLFKLVDTLEFDDSVSGMGEQEASYVFPESFKDLVDRTVALQCDYPIRKLSLKCHVGRDDEQRKACVGRWISNVVGRGVSEVVLRINDRGLHFLSPQLLTCKTLVKLTLGTRLFLGKLPSYVSLPSLKFLFIHSVFFDDFGELSNVLLAGCPVVEALYLNQNGESMPYTISSPTLKRLSVHYEYHFESVISFDLPNLEYLDYSDYALYGYPQVNLESLVEAYLNLDKAEHVESPDVTKLIMGIRNVEILSLSPDSVGVIYSCCKYGLLLPVFNNLVSLSFGTKKTRAWKLLADILKQSPKLETLIIEDLNGYPLDVSMPLNQVKELQILEYGESDDEVKRLKSFLGEESMIEVVFPEV

SEQ ID NO: 29163 - protein, 427 aa, Coccidioides immitis RS
MSSTPATSDPFRPAKRVAGQRKDVWSIAREAANASPVQPVVNMGQGFFGYNPPEFILNAAKNELDKVVSNQYAPTKGNPRLKQAIATAYSPFFGKRIDPESEVVITSGANEGMLSAFMGFVEPGDEVIIFEPFFDQYISNIEMPGGTIRYVPLHPPKDGSKRKTKASEWSIDFDELEKTFNEKTRMIMPRHNPVGKVLSREELERIAALCIKYNTIIVSDEVYDRLYYVPFTRIATLSPQVAERTLTVGSAGKNFYATGWRVGYLIGPEHLIKYVAAAHTRICYSSVAPLQAAAAIGFEEADKVGFWDQSRQEMRGKIERFCEVFDELNIPYTDPDGGYFVLANMASVKIPEDYSFPPHIESRPRDFKLFWFLAMEVGVGTIPPTEFYTDANAHIGEDWIRFSICKPDEDLEEAKKRLRGLQKYIVR

SEQ ID NO: 29164 - protein, 631 aa, Triticum aestivum
MDPRRFLCCLLLALALAFRRCGAQGAANGTGRFACLVPAPCDTFVLYRTQAPGSLDLGAISDLFGVSRAMIASANGLSLDAEGAALLPDQPLLVPVRCGCTGNRSFVNVTYPIRSGDTFYALALTGFENLTTPDVIQELNPQAVFNKLNVSQLVTVPLFCRCPTPAERSGGAQLLVTYMWRPVDTMSEVSKLMNSSASAIAAVNNVSADFTSTTMLPMLIPVARPPVLPPLQYGASASTGDPGVSKRFSGATVAASIAGSLIAVAALCAAIFAYRRYREKKATVHSASRFASPRFCFNQNAYGIQSSSSIARMINGGDKLLTSVSQFIDKPVIFGTAEIMEATMNLDERCRIGSSYYRAKLEGEVFAVKPAKGDVSAELRMMQMVNHANLIRLAGISIGADGDYTFLVYEFAEKGSLDKWLYQKPPSSLPSSSSSADTLSWNQRLGIAFDVANGLLYMHEHTQPSMVHGDVRARNILLTADFRARISNFSVATPAMADAAATSSDVFAFGLLVLELLSGRTAMETRVGAEIGMLWRDIRAVLEAGDKRDAKLRKWMDPALGDEYYLDAALSLAGMARACTEEDAARRPKMADVVFSLSMLVQPLPVGDAFEKLWQPSSEENIRIVNEVAAR

SEQ ID NO: 29165 - protein, 296 aa, uncultured bacterium
NSRLCMSSAVSGYLQSFGSDGPPCCYDDLDLTDCAFLIGTNTAECHPIVFNRLRKHHKRNPQVKLIVVDPRFTETAQVADLHLAIRPGTDITLQNGIGHLLLKWGALDQSFIHQSTQGFADYTEVLRHYEPSIVAERCGITEADLETAARTWAESQSVLSLRSMGLNQSSEGTAKVCSLINLHLLTGQIGRPGAGPFFLTGQPNAMGGREAGGLAHILPGYRLVKNPQHRQEIEQFWSLPEGQISPSRGLTIGEMIPALEHNQVGLLWIAATNPAVSLPDLNRTKAALQRSPFTVY

SEQ ID NO: 29166 - protein, 395 aa, Zea mays
  misc_feature (324)..(324): Xaa can be any naturally occurring amino acid
  unsure (1)..(395): unsure at all Xaa locations
MLSRLMDFLTACWRRRSFSDGKGGSEVTGRKEGLLWYKDAGQHLFGEYSMAVVQANNLLEDQSQIESGPLSLLDTGPYGTFVGVYDGHGGPETSRYVCDHLFQHLKRFASEQKSMSEEVIRKAYQATEEGFLSVVTKQWPMNPQIAAVGSCCLVGVICGGILYIANLGDSRAVLGRVVRATGEVLAIQLSSEHNVARESVRQEMHSLHPDDSKIVVLKHNVWRVKGLIQISRSIGDVYLKKAEFNKEPLYAKFRVREGFKRPILSSDPSISVHEIQQHDQFLIFASDGLWEHLSNQDAVDIVQNNPHNGIARRLIKAALQEAAXKKREMRYSDLKKIDRGVRRHFHDDITVVVVFLDSNLVSRASSVRGPPLSVRGGGIPLPSRTLAPCAAPMET

SEQ ID NO: 29167 - protein, 296 aa, uncultured bacterium
NSRLCMSSAVAAYMYSLGSDGPPCCYDDLELTDCAFLIGTNTADCHPIVFNRFRKHHKQQAGVKLIVVDPRRTATAVVADLHLAIRPGSDIDLLHGMAFLLRQWGRIDADFIAHHTHGYKDYGQVIDQYPPDVVAERCGIPVEQLEQAARWWGDSQNVLSLWSMGINQSAQGTAKARSLINLHLLTGQISKPGSGPFSLTGQPNAMGGREAGGLSHLLPGYRLIKNPDHRREVEQAWGLPPGRICPEPGLSAWEMIRGLEAGTVGCFWVVATNPLVSMPDLNRVKAALRRSPFTVC

SEQ ID NO: 29168 - protein, 296 aa, uncultured bacterium
NSRLCMSSAVAAYMYSLGSDGPPCCYDDLELTDCAFLIGTNTADCHPIVFNRLRKHHKQQAGVKLIVVDPRRTATADVADLHLAIRPGSDIDLLHGMAFLLRQWGRIDADFIAHHTHGYKDYGQVIDQYPPAIVAERCGIPVEQLEQAARWWGDSQNVLSLWSMGINQSAQGTAKARSLINLHLLTGQIGKPGSGPFSLTGQPNAMGGREAGGLSHLLPGYRLIKNPDHRREVEQAWGLPPGRICPEPGLSAWEMIRGLEAGTVGCFWVVATNPLVSLPDLNRVKAALRRSPFTVC

SEQ ID NO: 29169 - protein, 277 aa, Burkholderia vietnamiensis G4
MSDQYAVIGNPIGHTKSPLIHGLFSEESHQDISYTAIEGPLEPDDAFAATVRSFFAAGGKGMNVTAPFKLKAFAMADERSERAALAGAANTLSFRDGRIIAENFDGVGLVRDIEVNLNLPMAGKRVLVLGAGGAVRGALLPFIAARPAELVVANRDVAKVEALIARVATGDSLVACGYGDLAAMGRFDLVVNATSASLSGELPPVPPSVFDPRGAAYELVYGKRLTPFLRHARHAGVLGIADGVGMLVEQAAEAFAWWRGMRPETRAVIDRLTVPLD

SEQ ID NO: 29170 - protein, 296 aa, uncultured bacterium
NSRLCMSSAVAAYMYSLGSDGPPCCYDDLELTDCAFLIGTNTADCHPIVFNRLRKHHKQQAGVKLIVVDPRRTATADVADLHLAIRPGSDIDLLHGMAFLLRQWGRIDADFIAHHTHGYKDYGQVIDQYPPDVVAERCGIPVEDLAQAARWWGDSQNVLSLWSMGINQSAQGTAKARSLINLHLLTGQIGKPGCGPFSLTGQPNAMGGREAGGLSHLLPGYRLIKNPYHRREVEQAWGLPPGRICPEPGLSAWEMIRGLEAGTAGCFWVVATNPLVSLPDLNRVKAALRRSPFTVC

SEQ ID NO: 29171 - protein, 296 aa, uncultured bacterium
NSRLCMSSAVSGYIQSFGSDGPPCCYEDLEQTDCAFLIGTNTAECHPIVFNRLHKHCKKNRKVKMIVVDPRRTSTAEAADLHLAIRPGTDIDLLNGIAHLLMRWGKINTLFIDDCTRDFPLYADIIRHYPPELVARKCGIRLDELEKAARYWGDSERVLSLWSMGMNQSSEGTAKVRTLINLHLMTGTIGRPGSGPFSLTGQPNAMGGREAGGLAHILPGYRLVKNPQHRAELEQLWQLKPGQISPEPGLSAWDMILGLETGAVGFLWIAATNPAVSMPDLERTKAALKQSSFTVY

SEQ ID NO: 29172 - protein, 496 aa, Photobacterium profundum SS9
MMIAQLPIKLYRAEQVRHGEKAVAKILHINMYELMERAGQAVFITLKKCFPAACSITVCCGGGNNGGDGYIVARLALHAGLNVQLLQLDVAKALTGDAAKARDAWLVAGGKIESFSDTTIFTSTDVIIDALLGTGLSGAVRTNIAHYIEMMNQASKPIIAVDVPSGLCADTGTMLGIAINATLTVTFIGIKQGLCTGQAGHHCGELLYADLEVESTFSTVVKPTVFRVEHNYVKQCLPVRHRSAHKGSYGRVLCVGGDLGMAGAIRLAAEACARTGAGLSAVITQPDNILSIVTARPEIMVQGWSDKAHKSISRVEWADVVVLGPGLGTSNWSKALFNIVRSTEKKTVFDADGLNLLAQSPDYKKNRIITPHPGEAARLLNMTIYDIERDRFSAVRKLQQKYGGVAVLKGAGTLIFDGQQLWVCTAGNPGMATGGMGDVLSGIIGALLGQGLSLADAACVGVWIHSKSADLCAQKGERGMLASDLFPYIRQLINPR

SEQ ID NO: 29173 - protein, 210 aa, Escherichia coli B
MTNLNYQQTHFVMSAPDIRHLPSDTGIEVAFAGRSNAGKSSALNTLTNQKSLARTSKTPGRTQLINLFEVADGKRLVDLPGYGYAEVPEEMKRKWQRALGEYLEKRQSLQGLVVLMDIRHPLKDLDQQMIEWAVDSNIAVLVLLTKADKLASGARKAQLNMVREAVLAFNGDVQVETFSSLKKQGVDKLRQKLDTWFSEMQPVEETQDGE

SEQ ID NO: 29174 - protein, 542 aa, Glycine max
QLRRPPPHLSLLSLTPANSKREMEAASATILLLILILALICSWKVLNWLWLRPKRLEKLLREQGFRGNPYTLFFGDSKEFLKMRKEAVSKPMTLSDDIVPRVSAYVQHSVNKHGKNSFIWFGPMPRVTILDPEQIKDVFNKNYDFPKPNLNPLVKLLATGLAGYEGEKWSKHRRIINPAFNLEKLKIMLPLFLQSCNDLVSKWEGMLSSEGSCEMDAWPFLQNLTSDVIARSAFGSSYEEGRRIFQLQREQTEHLMKVILKIQIPGWRFLPTKTHRRMKEIDREIKASLKNMINKREKALKSGEATKNDLLGILLESNHKEIQEHGNRNSKNVGMSLEDVIEECKLFYFAGQETTSVLLVWTMVLLSRYPDWQARAREEAFQVFGYQKPDFDGLSRLKIVTMILYEVLRLYPPLIGMNRLVEKDVKLGNLTLPAGVQVFLPTVLIHHDSELWGEDAKQFNPERFSEGVLKATNGRVSFFPFGWGPRICIGQNFSLLEAKMALSMILQNFLFELSPAYAHAPTMSITTQPQYGAHIILRKVPI

SEQ ID NO: 29175 - protein, 204 aa, Solanum arnezii x Solanum hondelmannii
LNSSYRVPFESFRVPFVDLQEATNNFDEKFHIGLGGFGKVYRGVLRDGTKVALKRCKRESSQGIEEFQTEIEILSFCSHPHLVSLIGYCDERNEMILVYDYIENGNLRSHLYGSDLPSMSWEQRLEICIGAARGLHYLHTSAVIHRDVKSINMLLDENFVAKITDFGLSKKGTELDQTHLSTLVQGTIGYLDPEYFIRGQLTEK

SEQ ID NO: 29176 - protein, 290 aa, Solanum berthaultii
LNSSYRVPFESFRVPFVDLQEATNNFDEKFHIGLGGFGKVYRGVLRDGTKVALKRCKRESSQGIEEFQTEIEILSFCSHPHLVSLIGYCDERNEMILVYDYIENGNLRSHLYGSDLPSMSWEQRLEICIGAARGLHYLHTSAVIHRDVKSINMLLDENFVAKITDFGLSKKGTELDQTHLSTLVQGTIGYLDPEYFIRGQLTEKSDVYSFGVVLFEVLCARPAIVQSLPREMVNLAEWAVDSHNKGQLEQIIDLNLAAKIRPESLRKFGETAVKCLALSSGDRPSMGDVL

SEQ ID NO: 29177 - protein, 188 aa, Zea mays
MGECEDGKEYRCWEELLPDALGLIFRNLPLQEVLTVLPRVCKSWGRVVAGPYCWQEIDIEEWSQQQSKPEQIGRMVELLVGRSGGSCRRISVSGLPCDPLFSFIADNARALGTLEIPRSEISDSVVEAVAPRLSNVTFLDISSCTKIGARALEAFGRHCRSLVGLRRVMHPIDLADKVCQHDEAHAIA

SEQ ID NO: 29178 - protein, 464 aa, Anabaena variabilis ATCC 29413
MVSTHPAGVQDAGTQYLPQRRNTNTNISPNQELLPLTAKANSQGNLEIGGCDVTTLVEQFGSPLYILDEETLRTACQQYRDGFQKYYPGESQVLYASKAWNCLAVCAIAGSEGLGIDVVSGGELYTALAAGVSPAKIYLHGNNKSREELILAIESGVTIVADNWYELRTLASLTHTDQPVRIMLRLTPGIECHTHEYIRTGHLDSKFGFDPNDLAEVFEFVSQQPNLNCVGLHAHIGSQIFERQPHRDLAAVMVQWLRDANKYGLNVTELNVGGGLGIKYVESDDPPSIDEWVKAICEVVQSACAAENLPLPKLLSEPGRSLIATSCVTAYTVGSSKTIPEIRTYVSIDGGMSDNPRPITYQSVYRAVIANKLSVSHTETVTIAGKHCESGDILIKNAQLPKTEPGDILVVMATGAYNYSMASNYNRLPRPAAVVVANGEANLILQRETYQDLIRQDCLPERLK

SEQ ID NO: 29179 - protein, 219 aa, Enterobacter cloacae
MTQDELKKAVGWAALQYVQPGTIVGVGTGSTAAHFIDALGTMKGQIEGAVSSSDASTEKLKSLGITVFDLNEVDRLGIYVDGADEINGHMQMIKGGGAALTREKIIASVADKFICIADASKQVDILGNFPLPVEVIPMARSAVARQLVKLGGRPEYRQGVVTDNGNVILDVHGLEILDAIALENAINAIPGVVTVGLFANRGADVALIGTADGVKTIVK

SEQ ID NO: 29180 - protein, 438 aa, Symbiobacterium thermophilum IAM 14863
MRGVTNGGKEMGGAQNPFLIAQQQVRNAVAALGESEELFELLKAPAHFIEVQIPVRMDDGSLRVFTGYRSQHLTTLGPAKGGIRFHPAVTADEVKALSMWMTFKTSVVGLPYGGGKGGVVVDPRKLSLGELERLSRGYVRAIWPYLGPDKDIPAPDVNTNAQIMGWMTDEYETIVGASCPAVFTGKPLSMGGSLGREEATGRGTVITIREALAYLGLPVAGARVAVQGFGNAGQHAARLLEELGAVLVAASDSRGGIVCPGGMRVADLIAYKQATGSVVGFPGSRATDQFGVLTADCDILVPAALENQIDAEVARSIRARVVAEAANGPTTPDGDHVLAQRKIFLIPDILANAGGVTVSYFEWVQNRNQYYWTAEEVNARLEQRMVASFRDVVAMAERHGAYTRTAAYMYAIHRIAESLRMRGLLRAPARQALRAAAG

SEQ ID NO: 29181 - protein, 624 aa, Frankia sp. EAN1pec
MRAGGNARPAKDSRLRAPDAGPMERMLADIHEAFRTDRSGKVASFIPELATADPALFGLAVTTMDGLRYRAGDSDVPFTIQSVSKPFVYALALRDRGTDGVLARVGVEPTGDAFNAITLEPETGRPLNPMVNAGALLTSSLVGGGDAAERFDRVLTGLSAFAGRQLTVNERVFASERDTGDRNRAIGYLMRGAGALRGPVDEICEVYFRQCAVEVTAADLAVMAGTLARGGVNPLTGERVLNEEHVNHVLTVMATCGMYDRAGTWLFRVGLPAKSGVAGGVCAVLPGQLGIGVFSPPLDEVGNSVRGVRACERLASRFALHLLAPQGEPPHPVRGTHRGDALSSKRMRGARERAVLAVRGSAIVIHELQGDLVFASAERVVRTVRQHLDDVRWVVLDLRRVAAVREPALELLRVLLDELASRDVNVLFADPRGLPGVDRLMRGDWSTQRVPDLETALEWAEEALLMREDLATLPPTAHVPLGAQELLTDLGKEGTRVIGAMCERRTYERGATVFDEGDPADALYFVTRGLANAQAPNADGTRWFRLSSVPAGSAFGELALVDGGRRSTRIVVAETMTCEVLSVAAFDTLVREHPDVYNALVRAIARSLSAQLRRATREIQSLEE

SEQ ID NO: 29182 - protein, 757 aa, Diospyros kaki
MLKTLASVILISSFLSSASSADNGYPRCDCTVEGFLSPESIMQCQKASDLLIAVAYFSIPIELLYFVSCSNLPFKWVLFEFIAFIVLCGMTHLLTGWTYGPHSFHLMLALTVFKFLTALVSFATAITLLTLIPLLLKVKVRELLLKKKAWDLGREVGIIKKRSEAGWCVRMLTQEIRRSLNRHTILDTTLVELSKTLDLQNCAVWMPNEDRTEMVLTRDLGTIGSYMCKASIPIGDPDVREIKGSEQVKMLEPGSALAASSARGCVEFGPVAAIRMPMLTVADFKGGTPQMIQTWYAVLVLVLPGGQDRWWSNEELEVVKVVADQVAVAISHAALLEESQLMRNQLVERNRVLQRARQDAMMASQARNSFQQVMNDGMRRPMHSVLGLLSLMQDEKLSSELQILVKAMVKTSNVLSTVIDDVMDISIKNNGRFPLQMRSFQLHSMIKEAACLARCLCVFRGYEFEIEVEKSLPNHVMGDDRRVFQVILNLLGNLLSGNGGGGCVTFRVSSDRGSRDRNAAKWAMWRPILSDGNVCVRFEIGIRTNDSTLGVQFGGQSYCSDAIEECLSFNVCERLVQLMQGHLFVVSNSDGFDQSITVMLRFHLSPPIEIDLSVTGDSSDHPHSTSLFRGLQVLVVDGDDMNRAVTRKLLKRLGCMVSDVASGYECLNAVGSGVPSFQILLLDLHLQDLDALQIAVAIRKFRTHSWPLIIALTSSAVEDIWGRCLQIGMNGVLRKPVLLEGMAEELRRVLMLPNRDV

SEQ ID NO: 29183 - protein, 426 aa, Marinobacter sp. ELB17
MTHSETLFEQAQKYIPGGVNSPVRAFRGVGGTPIFFKRAQGAYLYDEDDRRYIDYIGSWGPMIVGHSDPRIRAALHAQIDLGVGYGAPTAIETEMAKKVCELVPSIELVRMVNSGTEATMSALRLARGYTGRDKVVKFEGCYHGHVDSLLVKAGSGALTLGVPNSPGVPACLAELTLTLNFNDIDDVRETFRAMGNEIAAIIVEPVAGNMNCIPPVPGFLEGLREICDEYGTVLIFDEVMTGFRVSLGGAQGLFGVTPDLTALGKVIGGGLPVGAFGGKREIMEHIAPLGPVYQAGTLSGNPLAMTAGLATLNAISEPGFHDALTLKTEKICAGLKAAADEAGIPLAVQGAGAMFGFFFSKESSVTRFDQVMECDIERFKKFFQGMLAEGIYLAPSAFEAGFTSAAISDENIEFTLNAARKVFATL

SEQ ID NO: 29184 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVEHGMFLGMATTLIVAGKFGVTVKDRFG

SEQ ID NO: 29185 - protein, 296 aa, uncultured bacterium
NSRLCMSSAVAGYMQSLGSDGPPACYDDLEQTDLAFLIGTNTAECHPIVFNRLQKQHKKNRNMKLVVVDPRRTPTAEAADIHLPIRPGTNIDLLHGIANLLMKWGYIDSLFIDECTRGFPEYAEVFQQYEPEQVARRCGIKLSDLEQVARLWGKSDRILSLWSMGFNQYAEGTAKVRTLINLHLITGTIGKPGCGPFSLTGQPNAMGGREAGGLSHILPGYRVVKNPDHRAEVERAWGLPPGSISPQAGRDAWAMIRGLEQDEVGVLWVAATNPAVSMPDLERTKKALDKSPFTIL

SEQ ID NO: 29186 - protein, 355 aa, Hordeum vulgare subsp. vulgare
SARGALKLEEFGISGSDAENICYLRNLEDADKLVNAMSSCSGGNAVVIGGGYIGMECAAALVTNKIKVTMVFPEKHCMGRLFTEKLAEYYESYYTSKGVTFTKGTVLTSFEKDSTGKVTSVILKDGNHLPADMVVVGIGIRANTSLFEGQLLMEKGGIKVNGQMQTSDSSVYAVGDVAAFPIKLFDGDVRRLEHVDSARRTARHAVAAILEPSKTRDVDYLPFFYSRVFTLSWQFYGDNVGEVIHYGDFTSNSPRFGAYWVSKGQITGAFLEGGNRDDYEALSVVVRRKTKASDMSELERQGLAFAIQESKKEVPDSGVTLGEKPTFVWYATAGVVAAVSISAFGYWYGRKRRRW

SEQ ID NO: 29187 - protein, 290 aa, uncultured bacterium
NSRLCMPSAVSGYIQSFGSDGPPCCYEDLEQTDCAFLIGTNTAECHPIVFNRLHKHCKKNRKVKMIVVDPRRTPTAEAADLHLAIRPGTDIDLLNGIAHLLMRWGKINTLFIDDCTRDFPLYADIIRHYPPELVARKCGIRLDELEKAARYWGDAERVLSLWSMGMNQSSEGTAKVRTLINLHLMTGTLGRPGSGPFSLTGQPNAMGGREAGGLAHILPGYRLVKNPQHRAELEQLWGLKSGQISPEPGLSAWDMILGLETGAVGFLWIAATNPAVSMPDLERTKAALMQ

SEQ ID NO: 29188 - protein, 295 aa, uncultured bacterium
NSRLCMSSAVSGYIQSFGSDGPPCCYEDLEQTDYAFLIGTNTAECHPIVFNRLHKHCKKNRKVKMIVVDPRRTSTAEAADLHLAIRPGMDIDLLNGIAHLLMRWGKINTLFIDDCTRDFPLYADIIRHYPPELVARKCGIRLDELEKAARYWGDSERVLSLWSMGMNQSSEGTAKVRTLINLHLMTGTLGRPGSGPFSLTGQPNAMGGREAGGLAHILPGYRLVKNPQHRAELEQLWGLKSGQISPEPGLSAWDMILGLETGAVGFLWIAATNPAVSMPDLERTKAALNSPHLRY

SEQ ID NO: 29189 - protein, 432 aa, Sulfolobus solfataricus P2
MIYFFMVDAVELSRKYEGKIEIYPKVPITSYNDFALIYTPGVAEVSKAIYKDPDKSFELTSRWNTIAVVTDGTRVLGLGNIGPTAAMPVMEGKSLLFKYLGGVDAIPLPINVKSADEFTNVVKALETSFGGINLEDIESPKCFYILEKLQSMLNIPVWHDDQQGTAAAILAGLINAMILTNKDPKESKVVFYGAGASNIAAARILAKYGFKYENIVMIDSKGPLYADREDVDHLMLHHKWKYELAIKTNKWEAKEIKDAFSGADAVVAASTPGPNVIKKEWISLMNKEAIVFALANPVPEIWPQDAKEAGAKIVATGRSDFPNQVNNSLIFPAIFRGVLDSRAKAITDEMTIAASEALAKYARDRGINENYIIPRMDEWEAFYEEAAAVASKAVELGLARVKKSREEFREIAKERIIRARKIMNLVISTWSP

SEQ ID NO: 29190 - protein, 219 aa, uncultured bacterium
NSRLCMSSAVAGYTRSLGSDGPPCCYEDLDDCSVAFLIGTNTAECHPVLFQRLLKRKKRNPKDVTVVVVDPRATDTTKAADHHLAIKPGSDLALLHGIAHLVLEAGGLDADFIEEATEGLADFAQLIAGATPARTAELCGISEAQLRQVAALWAQRDRVLSLWSMGVNQRREGTAVVCGLINLHLLTGQIGKPGAGPFSLTGQPNAMGGREAGGLAQLL

SEQ ID NO: 29191 - protein, 219 aa, uncultured bacterium
NSRLCMSSAVAGYTRSLGSDGPPCCYEDLDQCSVAILIGTNTAECHPALFQRLLKRKKRDPKGLTIVVVDPRATDTSRIADHHLAIAPGTDLALLHGLARLIVQNNGFDSDFIDEATEGFAAYAKTIRTWTSAKVAALCGISEKELRQVARLWSRSQGVLSLWSMGVNQRREGTAVVSGIINLHLLTGQIGKPGAGPFSLTGQPNAMGGREAGGLAHLL

SEQ ID NO: 29192 - protein, 687 aa, Coprinopsis cinerea okayama7#130
MFPPSKLGEYTVIADIAEGTFGKVKMAIHTVTGHKVAMKYISKAVIQREKTKTRVRREFEYLRTLRHPHIIKLYEVISTPTDIIFVLEYAGGELFNYIVANGRMSEAQARRFFQQIISGIEYSHRLKIVHRDLKPENVLLDDDLNVKIADFGLSNEISDGDFLTTSCGSPNYAAPEVIRGGVYAGPEIDVWSSGVILYVMLCGRLPFEDDDVQMLFHKISQGQFHCPSYLSKDAQSLINSMLVVDPVKRATITDIINHPFFKVDLPRYLTPLPPPPGPVLGMLTTLVAPPKQLDYEIIDGLGRIEEDVVEQLAARMIGVSKDDIWECLRRDDGAQGNAVKVAYMLLRDKNRLGKDLAVFAEAERDAQLAAQDPLTGLLSPTALSPAATEIDSNPFEAELNAEYEEEEEYLSEDELDSFIAAPPATDPTFAVLNSSLPEQLPEQHHLTSYVSAKRSARSGEKKQHRTKWHFGIRSRSPPMEVMLEIYRTLKTLGMEWKEKKNLGGLGGLKARRQHHHHQYHHHERGRASIERAREYDGDGGVDLKAAAGIYCVETRCRVQDVVVLMNLQLYMVDSINYLVDFHHKKTYKASTEPGAGKFDMAHFEIPSDSCSESERSVKEKEGCFGIGGREDEVVSPFVFMDVACRLILELAGGGELVEGRGRGVVTEEVGCGGSRREKETGLRGDAM

SEQ ID NO: 29193 - protein, 153 aa, Arabidopsis thaliana
MGSLVELVAFLVTMCVSVTISRGQKDSIPPTPTSGFDNPRTTVVIYNDLGGHLPLRYHCKSKNDDLGDRNMAVNGTWSFEFRPSVFGGTLFFCGFIWDKELHWFDIYKQSRDREFAEFGCRRCEWKIRKDGPCKLNKNSNMFDVCLPWNSQSL

SEQ ID NO: 29194 - protein, 523 aa, Triticum aestivum
MDTLGSPPWSLLCALGALLAALWCAGRALTGAWLRPRRLARALRSQGVSGTQYRFPSGDMKEYVRLIAAACSQPMPLSLHAVAARAVPFDHAIIKQHGKVALTWFGPEPRVVVSDPQLFREILSNKQGQFGKQRSILRIERLLANGLTTHQGDKWVAHRRIINHAFHLEKLKRMLPAFAACSSELVRRWGDSMGQSDVQEIDVWPEFQNLTGDVISRVAFGSSFSEGRKIFQLQSEQAQNAVKMANLMYIPGYRFLPTKLNRRMKANAREVEVLLKGIITNRQRAMMDGHADNDDLLGVMMESNIEESQEAGSSKPTMTTDDIVGELKLFYFAGMETTAVLLTWAMVLLSMHPEWQDRAREEVLRVFGQNQPDSEGINRLKVVTMILHEVLRLYPPILLLSREAYKETELGGVTYPAGVTFALPIVCIHHDPDVWGEDVVEFKPERFAEGIAGASKNSPAFFPFGWGPRICVGQNFALLEAKMGLSVILQHFMFELSPSYTHSPCPVSTLQPQHGSQIKLTKL

SEQ ID NO: 29195 - protein, 537 aa, Sulfolobus solfataricus P2
MNSEYYEYQLTIDKILDSGSRSFPDREIVYRDIRRYTFRSFANSVKRLANGLRKIGVKRGEKIGVIDWDTDVYMHNYYAIPMIGSVLHTVNIRYPLELIAKTILHAEDKYLIVRDEFMPLIEKAKGIMPVGMKVISYSDSKEKVRSSLDTIDFWELIESNEPLEEETNVNENDMATIFYTSGTTGEPKGVWFNHRKIVLHAISVSLVGARPPLSLTSNDVYMILVPMFHVHAWGYPYVALMAGVKYVLPGKYDYSFILSLMDKEGVTYSAMVPTILYLLLTNPDAPRYLHVFKRWKVTIGGSALPEGLAKKAKELGITVIGGYGLSETCPVLSVGYYNSAIERLDDNTKFMAQITAGAPIPLVQIKIVDPATGKEKETGKIGEIVVRAPWLTQEYYKDPEKTKALWKGGWLHTGDLAYMDQYGYIHIVDREKDAIKSGGEFIPSLLLENAISLHPKVSQVAVVGIKDEKWGERPAAFIVPKEQVSEEEIRQFLLKLADEGKIQKWWIPDRFIFISSMPLTSTNKIDKKVLRDMTQTK

SEQ ID NO: 29196 - protein, 475 aa, Solanum peruvianum
MNVMRRLKSIASGRSSVSDPGGDSSIKRVKVEKEVDQRVVGETQMEEGCTTTTVPKEDMASTSKETTAGSTSTMDTRLENSELDELPKEMHEMKIKGEKDDKADSLDDNLKDMEPAVVSGNGTETGQIIVTTVSGRNGQEKQTLSYMAERVVGTGSFGVVFQAKCLETGESVAIKKVLQDRRYKNRELQIMRTLDHPNVVKLRHCFYSTTEKNDVYLNLVLEYVSDTVYRVSRHYSRLTQHMPIIYVQLYTYQICRALNYMHGVLGVCHRDIKPQNLLVNPHSHQLKLCDFGSAKMLVPGEPNISYICSRYYRAPELIFGATEYTTAIDMWSAGCVMAELLLGQPLFPGESGVDQLVEIIKILGTPTREEIRCMNPNYTEFKFPQIKAHPWHKIFHKRMPPEAVDLVSRLLQYSPTLRCTALEACAHPFFDSLREPNACLPNGRPLPPLFNFSPQELSGVPAELRKRLIPEHLRK

SEQ ID NO: 29197 - protein, 133 aa, Glycine max
  misc_feature (24)..(24): Xaa can be any naturally occurring amino acid
  unsure (1)..(133): unsure at all Xaa locations
MPRGTLEVVLISAKGIDDNDFLYXTTKTSIDPYVILTYRAQEKKSTVQEDAGSKPQWNESFLFTVSDSASELNLKIMDKDNFSQDDCLGEATIHLDPVFEAGSIPETAERNEEQGYDAPEESYGGWKESSGEY

SEQ ID NO: 29198 - protein, 176 aa, Solanum berthaultii
SMSWKQRLEICIGSARGLHYLHTGYAKAVIHRDVKSANILLDESFMAKVADFGLSKTGPELDQTHVSTAVKGSFGYLDPEYFRRQQLTEKSDVYSFGVVLFEVLCARPVIDPSLPREMVNLAEWAMKWQKLGQLEQIIDSNLEGKIRPDSLRKFAETAEKCLADFGVDRPSMGDVL

SEQ ID NO: 29199 - protein, 198 aa, Solanum berthaultii
VPFESFRVPFVDLQEATNNFDEKFHIGLGGFGKVYRGVLRDGTKVALKRCKRESSQGIEEFQTEIEILSFCSHPHLVSLIGYCDERNEMILVYDYIENGNLRSHLYGSDLPSMSWEQRLEICIGAARGLHYLHTSAVIHRDVKSINMLLDENFVAKITDFGLSKKGTELDQTHLSTLVQGTIGYLDPEYFIRGQLTEK

SEQ ID NO: 29200 - protein, 429 aa, Candidatus Kuenenia stuttgartiensis
MDAFHYDGNTLYCERVKIKDIVSETGTPVYIYSKNAILTRFNELKTAFQEVDATICFSVKSNSNLSVCKILADEGSGFDVVSGGELFRALKAGGKPSKIVFAGVGKTDKEIQYALENDIFMFNVESIAEIEHINAAACRAGKTAKVALRINPDIDAKTHAKTTTGKKENKFGIDLIVAETIIEKAKAYTNVTICGIHVHLGSPIYSADPYVNALKKITMFMEKCRNAGINIQYLNIGGGYCISYTGEKVIEPKDYSTQILPFAKEMKCRVIMEPGRFITGNSGILVTSVIYNKQNSHGKKFVICDAAMNDLLRPALYDAFHRIWPVNTSVAMPDVETPDTSVAKQGMDLVDIVGPVCESSDVFAKDRAIPPVNEGDLLAIFSAGAYGFTMSSSYNSRPRSCEILVDRDKYIVIRKRETYEDLIAGEELV

SEQ ID NO: 29201 - protein, 115 aa, Debaryomyces hansenii CBS767
MAELIDRPRSELTELELQKLEEFEFTHGPMSLLQNAVNNGSPVVISCRNNHKLIAKVKAFDRHCNLILENVKELWTESVKNNKGKKIKSTSKERFVSKMFLRGDSVVIVLKAQAS

SEQ ID NO: 29202 - protein, 355 aa, Trichoderma asperellum
MSRSNAPNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 29203 - protein, 789 aa, Oryza sativa (japonica cultivar-group)
MPDLPCDGDGVCMVCRVASPPEVDLLRCSTCATPWHSPCLSKPPALADAAQWSCPDCSGDSTDAPPPAPAPLAPGSAGQLVAAIRAIECDATLSDQEKARRRQELLGGAAPAGADADDDEGDDVLEVIGKNFSCAFCMKLPERPVTTPCGHNFCLKCFQKWIHSGKRTCGKCRAQIPAKMAEQPRINSALVSVIRMAKVSKNANSAVSAAAYHYIRNDDRPDKAFTTERAKRAGKANASSGQIFVTIPPDHFGPILAENDPKRSIGVLVGDTWEDRLECRQWGAHFPHVAGIAGQSTHGAQSVALSGGYVDDEDHGEWFLYTGSGGRDLSGNKRTNKEQSSDQKFEKLNAALRISCLKGYPVRVVRSHKEKRSSYAPEAGVRYDGVYRIEKCWRKISVQGKFKVCRYLFVRCDNEPAPWTSDIYGDRPRPLPKVDELKGATDISERKGTPSWDFDEKEGWKWVKPPPISRKPNLSGDPATDKEIRRVARRAQMSVTERLLKEFGCSICKQVMKEPLTTPCAHNFCKLCLVGTYGSQSSMRERSRGGRTLRAQKIVKKCPSCPTDICDFLENPQINREMMDLIESLQRKAVEEGDTKTSSDVSNGAESSGDDGNNEALEKGEDDSSLKDDGSLKDDGKVVKAVVVIKEEDLQPKKSKGEDEKEQGDKKMDSADVVDIAVEKKQATKRASEKAEKKQARKRKGDAVATNDGKRMKTGGDAMETAAEEDAPLSGGTPVKRNSRKSSEVDAKGGGGSPVVSSPRRVTRSNAKASGEADGSPATRTRRATRAEA

SEQ ID NO: 29204 - protein, 552 aa, Synechococcus sp. WH 8102
MTTSAPAEPTLRLVRLDAPFTDQKPGTSGLRKSSQQFEQANYLESFVEAVFRTLPGVQGGTLVLGGDGRYGNRRAIDVILRMGAAHGLSKVIVTTGGILSTPAASNLIRQRQAIGGIILSASHNPGGPNGDFGVKVNGANGGPTPASFTDAVFECTKTLEQYTIVDAAAIAIDTPGSYSIGAMQVEVIDGVDDFVALMQQLFDFDRIRELIRSDFPLAFDAMHAVTGPYATRLLEEILGAPAGSVRNGVPLEDFGGGHPDPNLTYAHELAELLLDGEEFRFGAACDGDGDRNMILGQHCFVNPSDSLAVLTANATVAPAYADGLAGVARSMPTSSAVDVVAKELGIDCYETPTGWKFFGNLLDAGKITLCGEESFGTGSNHVREKDGLWAVLFWLQILAERRCSVAEIMAEHWKRFGRHYYSRHDYEAVASDAAHGLFHRLEGMLPGLVGQSFAGRSVSAADNFSYTDPVDGSVTKGQGLRILLEDGSRVMVRLSGTGTKGATIRVYLESYVPSSGDLNQDPQVALADMISAINELAEIKQRTGMDRPTVIT

SEQ ID NO: 29205 - protein, 411 aa, Ashbya gossypii ATCC 10895
MITMSAVAQQAHRTVLAALVTFVFIQGCVSLVIFQFSMKCMYRSNRIGLQSQLDRSKKSFILLLVTIMTIVAPSYVRVTTDNASVAKGTFWRDKGQGQLRSRLERNSVVISNHQIYTDWVFLWWLAYTSGLAGRVYIMLKKSLAAIPVLGYGMKNYGFIFMNRRWNLDRVHLGNSLQRLDRDGRGLGPLAGHAPSRVTAEGEEEYESQDGEASKQTWPYTLILFPEGTNMSSNTRERSNVYARKINVQPFENVLLPRSTGLRFALEKLAPSCDCVYDVTIGYSGVKKTTYAEQIYDLQSIFLRGQGPKLVDVHIRTFKLSEIPYKDEKAFEQWLYKVWGEKDKLLERYYQKGSFDLDPDLTHTVSGLCEIDTAEVFLVMIVPMLILAAASFLFTKYAVQYFGKYSMAAAIY

SEQ ID NO: 29206 - protein, 440 aa, uncultured archaeon GZfos10C7
MEEEKRKEGKKHLRTINKHEPEKVASEYHSYYRGKIEIGLKAPVRSYDDFAIWYTPGVAEPAREIKNSRERVFEYTNKGNSVAIVTDGTRVLGLGDVGAEAALPVMEGKAMLFKYLGGVDAFPLCLDTSDAEDIINTVKWVAPTFGGVNLEDIESPKCYYILERLQEELGMPVWHDDQQGTALVILAGAINALKVVGKRLSEIAISLVGAGAANMNVAKYLCLAGAKEGNMVMVDSKGILNRERVEDVKQDENKRDMCEKTNREGRKGGIKEAMRDTDLCIALSTPGPGVIKKEWVVDMADDAIVFACANPVPEIWPVEAEEGGARIVATGRSDFNNQVNNSLGFPAVFRGALDVRAARITDEMCIAAANAIARYTEEGGKGISESRIIPRMEESEMYVCEAVAVGMKAIEQGVAEKGMSMKALEERVREKISDKTTKPF

SEQ ID NO: 29207 - protein, 219 aa, uncultured bacterium
NSRLCMSSTVAGYTRSLGSDGPPCCYEDLDQCSVAVLIGTNTAECHPVLFQRLLKRKKRDPKSLTIVVVDPRATDTSRIADHHLAIAPGTDLALLHGLARLIVQDNGFDSDFIDEATEGFAAYAKTIRTWTSAKVAALCGISEKELRQVARLWSRSQGVLSLWSMGVNQRREGTAVVSGIINLHLLTGQIGKPGAGPFSLTGQPNAMGGREAGGLAHLL

SEQ ID NO: 29208 - protein, 219 aa, uncultured bacterium
NSRLCMSSAVAGYTRSLGSDGPPACYDDLDHCSVAVLIGTNTAECHPVLFQRLIKRKKRHPGSVTIVVIDPRRTDTAKAADIHLPIAPGTDLALLHGIAHLVMRENGQDVAFIDDHTENYKPFFDVVARWTPRKVARFCGIPEKRLREVAELFHRKEKVLSLWSMGVNQRREGTAVVQGLINLHLLTGQISKEGAGPFSLTGQPNAMGGREAGGLAHLL

SEQ ID NO: 29209 - protein, 219 aa, uncultured bacterium
YSRLCMSSAVAGYTRSLGSDGPPACYDDLDHCSVAILIGTNTAECHPVLFQRLIKRKKRHPGSVTIVVIGPRRTDTAKAADIHLPIAPGTDLALLHGIAHLVMRENGQDVAFIDDHTENYKPFFDVVARWTPRKVARFCGIPEKRLREVAELFHRNEKVLSLWSMGVNQRREGTAVVQGLINLHLLTGQIGKPGAGPFSLTGQPNAMGGREAGGLAHLL

SEQ ID NO: 29210 - protein, 219 aa, uncultured bacterium
NSRLCMSSAVAGYTRSLGSDGPPACYEDLDHCSVAFLIGTNTAECHPVLFQRLLKRKKRNPGSVTIVVVDPRSTDTAKAADIHLPIAPGTDLALLHGLAHLVLRENGQDPAFIDDRTENYDAFFDVAARWTPRKVARFCNIPEKRLREVAELFHRRERVLSLWSMGVNQRREGTAVVGGLINLHLLTGQIGKEGAGPFSLTGQPNAMGGREAGGLSHLL

SEQ ID NO: 29211 - protein, 191 aa, Brassica napus
MNSNQVSNGFVKPVPTEEEKGKIEELRKLLGPLPEKLSGFCSDDAVLRYLRARNWHVKKAAKMLKETLKWRVQYKPEEICWEEIADEAETGKIYRSSCVDKHGRPVLIMRPSVENSKSVKGQIRYLVYCMENAIQNLPPGEEQMVWMIDFNGYSLANVSLKTTRETAHVLQEHYPERLSLAILYNPPSSLN

SEQ ID NO: 29212 - protein, 219 aa, uncultured bacterium
NSRLCMSSAVAGYTRSLGSDGPPCSYEDLDHCTVAFLIGTNTAECHPVLFQRLLKRKRKNPSSVTIVVVDPRRTDTAKAADIHLPIAPGSDLALLHGIAHLVLRDNGQDPAFIDDHTENYDAFFDVAARWTPRRVALFCNIPEKRLREVAALFHRREKVLSLWSMGVNQRREGTAVVQGLINLHLLTGQIGKEGAGPFSLTGQPNAMGGREAGGLAHLL

SEQ ID NO: 29213 - protein, 331 aa, Cucumis melo
MSPAAAPESAIESTDAPKRAYVTFLAGNGDYWKGVVGLAKGLRKVKAAYPLIVAVLPDVPEDHRQILEYQGCVVREIEPVYPPENQTQFAMAYYVINYSKLRIWEFVEYEKLIYLDGDIQVFENIDHLFAMPSGYFYAVMDCFCEKTWSNSPQYKIGYCQQCPDKVKWPVEEMGNPPPLYFNAGFFVYEPDLFTYKDLLETCKATTPTLFAEQDFLNMYFNDIYKPIPPIYNLVMAMLWRHPENIDVDKVKVVHYCAAGSKPWRYTGKEENMDREDIKMLVKKWWEVYEDESLDYQNVLKSETKQETNLTPLISVLSEAEVVNHITAPSAA

SEQ ID NO: 29214 - protein, 172 aa, Solanum berthaultii
MSWEQRLEICIGVARGLHYLHTNGVIHRDFKSTNILLDENFVAKIIDFGLSKTRTELDQTHVSTDVKGSFGYLDIEYLKRGKLTEKSDVYSFGVVLCEVVCARPAVDSSFPREQGNLAEWAMNWMKKGQLERIIDPNLLGKIRPDSLRKFGETAEKCLADSGVDRPSMGEML

SEQ ID NO: 29215 - protein, 292 aa, Solanum demissum
LNSSYRVPFESFRVPFVDLQEATNNFDEKFRIGVGIFGKVYRGVSRDGTKVALKRRNRESPQGIEEFQAEIEILSFCSHPHLVSLIGYCDERNEMILVYEYMENGNLSSHLYGSDLRLPTMSWEQRLEICIGAARGLHYLHNSAVIHRDVKSTNILLDENFVAKITDFGISKTMSELDQTHLSTTVKGSIGYIDPENFIRRQLTEKSDVYSFGVVLFEVLCARPAIVQSLPRETVCLAEWAVDSHNKGQLEQIIDPNLAAKIRPESLRKFGETAVKCLALSSEDRPSMGDVL

SEQ ID NO: 29216 - protein, 327 aa, Zea mays
  misc_feature (97)..(97): Xaa can be any naturally occurring amino acid
  misc_feature (106)..(106): Xaa can be any naturally occurring amino acid
  misc_feature (121)..(121): Xaa can be any naturally occurring amino acid
  misc_feature (140)..(140): Xaa can be any naturally occurring amino acid
  misc_feature (164)..(164): Xaa can be any naturally occurring amino acid
  misc_feature (235)..(235): Xaa can be any naturally occurring amino acid
  misc_feature (278)..(278): Xaa can be any naturally occurring amino acid
  misc_feature (302)..(302): Xaa can be any naturally occurring amino acid
  unsure (1)..(327): unsure at all Xaa locations
MASDGSGVVTVYGSNGAELLEPSKQPKSATFSVKVGLAQMLRGGVIMDVVTPEQARLAEEAGACAVMALERGPRRHPRGRAGVARMSDPGLIRDIKXRAVTIPVMXAKARIGHFVEAQILXEAVGVDYVDESEVLTPADXTRHHINKHNFRVPFRLAAGRDLGXRALRRVREGAAMIRTKGEAGTGNVVEAVRHVRSVMGDVRALRSMDDDEVFAYAKRIAAPYDLVMQTKQLGXASPVVQFAAGGCRHGPPTPALMMQLGCDGVFVGSGIFKSGDPXARRARAIVQAVTHYSDPTILADVXTGLGEAMVGINLNDPKVERYAARSE

SEQ ID NO: 29217 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCSHPHLVSLIGYCDERNEMILVYDYMENGNLRSHLYGSDLPSMSWEQRLEICIGAARGLHYLHTSAVIHRDVKPINILLDENFVAKITDFGLSKKRTELDQTHLSTLVQGTLGYLDPEYFNRGQLTEKSDVYSFGVVLFEVLCARPAIVQTPSRGMISLAEWVVESQKKGQLEQIIDPNIVAEIRPESLRIFGETAVKCLALSGEDRPSMGDVL

SEQ ID NO: 29218 - protein, 304 aa, Debaryomyces hansenii CBS767
MSSSVFHDYSGFSNATTFGEVYNNFNQIDLLNWMEKLWGSYYYYMGNDLFATGLLFFTLHEAMYFGRCIPWMIIDRIPYFNKYKIQDAKIPSNKEQWECLKSVLTSHFLVEAFPIWFFHPLCQQIGISFEIPFPDISSMLIQLAVFFVCEDAWHYWFHRALHHGVFYKYIHKQHHRYAAPFGLTAEYAHPIEVMLLGFGTVGIPIVWCLITKNLHLFTVCIWITLRLFQAVDSHSGYEFPWSLHHFVPFWAGADHHDEHHHFFIGSYSSSFRWWDFVLDTEAGPKGKSSREQKMKTKAESKKQL

SEQ ID NO: 29219 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCNHPHLVSLIGYCDERNEMILVYDYMENGNLRSHLYGSDLPSMSWEQRLEICIGAARGLHYLHTSAVIHRDVKPINILLDENFVAKITDFGLSKKRTELDQTHLSTFVQGTLGYLDPEYFNRGQLTEKSDVYSFGVVLFEVLCARPAIVQTPSRGMISLAEWVVESQKKGQLEQIIDPNIVAEIRPESLRIFGETAVECLALSGEDRPSMGDVL

SEQ ID NO: 29220 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCSHPHLVSLIGYCDERNEMILVYDYMENGNLRSHLYGSDLPSMSWEQRLEICIGAARGLHYLHTSAVIHRDVKPINILLDENFGQKLLDFGLSKKRTELDQTHLSTLVQGTLGYLDPEYFNRGQLTEKSDVYSFGVVLFEVLCARPAIVQTPSRGMISLAEWVVESQKKGQLEQIIDPNIVAEIRPESLRIFGETAVKCLALSGEDRPSMGDVL

SEQ ID NO: 29221 - protein, 265 aa, Haloarcula marismortui ATCC 43049
MDVYGLIGNPVGHSLSPPMHEAGYEALGLDARYVTFEPPADAGAEAIEAAETLGVDGLNVTIPFKQDVLDAVDPAPLAERIGAVNTVDFTGGTPTGYNTDAVGAVRALDHHDVSLSGTAVVVGAGGAGRAVAFGLADEGLSVRIANRTESKADALADEVPDASGHGLDSLSDLLANADILVNCTSVGMEEDKTPVPADALHSDLAVLDAVYTPIETRLLQDAAAAGATTVDGAWMLLYQGVEAFERWTGEDAPVDRMNGRLREHL

SEQ ID NO: 29222 - protein, 342 aa, Anabaena variabilis ATCC 29413
MTLLLAGDIGGTKTILRLVEVSNSSELHNIYEESYQSGDFPDLVPMVQQFLVKANIPSHPEKACFAIAGPVVNNTAKLTNLVWFLDTERLAQELSIPFISLINDFAAVGYGIFGLSKQDLFTLQAGKHQTEAPIAIIGAGTGLGQGFLIKQGNQYQVFPSEGGHADFAPRNELEFQLLKYLLDKHDIQRVSVERVVSGQGVVAIYQFLRDRKLAIESPEIAQVVRTWEQQAGQAEKTVDPGAAIGKAAVQGSDRLSEQTLQLFIDAYGAEAGNLALKLLPYGGLYIAGGIAPKVLPLIENSNFLLNFSQKGRMRPLLEEIPVHIILNPQVGLIGAALCAARL

SEQ ID NO: 29223 - protein, 326 aa, Triticum aestivum
MAGASSPPPTPKSPKLQPPLLERAKGPSGLDKIVLRDPRGFTAEVRLYGGQVTSWKNEQGDELLFVSSKAIFKSPGAIRGGIPICFPQFGTHGNLEKHGFARNRLWLVDDNPPPLPVNSGIKTYADLILKPSEEDLKIWPHRFEFRLRVALGPKGDLFLTSRIRNTNTDGKPFSFTFAYHTYFSVSDISEVRIEGLETMDYFDNLKGKERFTEQGDALVFESEIDKVYLDTPPKIAIIDHEKKRTFVLRKDGLPDAVVWNPWERRSKTILDFGDEEYKHMLCVEPAAVEKPITLKPGEEWKGRLELSAVPSSYYSGQLDPDKVLHG

SEQ ID NO: 29224 - protein, 469 aa, Bacillus clausii KSM-K16
MKLFINGEWVSEELDVFDVVNPATGEVVGSVPKGGAKEAKVAADGAYESLPAWAERSAYERSAILEAWHDLIAEQKEELARLMTMEQGKPINEARGEIAYANSFIKWYAEEGKRIYGETIPASSPDKRLFVVKQPVGVVAAITPWNFPAAMITRKVAPALAAGCTVLIKPASQTPLTALKLAELAEKAGLPKGVLHVVVGSTSDISKAWQEDERVRKLTFTGSTEIGRTLMSEAGQTVKKISLELGGHAPVLVFEDADIDNAVQETIASKFRNGGQTCVCANRIYVHESIAEAFITKMKQAVEQLKVGNGLNEETDIGPLIDEEAVDKVLTHIRDAKDKGAEVLTGGNSSDGLFIEPTVIAGVTDDMACMSEETFGPLAPISTFKTEEEVVKRANDTIYGLAAYLFTTDLSRGIRVAEKLDYGVVGLNDGGPSVAQAPFGGFKQSGIGREGGHEGLEEFLESKYVSLKM

SEQ ID NO: 29225 - protein, 873 aa, Wolbachia endosymbiont of Drosophila ananassae
MGEKLIHYFSQGKCEGNAEMKNLLGGKGANLAEMCNVGIPVPPGFTISTSACKVYYQDNRSSVIQVSDYSDPEKNVVTHWNDICSGIKNYMTMLENDIGCKFGDLNNPLLVSIRSGSVSSMPGMLDTILNVGLNDETVVGLAKKSGERFAYDSYCRFIMMYSNVVLQLDHHLFQDVIDNEQQKSGAKSLADLDVDVLKRIVNDFKKIVYEKTEKHFPQNVEEQLLNSVNAVFASWKNDRAVSYRRIHNIPENLGTAVNVQAMVFGNLNDNSATGVIFTRNPSTGEKKLFGEFLVNAQGEDVVSGVYTPMPIDGEQKNTMEKLLPSVYRELCVVCEKLERHYKDMQDIEFTVQDGKLWILQTRSGKRTAEAAIRIIVDMVNEGTITKEEGILRIDPKTFDNLLHPVLDVKSDQKVIGKGLPASPGVASGYVVFSASDAEKAAEQGKKVILVRSETSPEDINGMNAASGIVTARGGMTSHAAVVTRGMGKPCICSVSGLYIDKDGTFFSVGDTKVNKGEPITINGGTGEVMLGILPTISPELSQEFKTVINWIDEIKTVKVRANADTPKDAKIAKEFGAEGIGLCRTEHMFFASDRIEFIQKLIIADDENERANALIKLEEMQKSDFKEIFSIMEGREVTIRLLDPPLHEFLPNDQSTIEKIAKSLSKSVESVKNKIAQLSEKNPMLGHRGCRLAISHPEIYSMQIRAILSAASELKKEKKIEVEPEIMIPFIMSEKEFILICELAKKESSVISQTQIPASRAGMTSDKAYSIGTMIELPRAALIADKLAKHAEFFSFGTNDLTQTTMGLSRDDSVNFLDSYKKNNIFDNDPFEVLDIEGVGELIKMAIERGKKYHSFQSFYRLSSTYKTKLNFK

SEQ ID NO: 29226 - protein, 76 aa, Zea mays
  misc_feature (58)..(58): Xaa can be any naturally occurring amino acid
  unsure (1)..(76): unsure at all Xaa locations
YITHRTASAAFLGMFLVGTVFSTGSYTAFVGSCSEALKEKVPMVTEKLTWAASLVAVXVGMGLALLVGQFFGFNLY

SEQ ID NO: 29227 - protein, 86 aa, Triticum aestivum
MALGDDSPASYIRMVHHLIEKCMTFGMSMEECMEALSKRADVQPVVTSTVWKELEKENKEFFDRYNKQLRSEKEGRSSSSSSDSSS

SEQ ID NO: 29228 - protein, 219 aa, uncultured bacterium
NSRLCMSSAVAGYTRSLGSDGPPCCYEDLDHCSLAFLIGTNTAECHPVLFQRLLKRKRKNPGSVTIVVVDPRRTDTAKAADIHLPIAPGSDLALLHGIAHLVLRENGQDPAFIDDHTENYDGFFDVAARWTPRRVALFCNIPEKRLREVAALFHRREKVLSLWSMGVNQRREGTAVVQGLINLHLLTGQIGKEGAGPFSLTGQPNAMGGREAGGLSHLL

SEQ ID NO: 29229 - protein, 459 aa, Mycobacterium avium 104
MPQHPSLPAHAIAPAYTGRLFTAPVPALRMPDESMDPDAAYRFIHDELMLDGSSRLNLATFVTTWMDPEAGRLMAETFDKNMIDKDEYPATAAIEQRCVCMVADLFHAEGLNDADPYSACGVSTIGSSEAVMLGGLAMKWRWRAKTKDWKKRTPNLVMGSNVQVVWEKFCRYFDVEPRYLPMEEGRYVITPEQVVDAVDEDTIGVVAILGTTYTGELEPVADICGALDKLAARGGVDVPVHVDAASGGFVVPFLHPELKWDFRLPRVVSINVSGHKYGLTYPGVGFVVWRSKEYLPDELVFRVNYLGGDMPTFTLNFSRPGNQVVGQYYNFLRLGREGYTKVMQTLSGTARWLGEQLRVSEHCELISDGSAIPVVAFRLAKDRGYTEFDVSHELRTYGWQVPAYTMPDNATDVSVLRIVVREGLSADLARALHDDAVSALTSLDKVKPGGHYDAQHFAH

SEQ ID NO: 29230 - protein, 590 aa, Coccidioides immitis RS
MNCPSRTDNPSDNPGWNQSPPLLTADLTTRKDLNGMANMRVRKGKGTGPNGTELNPGQDIPSKSPDEDEPGAHSAGKDAHGSTVGEREVGLEEDVDNRRISSSSWPNFHGYSGGAGSGNLGKFGPRELIHRLVKTLRKFGQFIGPGFLIAVAYIDPGNYATDVAAGASTKYSLLFIIFMSNVIAVFLQSLCIKLGSVTGLNLAENCKAHLPKWLNILLYVLSEAAIIATDIAEVVGSAISLNLLFNIPLVAGCAITLVDVMVILIFYKPHGTMRALRAFEFFVMALVFGVVGCFCVQLSLIKESSVGEIFKGYLPSEAIVKDNGCGILGATVMPHSIFLGSGVVQSRLREYDINRGYIDPSVQYGNTYEDKYRPTVHAIRGCLKYSVLELVLSLFTFALFVNSSILIVAGASLSGSEASDADLFGIHRLLSETISPAAGTVFAIALLLSGISAGIVCTIAGQMVSEGMLNWSVAPWLRRLITRSISIIPSVIIAAAVGKEGLNAALTASQVVLSAMLPFVSAPLIYFTSRSRYMTVEAGLMTGNSNPEGQEVKGVSMKNNWLVTILGVLIWIAITVLNIALLVLVGMGKA

SEQ ID NO: 29231 - protein, 219 aa, uncultured bacterium
NSRLCMSSAVAGYTRSLGSDGPPCSYEDLDHCTVAFLIGTNTAECHPVLFQRLLKRKRKNPSSVMIVVVDPRRTDTAKAADIHLPIAPGSDLALLHGIAHLVLRENGQDPAFIDDHTENYDAFFDVAARWTPRRVALFCNIPEKRLREVAALFHRRQKVLSLWSMGVNQRREGTAVVQGLINLHLLTGQIGKQGAGPFSLTGQPNAMGGREAGGLAHLL

SEQ ID NO: 29232 - protein, 373 aa, Synechococcus elongatus
MARDFYEILGVSRSADAEELKRAYRRLARKYHPDVNKEPGAEEKFKEINRAYEVLSDPQARANYDRFGEAGVSGVGAAGFSDFGIGDMGGFADIFETFFGGFTTSSRRQQGPTRGEDLRYDLKLEFREAVFGGEKEIRINHLETCKTCQGTGAKPGTRPVTCSTCGGVGQVRRSARTPFGSFTQLTTCPTCGGSGVVIEDRCESCGGQGHIQVSKKLKITIPAGVDNGTRLRVSGEGDAGLRGGPPGDLYVYLFVQPDPEFQREGNNILSRIKISYLQAILGCRISVSTVDGEAELKIPAGTQPGTVLVLEGRGVPRVGNPVARGDHLITVDVEIPTHITHEERELLEKLAKIRGERLGKGGLEGFLGSLFGG

SEQ ID NO: 29233 - protein, 255 aa, Nostoc sp. PCC 7120
MDWKEIRGNWVLVPRNPVGIIHFLGGAFVATAPHLTYRWLLEQLGNKGYVVIATPFVNTLDHIAIANSVLLNFERTIERLHDSGALRKLYLPTYGIGHSMGCKLHLLIGSLFPVERAGNILISFNNYAAKDAIPLVEQFNTTLAIEFTPSPLETNKLVQESYNVRRNLLIKFNNDNLDQSAALTKILQVRFPEMVTAQTLPGTHTTPLGQDVKWQTGSSFTPFDALGQWFKQEVYRDLNQLNRAMLLWLNPLSPP

SEQ ID NO: 29234 - protein, 219 aa, uncultured bacterium
NSRLCMSSAVAGYTRSLGSDGPPCSYEDLDHCTVASLIGTNTAECHPVLFQRLLKRKRKNPGSVKIVVVDPRRTDTAKAADIHLPIAPGSDLALLHGIAHLVLRENGQDPAFIDDHTENYDAFFDVAARWTPRRVALFCNIPEKRLREVAALFHRREKVLSLWSMGVNQRREGTAVVQGLINLHLLTGQIGKQGAGPFSLTGQPNAMGGREAGGLAHLL

SEQ ID NO: 29235 - protein, 219 aa, uncultured bacterium
NSRLCMSSAVAGYTRSLGSDGPPSCYEDLDHCSVAFLIGTNTAECHPVLFQRLLKRKKRNPGSITIVVVDPRRTDTAKAADIHLPIAPGSDLALLHGIAHLVLRENGQDSAFIDDHTENYDAFFDIAARWTPRRVARFCNIPEKRLRDVAQLFHRRERVLSLWSMGVNQRREGTAVVQGIINLHLLTGQIGKEGTGPFSLTGQPNAMGGREAGGLSHLL

SEQ ID NO: 29236 - protein, 219 aa, uncultured bacterium
NSRLCMSSAVAGYTRSLGSDGPPCSYEDLEHCTVAFLIGTNTAECHPVLFQRLLKRKRKNPGSVKIVVVDPRRTDTAKAADIHLPIAPGSGLALLHGIAHLVLRENGQDPAFIDDHTDNYDAFFDVAARWTPRRVALFCNIPEKRLREAAALFHRRQKVLSLWSMGVNQRREGTAVVQGLINLHLLTGQIGKQGAGPFSLTGQPNAMGGREAGGLAHLL

SEQ ID NO: 29237 - protein, 545 aa, Methanosarcina acetivorans C2A
MPVITLHYEDLEKLTGTDKETIIKRVPMIGADIERVEDEYVDIEFFPDRPDLYSVEGAARAMRGFLDLETGLPEYAIKPYEVSISVSENILKIRPFLGCAVVRGVKFTSSSIKSLMDLQEDLHWGLGRNRKKVSIGVHDLKNVQPPFRYMAVDPSFEFVPLDYTEKMSMTDILEKHPKGTRFAHLVKDFEKYPIILDANDNVLSFPPIINGTLTTVTEQTTDLFIDVTGLGEAVYIALNIVVTALAERGGQIEFVRVIRPGGEELVLPDLEPKERLLTTGEVKALMGMDLTVEEIVKQLERMRFGAAALDKEAVEVKVPAYRADILHNYDLVEDIAKGYGYENIKVKVPETYTPGKSHPISLMRASVNEIMVGLGYYEVMPFTLTSEKINFENMCRPKTDDVTYVLHPISEDQTMIRTTVLPNLLEILSLNQHRELPQKIFEFGEVVSNETTGQHVAAVSIHPQANFTEVYEVVDALMREMMLPYEVKESEDPAFLEGRRADVYVNGKKLGVFGEFHPEVISNFALGYAVVGFELDLNDLIGKKI

SEQ ID NO: 29238 - protein, 210 aa, Symbiobacterium thermophilum IAM 14863
MRTGQVLMQAYMNEEALRLTLETGYAWYWSRSRQELWQKGGTSGHVQRVREIRTDCDGDSLLLLVEQEGVACHEGTYSCFTRRVDGSPKALIDTAFWPIQPDDTVPYDIGSILRELTAVLAERRAHPDPESYTSRLFRRGPDAYCKKIGEEATEVVLAVKNRDRENLAFEVADLWFHSLVALVDQGLSPADVADQLASRRGRRREQQKEE

SEQ ID NO: 29239 - protein, 302 aa, Lactobacillus sakei subsp. sakei 23K
MKKVIVLGSTNVDTILNVQRFPQPGETLAMDGRAVAGGGKGANQAIAAVRSGAQTAFISKVGKEGAADFMIDTFKKDGMNVDHVRCSETAGTGQAYIMVDAHGQNSILIYGGANQDVTVEDVHEAETAIKAADRIVAQFEVPIPAIIEAFKIARANGVQTILNPAPAIKNIPTELLAVTDMIVPNETEAEIITGIKVTDEASMQANAEAMFKLGIKVVIITVGSKGSFYATPTATGFVPAFKVNAVDTTAAGDTFIGALSTKLELDYSNIEAAMTYANKASSIAVQTKGAQNSIPYEKDIQL

SEQ ID NO: 29240 - protein, 441 aa, Anabaena variabilis ATCC 29413
MRNRRVVIVGAGFGGLQAAQSLANSGADVLLIDRHNYHTFVPLLYQVATGQIEPEYIAYPIRTILRRFSFNYRRQHQKPQVQFLMAEVEQIDFSGQIVKTAKGAIDYDFLVLATGSRTQFWGVSGAEEYAFPMRSLEEAVALRNHIFSCFEQAIQESDAAKRRQLLTFTIVGGGATGVEMAGALVEMLRGCLRRDYPTIGFGEVKIILVQSGDRLLVEFPKKLGNYTYKKLHQLGVEVYLQTRVSQLTQGFVHLENAEIIPSASVIWTAGLEANLPGVLEELPVAHKGKIVVHPTLQALEHPNVYAIGDLAYVEKNGKSLSGVAPEALQQGVAVARNIQQQIRGKSPKPFNYFNKGRLAIIGCYSGVGKIGAFAFTGFLAWLMWLGVHLVYLPGYRSRLLVLLTWVHTYLGSDRHVRVILSSKTMSVQHRLADLPYLQESR

SEQ ID NO: 29241 - protein, 293 aa, Anabaena variabilis ATCC 29413
MDLYSSIFRCFCIVEAQVNSYMTNTVIITGASQGIGKATALLFARQNYNVVLAARQPDRLEAIATEIRELGQEAIAIPTDVKDATQVNNMIQKAIAHFGQVDVLINNAGIFCLGSVENFSLEDRHQIIDTNLWGYIHTIYAILPYFLQRCAGTIVNVSSIGGLEPIPYHVPYTASKYAITGLTKSLHAELSPKGIHVSGIYPSFISTQLMERAIFRGKDEEIAQARTELVGKAIQMPVLEKPEDVAKAIWSAVKNKRSDVVVGSANFWKAAYQLTPSLIQSLVRRVFGMEERK

SEQ ID NO: 29242 - protein, 229 aa, Lactobacillus sakei subsp. sakei 23K
MAKLVFIRHGQSEWNLSNQFTGWVDVNLSEEGVRQAQNAGALLKKEGILFDQAYTSVLTRAIKTLHYALEGSDQLWIPETKSWRLNERHYGALQGQNKAEAAEKWGDEQVHIWRRSYDTLPPLLDASDEGSAANDRRYAHLDPKAIPGGENLKVTLERVIPFWEDEIAPKLIDGQNIIVAAHGNSLRALTKYIENISDEDIMDVEMATGEPVVYDLDENLNVVSKKKLN

SEQ ID NO: 29243 - protein, 208 aa, Symbiobacterium thermophilum IAM 14863
MTDCSRNETGALAERVGQVARKTRETDIAVTWRLDGAGRADVDTGVPFFDHMLDQIARHSLTDLTARAVGDLEIDAHHTVEDTGIALGQALRRALGDGRSIRRYGSAFVPFDETLAFAAVDVSGRPYLVFDAALPAQKVGNFDTELAEEFFRALAMNAGITLHLKVHYGRNTHHMIEGLFKAFARALGDAVARDPRVLGVPSTKGALF

SEQ ID NO: 29244 - protein, 1137 aa, Mycobacterium avium 104
MFVTGDSIVYSASDLAAAARCEFALLRDFDAKLGRGPAVTVEDDLLIRTATLGAEHERRELARLRERFGDAVAVIGRPAYTPAALTAASEATRRAVADRAPVIYQAAMFDGRFLGFADFLVRDGERYQVVDTKLARSEKVTALLQLAAYADALAAAGVPVAPEAELRLGDGTAVRHRVCDLVPVYRSARARLQRLLDEHRAGGAAVRWDDENVTACFRCAVCVEQLRATDDVLLVAGMRVSQRDKLFDAGISTVAELAAHRGPVPELAAGVVAKLTAQAKLQVRERETGVPQVEIVDPQPLALLPEPDPGDLFFDFEGDPLWTADGREWGLEYLFGVLEAGPSGRFRPLWAHNRSEERKALTDFLALVANRRRRRPNMHIYHYAPYEKTALLRLAGRYGVGEDQVDELLRSGTLVDLYPLVRRSIRVGADSFSLKALEPLYMGSRLRAGEVTTAAGSITSYARYCELQADGRADEAVAVLKEIEDYNHYDCRSTQELRNWLMLRAYESGVLPVGAQPVGDGNTVDDRDELVATLSAFTGAAGIDERTPQQTAVALLAAARGYHRREDKPFWWAHFDRLNFPIDEWADNTDVFVAEQASVCVDWQTPARARKPQRRVRLRGELARGELRTEVFALYDPPAPPGMTDNPDRRGAGRATVVEADDPALPTEVVVLERVTSDGKPFHQLPFALTPGPPIPTTALRDSIEATVAAVAAGLPRLPDSAVVDVLLRRAPRTRSGAALPRSADTVADIASALTDLDSSYLAVHGPPGTGKTHTAARVIVRLVAEHRWRVGVVAQSHATVENLLDCVIDAGLDPRRIAKKRYDRQAPRWQEIDGNAYAAFLADTPGCVIGGTAWDFANANRIPPGSLDLLVIDEAGQFCLANTIAVAPAAANLLLLGDPQQLPQVSQGTHPEPVDTSALDWLVDGQRTLPDERGYFLDRSYRMHPAVCAAVSALSYEGRLHSDACTAARRLDGCPPGVRLLSVDHQGNSTESPEEADAIAAAVTGLLGASWTDEHGTRALTASDVLVLAPYNAQVALLRRRLGSAGLDGVRVGTVDKFQGGQAPVVFISMTASSVDVVPRGISFLLNRNRLNVAVSRAQYAAVIVRSPTLTEYLPGTPAGLIELGAFLALTQPDLR

SEQ ID NO: 29245 - protein, 86 aa, Symbiobacterium thermophilum IAM 14863
MPFSIYVGNLPWSTTPEDLRALFEPYGEVENARIITDRETGRSRGFGFVDMADEEAARRAIAELHNYEYGGRPLTVNEAQARQGGM

SEQ ID NO: 29246 - protein, 647 aa, Glycine max
MASLHANVTSVVCKSGNHASQSKFTSSSFLPGFDVVGRASNAWKKELVPSSISLVPRATLTFDPPTTNSDKTKQRKHTVDPASPDFLALPSFEQCFPKSTKEHREVTHEETGHVLKVPFRRVHLSGEEGHFDTYDTSGPQNVNPRTGLPQLRKEWVDRREKLGYPRFTQMYYAKQGIITEEMLYCATRENLDPEFVRSEVARGRAIIPSNKKHLELEPMIVGRNFLVKVNANIGNSAVASSIEEEVYKVQWATMWGADTAMDLSTGRHIHETREWILRNSAVPVGTVPIYQALEKVNGIAEDLNWEVFRDTLIEQAEQGVDYFTIHAGVLLRYVPLTARRMTGIVSRGGSIHAKWCLAYHKENFAYEHWDEILDICNQYDVALSIGDGLRPGSIYDANDTAQFAELLTQGELTRRAWEKDVQVMNEGPGHIPMHKIPENMQKQLEWCSEAPFYTLGPLTTDIAPGYDHITSAIGAANIGALGTALLCYVTPKEHLGLPNRDDVKAGVIAYKIAAHAADLAKGHPYAQAWDDALSKARFEFRWMDQFALSLDPMTAMSFHDETLPADGAKVAHFCSMCGPKFCSMKITEDVRKYAEEHGYGTDEALQRGMDAMSAEFQAAKKTISGEQHGEAGGEIYLPEEYVSSKRT

SEQ ID NO: 29247 - protein, 219 aa, uncultured bacterium
NSRLCMSSAVAGYSRSLGSDGPPCSYDDLDHCSVAFLIGTNTAECHPVLFQRLLKRRKRNAGSVKIVVVDPRCTDTAKAADIHLAIAPGSDLALLHGLAHLVLLNGGQDQAFIWDHTDNFDDFSNVVSRWTPTLTAQFCGIPERDLREVADLFHRQERVLSLWSMGVNQRREGTAVVGGLINLHLLTGQIGRQGSGPFSLTGQPNAMGGREAGGLSHLL

SEQ ID NO: 29248 - protein, 219 aa, uncultured bacterium
NSRLCMSSAVAGYTRSLGSDGPPCSYEDLDHCSVAFLIGTNTAECHPVLFQRLLKRKRKNPGSVKIIVVDPRRTDTAKAADIHLPIAPGSDLALLHGIAHLVLRENGQDPAFVDDRTENYDAFFDVAARWTPRRVARFRNIPEKRLREVATLFHRREKVLSLWSMGVNQRREGTAVVQGLINLHLLTGQIGNEGAGPFSLTGQPNAMGGREAGGLAHLL

SEQ ID NO: 29249 - protein, 337 aa, Nostoc sp. PCC 7120
MKVRVGINGFGRMGRLALRAAWDWPELEFVHINEIKGGAVAAAHLLKFDSVHGRWTPEVEAEGERVLIDGTPLSFSEYGKPDDVPWEDFGVDLVLECSGKFRTPATLDPYFKRGVQKVIVAAPVKEEALNIVMGVNDYLYEPEKHHLLTAASCTTNCLAPVVKVIHEGLGIKHGIITTIHDNTNTQTLVDAPHKDLRRARATSLSLIPTTTGSATAIALIYPELKGKLNGIAVRVPLLNASLTDCVFEVTRPTTVEEINALLKAASEQAPLQGILGYEERPLVSIDYKDDPRSSIIDALSTMVVDETQVKILAWYDNEWGYVNRMVELARKVALSLK

SEQ ID NO: 29250 - protein, 219 aa, uncultured bacterium
NSRLCMSSAVAGYTRSLGSDGPPCSYEDLDHCTVAFLIGTNTAECHPVLFQRLLKRKRKNPGSVKIVVVDPRRTDTAKAADIHLPIAPGSDLALLHGIAHLVLRENGQDPAFIDDHTENYEAFFDVAARWTPRRVALFCNIPEKRLREVAALFHRREKVLSLWSMGVNQRREGTAVVQGLINLHLLTSQIGKQGAGPFSLTGQPNAMGGREAGGLAHLL

SEQ ID NO: 29251 - protein, 370 aa, Arabidopsis thaliana
MGKGGMSQGEGSKVEEENMAAWLVGINTLKIQPFLLPSVDLCSFKGPHDVRVRMKAVGICGSDVHYLKTMRCADFVVKEPMVIGHECAGIIEEVGEEVKHLVVGDRVALEPGISCWRCNLCREGRYNLCPEMKFFATPPVHGSLANQVVHPADLCFKLPENVSLEEGAMCEPLSVGVHACRRAEVGPETNVLVMGAGPIGLVTMLAARAFSVPRIVIVDVDENRLAVAKQLGADEIVQVTTNLEDVGSEVEQIQKAMGSNIDVTFDCAGFNKTMSTALAATRCGGKVCLVGMGHGIMTVPLTPAAAREVDVVGVFRYKNTWPLCLEFLTSGKIDVKPLITHRFGFSQKEVEDAFETSARGSNAIKVMFNL

SEQ ID NO: 29252 - protein, 219 aa, uncultured bacterium
NSRLCMSSAVAGYTRSLGSDGPPCSYEDLDHCTVAFLIGTNTAECHPVLFQRLLKRKRKNPGSLKIVVVDPRRTDTAKAADIHLPIAPGSDLALLHGIAHLVLRENGQDPAFIDDHTENYDAFFDVAARWTPRRVALFCNIPEKRLREVAALFHRREKVLSLWSMGVNQRREGTAVVQGLINLHLLTGQIGKQGAGPFSLTGQPNAMGGREAGGLAHLL

SEQ ID NO: 29253 - protein, 220 aa, Brassica napus
MMISDLPRDMVEEVLCKLPMTSLRRARFTCKRWNNTLSKDWRFTRKYNGEAAKRKEFQVVMILEYKVYLMSVNLHNPSPSIEPIGKLHDAGVDIINVFHCQGLLLCVTKDGTRLVVWNPFTGQTRWIKPRDSYHRCDRYALGYENRNNYPLKVLRFVDDYDRNLKRRVYKFEIFNLNSSPWKVVDFNPDWDYTVFFYRGLVFQGQYFTGFAEKLGCTQAK

SEQ ID NO: 29254 - protein, 219 aa, uncultured bacterium
NSRLCMSSAVAGYTQSLGSDGPPCCYDDLDHCKVAFLIGTNTAECHPVLFQRLLKRKKRNPGSLKIVVVDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 29255 - protein, 144 aa, Zea mays
MSHRVSILSSHLSPVMASEKEAALAGTPSDSPTIFDQIISKEIPSTVVFEDDKALAFRDITPQGPVHILLIPKVRDGLTGLSKAEERHIDILGRLLYTAKLVAKQEGLDEGFRIVINDGPQGYQSVYHIHVHLIGGRQMNWPPG

SEQ ID NO: 29256 - protein, 515 aa, Oryza sativa (japonica cultivar-group)
MGIVRAAEDVEGAVVAGAAGGGGGGGGGEVTAPLLLRQHKQGRGDEEKIQNDAGGDGGGRRGGGGGGSMSMLMLSTAVAVCGSFEFGTCVGYSAPTQSGIVDEVGLSISQFALFGSVLTIGAMIGAVTSGRLADFLGRKMTMRISATICIFGWLSLHLAKGVIMLYFGRILLGFSTGILSYVVPVFIAEIAPKNLRGGLATSNQLLICSGSSATYIIGALVAWRNLVLVGIVPCVLLLTGLLFIPESPRWLANVGREKEFHASLQMLRGEDADVSEEAVEIKEYIESLHRFPKARVQDLFLRKNIYAVTVGVGLMIFQQLGGINGVGFYASSIFTSAGFSGKLGTILIGIIQIPITLFGAILMDKSGRRVLLMVSASGTFLGCFLTGISFYLKAQGLFSEWVPELALTGILVYIGAYSIGMGPVPWVVMSEIFSIDMKAIGGSLVTLVSWLGSFAISYSFSFLMDWSSAGTFFMFSAASLITILFVVMVVPETKGRTLEEIQDSLIDSRSRLRDP

SEQ ID NO: 29257 - protein, 176 aa, Solanum sucrense
TMSWEKRLEICIGIARGLHYLHTGYAKAVIHRDVKSANILLDESFMAKVADFGLSKTGPELDQTHVSTAVKGSFGYLDPEYFRRQQLTEKSDVYSFGVVLFEVLCARPVIDPSLPREMVNLAEWAMKWQKLGQLEQIIDSNLEGKIRPDSLRKFAETAEKCLADFGVDRPSMGDVL

SEQ ID NO: 29258 - protein, 497 aa, Methanosarcina acetivorans C2A
MCGIAGVFGTPDSNLKVKKMLAALGHRGPDACGIHTAGDLSIGNTLLKITGDMPQPLTGKGALVLNGEIFNFRELAAEIGIKIDSDTELLFSLIETGVKEGSTPIDAVCSALSKVNGDYALAYACGGELVLARDPSGVKPLFYCSGTEGEKPEIAFASEKKALAFISRKAKPFPQGGILGFNTESGKITEKIPEGYLEIKSPEKRIYTEHEALSQLKETLEKAVELRLTPTTGIAFSGGIDSTFLAALAKRIDPGVSLYAVGLPDSHDITQAERAAEAIGMRKNLKVHFLSPEEIEAAVPRVVYATESTDPMTVAIGIPLYIVAKTAKEDGKRVLLTGQGADELFGGYRRHEEFLKKGAEVLDREIYSDLATISKINLERDDMVTMANSVELRVPFLDKEVIKTGLAIRPELKVLKKDGYYEDGYYERKYILRKAAKGLIPPEILWKEKKAMQYGTGVQKVLDRLARDSGFSKKQESHIEKYLMQIASEKGFEFVNN

SEQ ID NO: 29259 - protein, 418 aa, Candidatus Kuenenia stuttgartiensis
MGKLKNEYFLKHIGDHGAEVYDSTIDFIHSLKKQGCKTAIISSSRNCAMILDSTNLSSLFDVRVDGLDSEVLGIKGKPAPDIFLEAARQLKAKPERAVVIEDAISGVQAGKAGKFRLVVGVARTGDKESLLENGADVVVEDLSEIGVRNDIEVIHGLPSALDSIDDIANQARGKRIAVFLDYDGTLTPIVETPDKAIMAEDMREAVIKLSNNCTVGIISGRDLKDVQEKVEIDSFVYAGSHVFDIAGPEGLNIKSQAGAEFLPVLDKAEKELSEKLRSIEGVFVERKKFAIAIHYRLVTPEKAELVDEIVDKVASVYPELRKAYGKKIFELQPDIDWHKGKALLTLLKALKLDGDDVLPFYIGDDVTDEDAFWTLKGSGIGIVVWDEPYETAASYSLKNPEEVRKFLLKLIPLGGGHE

SEQ ID NO: 29260 - protein, 198 aa, Solanum sucrense
VPFESFRVPFVDLQEATNNFDEKFHIGLGGFGKVYRGVLRDGTKVALKRYTPESNQGLQEFQTEIEILSFCSHPHLVSLIGYCDERNEMILVYDYMENGNLRSHLYGSDLPSMSWEQRLEICVGAARGLHYLHTSAVIHRDVKPINILLDENFVAKITDFGLSKKRTELDQTHLSTLVQGTLGYLDPEYFNRGQLTEK

SEQ ID NO: 29261 - protein, 381 aa, Ashbya gossypii ATCC 10895
MSETQGKPIQCTAAVAYAAGEPLRIEKVTVDPPKAHEVRIKIVNSAICHTDAYTLSGSDPEGLFPCILGHEGSGIVESVGEGVTNVKPGDHVVPLYTAECQQCKFCVSGKTNLCGAVRATQGKGVMPDGTSRFRNGKGETLYHFMGCSTFSEYTVVADVSVVAVDQQAPLETVCLLGCGVTTGYGAAVKTADVQEGDTVAVFGAGTVGLSVVQGAKARNASRIIVVDINDAKREWASKFGATDFINPKTDLKEGETIVARLIEMTDGGLDHTFDCTGNTKVMRDALEACHKGWGQSIIIGVAAAGQEISTRPFQLVTGRVWKGSAFGGIKGRSEMGGLVRDYLNGTLKVQEFVTHKRPFEEINSGFEDLHHGDCLRTVLSL

SEQ ID NO: 29262 - protein, 515 aa, Anabaena variabilis ATCC 29413
MLNRNKHISQVVVTAAQMRDIEARIFAAGMPVSALMEKVAGLIAKRIQEIWEPSNHVGILTGPGHNGGDGLVVARELHFRGYDVWIYLPFDKLKELTSQHLQYAQSLGIPCYQEIEQLPDCDFLVDGLFGFGLEREITDPIASVINQLNEWNKPIISIDLPSGLHTDTGEVLGTAIRANYTLCLGLWKQGLLQDQALDYIGKAELIDFDIPWADVQAVLGDVPKVKRITPTTALSTLPLPRPPVTHKYKEGHLLLICGSRRYAGGAILTALGARGSGVGMLSIAVPESLKQLLVSHLPEALVIGCPETETGAIAQLQLPENTNLSSFSAIACGPGLTKDAISIVQEVLASDRPLVLDADGLNILAQLGTILTLQQRQAATVLTPHTGEFHRLFPDIADAKGDRVKAVQEAAAQSGAVVLLKGARTAIANPQGSVWINPESTPALARGGSGDVLTGLLGGLLAQAVNKAIPVEDIVATAAWWHGQAGILAASERTELGVDAFTLSQYLLKVIVGRS

SEQ ID NO: 29263 - protein, 204 aa, Solanum sucrense
LNSSYRVPFESFRVPFVDLQEATNNFDEKFHIGLGGFGKVYRGVLRDGTKVALKRYTPESNQGLQEFQTEIEILSFCSHPHLVSLIGYCDERNEMILVYDYMENGNLRSHLYGSDLPSMSWEQRLEICVGAARGLHYLHTSAVIHRDVKPINILLDENFVAKITDFGLSKKRTELDQTHLSTLVQGTLGYLDPEYFNRGQLTEK

SEQ ID NO: 29264 - protein, 297 aa, Magnetospirillum magnetotacticum MS-1
MPGDDAHIMYVWLDALTNYITAVGYPDTTGDFARYWPNVIHMVGKDIVRFHAVYWPAFLMAADLPAPRRVFAHGWWTNEGQKISKSVGNVIDPLSLIETYGLDQVRYFLLREVPFGNDGDFSHRAMMGRMNSELANDYGNLVQRSLSMIGKNCSGVTPAHSPDTDDDKEMLGAAYAMLAKVRDSMDRQMYHEAIEAIWVVIRAANGYVDKQAPWALKKTDPARMGTVLWVLAETIRCLGLLTQPFMPAASARILDQLMVPEAERSFAFFGPAHALKAGITLPTPQGVFPRYVEETAS

SEQ ID NO: 29265 - protein, 434 aa, Methanocaldococcus jannaschii
  misc_feature (69)..(69): Xaa can be any naturally occurring amino acid
  unsure (1)..(434): unsure at all Xaa locations
FLGNDTVEIKDGRFFIDGYDAIELAEKFGTPLYVMSEEQIKINYNRYIEAFKRWEEETGKEFIVAYAYXANANLAITRLLAKLGCGADVVSGGELYIAKLSNVPSKKIVFNGNCKTKEEIIMGIEANIRAFNVDSISELILINETAKELGETANVAFRINPNVNPKTHPKISTGLKKNKFGLDVESGIAMKAIKMALEMEYVNVVGVHCHIGSQLTDISPFIEETRKVMDFVVELKEEGIEIEDVNLGGGLGIPYYKDKQIPTQKDLADAIINTMLKYKDKVEMPNLILEPGRSLVATAGYLLGKVHHIKETPVTKWVMIDAGMNDMMRPAMYEAYHHIINCKVKNEKEVVSIAGGLCESSDVFGRDRELDKVEVGDVLAIFDVGAYGISMANNYNARGRPRMVLTSKKGVFLIRERETYADLIAKDIVPPHLL

SEQ ID NO: 29266 - protein, 464 aa, Solibacter usitatus Ellin6076
MPYDLIVIGSGPGGYSAAIRAGQYGLKTALIEKQPRLGGTCLLVGCIPTKSLLHTADVWDHFVHAEADGIVAENPRLDFPKVQARKDGIVSKHSKGVEFLLKRAKVERISGYATIKGGGKIEVKTDAGVQTLEARNIIIATGSEARMLPGMQPDPEFILTNIEILNLAAVPKSLIIIGAGAVGVEFASIFKRFGTDVTVIEMLPRIVPVEDEDISKELERVFKKQKIRVETGARAENIQKTGTGVKLTLTTKDGKQEQLEAEKLLVAVGRKPNTDAIGLENTKVQLDRGFIKVDQYQQTGEPGVYAIGDVVAGTPQLAHVATREGMIAVAHMAGKPAVPINKNRIPGATYTTPGIGSVGLTEAQARAQGYQVKVGKFPFAGDSRATILGQHEGFIKVVADEKYGEILGVHIIGPDGFELIAEAVAAMEAEATVDVMMQTIHAHPTLYEAVGEAFNAVYGLSINA

SEQ ID NO: 29267 - protein, 219 aa, uncultured bacterium
NSRLCMSSAVAGYTRSLGSDGPPCSYEDLDHCTVAFLIGTNTAECHPVLFQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 29268 - protein, 442 aa, Solibacter usitatus Ellin6076
MTDVVMPQMGESIVEGTLTKWLKKPGERIERDEPLFEISTDKVDTEIPSPAAGTLAEVLVEEGKTVGINTVVARISEGGSADGGAAAAKPVAAPAPPPPAAAAPPAAQAPVAPPPPPVQAAPPPPPAEAESPSGPLSPLVKKMAREMNLDLAQVKGTGAGGRITKQDVEAYVAAGKPAAAPPSPAPAATPVQAAAPAPTPAPAMAPLAPAGQAKTRIEPMSTMRIKIAEHMVMSKRTSPHVTTIHRVDMTKVAKMRERFKAQFQANYGFGLTYLPFITRATVAGLRQYPLLNASLDGNNIIYHNEIHIGIAVALENGLIVPVVRSADEKNVLGLQRSIVDLAARARSRQLKPDEIQGGTFSITNFGSFGSLVGTPVINQPQVAILGVGTVDKTPVVIDDAIAIRSICHLSLSFDHRLIDGALADQFMTKVKQVLENWSEEVL

SEQ ID NO: 29269 - protein, 219 aa, uncultured bacterium
NSRLCVSSAVAGYTRSLGSDGPPCCYDDLDHCSVAFLIGTNTAECHPVLFQRLLKRKKRNPGSVTIVVVDPRRTDTAKAADIHLPIAPGSDLALLHGIAHLVLRENGQDPTFIDDHTENYEAFFDVVARWTPRRVARFCNLPEKRLREVAQLFHRRENVLSLWSMGVNQRQEGTAVVCGLINLHLLTGQIGKEGAGPFSLTGQPNAMGGREAGGLSHLL

SEQ ID NO: 29270 - protein, 206 aa, Nicotiana tabacum
VRLATRSLQYEARERPNAKSLVNSLMTIQKETEVPSHVLLGIRHGTATPPQPLLLTTTGEACLRMDLTALHEILQETGYKDDEGIANELSFQMWTNQMQETLNSKQQGDAAFRAKDSITAIECYTQFNDGGTMVSPTIYARRCLCYLMSDMAQEALGDAMQAQVISPEWPTAFYLQSVALFSLGMENDAQEALKQATKLEAKRNKN

SEQ ID NO: 29271 - protein, 219 aa, uncultured bacterium
NSRLCMSSAVAGYTRSLGSDGPPCSYEDLDHCAVAFLIGTNTAECHPVLFQRLLKRKKRHPGSVTIVVVDPRQTDTAKAADIHLAVAPGSDLALLHGIAHLVMRENGQDPTFVDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 29272 - protein, 425 aa, Oryza sativa
MPATDSSSAAAPLTSFGRSFLSHRRDQIPPPPPDHHSHSHTQHPSSSDLEIDAFHRHAADLLHDLLSDSNSDPSAPDLLSLAWTRRLLDSFLICLEEFRAILFALADSQPLSRPPLDRLLLDFLDRAVKALDLCNALRDGLDLIRQWRKHLAIAAAALAPAPAAQRGEAQIRRARKALTDLTILMLDDKDAGGVVGQRNRSFGRAGTTRDSLPHGHGHHRRSSSGGSSGSGSGSHLRSLSWSVSRTWSAARQLQAIGGGLTVPRANDIAATGGLASAVYAMGAVLFVVTWALVAAIPCQDRGLQAHLTAVPRTFPWAGPLITLFDRILDESKKKDRKHSCGLLKEIHQIERCSRQLMEVTDAAEFPLADDKDSEVQEATQELVQVCGSLKDGLDPLERQVREMFHRVVRTRTEILDYLSRPHNAG

SEQ ID NO: 29273 - protein, 219 aa, uncultured bacterium
NSRLCMSSAVAGYTRSLGSDGPPCSYEDLDHCTVAFLIGTNTAECHPVLFQRLLRRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGFSHLL

SEQ ID NO: 29274 - protein, 290 aa, Solanum tuberosum
LNSSYRVPFESFRVPFVDLQEATNNFDEKFHIGLGGFGKVYRGVLRDGTKVALKRCKRESSQGIEEFRTEIEILSFCSHPHLVSLIGYCDETNEMILVYDYIENGNLRSHLYGPDLPTMSWEQRLEICIGAARGLHYLHTSAVIHRDVKSINILLDENFVAKITDFGISKKGTELDQTHLSTLVQGTIGYLDPEYFIRGQLTEKSDVYSFGVVLFEVLCARPAIVQSLPREMVNLAEWAVDSHNKGHLEQIIDPDLAAKIRPESLRKFGETAVKCLALSSEDRPSMGDVL

SEQ ID NO: 29275 - protein, 262 aa, Coprinopsis cinerea okayama7#130
MLLPTQMRLAQIVEMIHVALLLHQNISDASKSPSSDSQNPFGNKLSILGGDFLLGRASTVLSHLGGGEVVELIASVISNLVEGEFLGMDKVQTPGLGVMEGPRTREEAWDLYLRKTYLKSASLMAKGARASVVLGGCGENEVWKEVAYAYGRSLGIAYQLIEDTLDYDACSPGLQPGLATAPVLYALEEHPELKHLIARNLTGTGDIEAAIQCVQQSSGVERTRLLAHAYAEKARETLQRLPDSDTKLALEGLTETVITRTW

SEQ ID NO: 29276 - protein, 290 aa, Solanum tuberosum
LNSSYRVPFESFRVPFVDLQEATNNFDEKFHIGLGGFGKVYRGVLRDGTKVALKRCKRESSQGIEEFRTEIEILSFCSHPHLVSLIGYCDETNVMILVYDYIENGNLRSHLYGPDLPTMSWEQGLEICIGAARGLHYLHTSAVIHRDVKSINILLDENFVAKITDFGISKKGTELDQTHLSTLVQGTIGYLDPEYFLRGQLTEKSDVYSFGVVLFEVLFARPAIVQSLPREMVSLAEWAVDSHNKGQLEQIVDPDLAAKIRPESLRKFGETAVKCLALSSEDRPSMGDVL

SEQ ID NO: 29277 - protein, 714 aa, Aspergillus oryzae
MATPTNDLNARTPTGSNGPPPMRIRRPKAADPLVRPKKKLAAKPGISVSGNGPALKSVSSRPATSNPLSMPHPDRGKPSSSGADFSANGFSGPLLSETYTDYPLVTTKRALREGLKHHIARFASKKTVDPRDESQFTRPVRLQRRDPRARSHEMTSEKSQGMQKTMSESSHQMDEVEREELEARKAAREKERAENLAQIAPSTGSAPKRANVPKQKTQQVSKTDMTPEEMAKTRIKYEEALPWHLEDFDNKNIWVGNYEAALSETHAVFVLEATGKMRMIPVEKWYRFNAKHQFKALTIEEAEKFMAKKVKDPRWFMEKQQELAQRKELEQFAKQRKVYAGKQGTPSGVEGLEADEMDFEEDRFADDEEHDDLFNEDEEAKAAEKRIKQDQLKANVFDLKDEKDYEQEELREKKEKEARRVLGKKVRKALQKREKNYDYSSGSDVNPYSDDESSDDSESERLKEEERKAEEEKNKKDTTASSKGNNTPSGRPKHTDPLKKGTAAAPRKRLGSPNVSDASGTDTSRKKGKSKDLSSQPTPQPSSRNMSPVASSQMPLGKKRVRNVPLGGAGSGSDADGGAGSGGEMSESGKTKKLKLNPPAVSQGGTPQGSRAGSPTPLAGRSFSGSRASSPESFRGQTRVSTPVRAGNQSFPTPAEIHAAIPPSGILSSDLLKIFRPRIGESKENHRKFIAIVKDVGVYGKEDRLLRPGTLKES

SEQ ID NO: 29278 - protein, 136 aa, Debaryomyces hansenii CBS767
MARTKQTARKSTGGKAPRKQLASKAARKSAPVSGGVKKPHRYKPGTVALREIRRFQKSTELLIRKLPFQRLVREIAQDFKSDLRFQSSAIGALQEAVEAYLVSLFEDTNLCAIHAKRVTIQKKDIQLARRLRGERS

SEQ ID NO: 29279 - protein, 357 aa, Aspergillus oryzae
MPTELEELVEFLHHGNTQIRQIACENLLGFSIAQPNLFKRHQLLPVRDLKLLVRDYTPIAKNALTMLINLSADQDVLANLADDDAFLETLFTKVTNVKEPNADDVSMLLANLVKSEKMKKLLTIKRRVPEQVSTSPNVMDQLMDCFVKGAEGALNKNATYDYLSYVFADMSKSKEGRAYFTSRQEYDGVVPVTKLTVFTEHQSSIRRRGVASTIKNVAFDIAFHPTLFSEDEANLLPYILLPIAGPEEFGEEETLTMLPDLQLLPPDKKRDSENSIIVTHLETLLLLTTTREGRDRMREVQVYPIIRECHLNVDDEDVREACDRLVQILMRDEEGENAGQPGSIQQEHDDQQVVELF

SEQ ID NO: 29280 - protein, 1357 aa, Debaryomyces hansenii CBS767
MFQKTSDFLLIHHIDKSQTSDQMGPVKTISGQQEYGKKDVTGTNENNENKQNSDNNEHDNGNNSYQNKLKYLPNSDFKYDSNNSFSMNSMNSPISIPNTFKYKSHPNAKTKSQLGVSQVDSVPEVEEHSILIPTKNKGDSQHDSDTPPMKTSTIKHIQQEEHNSLNNADFNATPDWMPEELADKWVPPKSFEIQNLENLDQGDFGSSVRITKQTDSNRDLDMNLQFSSTNTMIHNSKPMVNETPMWKKASKEYESNRKSQPQLHNIFLSMDSLKEEGTNIDKSAYISRGVQGEREHESEPNNNSASSTLSTPMASISNKSGTALTKNQIIQLENILEGEGKGKPNDFLLHVPNPESPLKLFGDKYNTFTKGKLTDLLQKINTKTPSSVNPQKSVENKKNKYGEAIPDSSNPLEEPHLRIKNFTKSGTYTEEQFLQNANNIFNNIQRRGFKMNQDLTHDMSYADGRQRSLSSAVNSQSTATSTPKNIKVNDIDKITSEDEYSSFTSGFEEHESTEFPQYNTDRGHAETHQNEYTSFDQSNSVKDNENASFSNLSPRNLQALQRELTHSNESIYTIDEGYTEDRNSNKNFKESNVNHGEKSEGNPNEIKYFANRLEELERMMKDLNVNAYQADIQKLENENTRLKHELERRTSSNGNQGDGCEVVIDDIDFTNDDLSQMQDFIKWKRASQLRLQNNNSLNGSPILKLKEKSGNQHPIIRGRVEPGIELPVAYDNMILDTKNQKWIANDKENQYHGSLDSIEDLLSRSEENEERGELNNTNNILGEGKPSTKSRKIARRNNDSKLEVSFNLPNMTDEIHETTHEYEDKSPSLNNVTHISQINDMTFSQTKKKLVAVITDILSVGQNFRPINWEKVTDIAMTGYQLDSIKDLNKFLPRLNNVDLSDNNIKFLDGLPKRVLNLNVSHNDIEHMTSFNKYHDLQHLNVSFNKLSNLSNVSNNIHLTELTALNNKLVSIDGIRKLENLTRIDVSQNDLMGEIDFANFKLVNLQELNISENSIQSLSGLECLPRLRILNANENQIMHISCMEKHSHLKKMLLKLNNLQKLNLEPYPFIRCLRIDGNNLNVVTDFKKLRHLEELSCKSQNNPDVINNMLNGSNDILKLDLSGNGNFDLFPNNPNVSGLNHNIHYEPFLNLNVLVLSAMNLSKLPADFAASFPNIRELNLNFNNLSNIAALSKMQNIKRLYMVSNNVREIGSVVESLKGVRNTLRVLDLRLNPINILVYPYVFNPQELDYLQLEIGNKTEGAPIQLETLDDIESFAIHYESLTRNHEDWSERDSKFFSHLKSNANLEKAKHRYNYETLLINFFNHLRKLDGGMITYDKRVSLTKRSKLEDVHGLIQS

SEQ ID NO: 29281 - protein, 840 aa, Clostridium symbiosum
MAKWVYKFEEGNASMRNLLGGKGCNLAEMTILGMPIPQGFTVTTEACTEYYNSGKQITQEIQDQIFEAITWLEELNGKKFGDTEDPLLVSVRSAARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQERSVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGEILLP

SEQ ID NO: 29282 - protein, 110 aa, Debaryomyces hansenii CBS767
MYSDLECDYINPIELCNKLNPWFIPEGGLHAFITALFLVNGYWFVFLLNLPLLAFNVNKFLNKNHLLDATEIFRTLSKHKKESFIKLGFHLLMFFFFLYRMIMALIADDS

SEQ ID NO: 29283 - protein, 103 aa, Ashbya gossypii ATCC 10895
MVSEIKSLSEFESAVGSDKLVVVDFYATWCGPCKMIAPMIEKFATQFQEASFYKVDVDAAAEVAHKYQITSMPTILFFKNGQAVDKVVGADVQSIRTKIAQHL

SEQ ID NO: 29284 - protein, 341 aa, Schizosaccharomyces pombe 972h-
MSQTTTETIIPLDSSVKDKLDPEYVNFYNKYVCSNLPIVKTHTYPVDFLRNNGNVMPGQSELLPVESTEDITIPRKHTKAPSGVPSRIFRPHGTAPEGGWPCFLWFHGGGWVLGNINTENSFATHMCEQAKCVVVNVDYRLAPEDPFPACIDDGWEALLYCYENADTLGINPNKIAVGGSSAGGNIAAVLSHKVAASPANFPPLVLQLLVVPVCDNTANAKTHKSWELFENTPQLPAAKMMWYRRHYLPNEKDWSNPEASPFFYPDSSFKNVCPALICAAGCDVLSSEAIAYNEKLTKAGVESTIKIYEGCPHPVMAMDAVLEKGRILNKDATNALLAAFA

SEQ ID NO: 29285 - protein, 783 aa, Neurospora crassa
MAHGDAAPEAHSEAAQQQAQDDSRSTSSSSTPPPVDNEESDFFLAANDSQSSLGVPNIENMQVADEECRVAPINRLPNELLIAIFVKLTTSSDILHVMLTCKSWARNAVEILWHRPACSSWERHTIICQTLSAPRPYFAYRHFIRRLNLSALAPELNDGSVESLEMCSRVERLTMTGCKRITDAGLLKLLRNNTGLLALDISGMEDITETSINAVAEKCSRLQGLNISNCTKISIASLVQLAQSCRFIKRLKLNECAQVTDEAVIAFAENCPNILEIDLHQCRLIGNDPVTALMSKGKALRELRLASCDLIDDSAFLSLPPNKTYEQLRILDLTSCSRLTDRAVEKIIDVAPRLRNLVLAKCRNITDAAVFAIARLGKNLHYVHLGHCGNITDEAVKRLVQCCNRIRYIDLGCCVHLTDDSVVRLATLPKLKRIGLVKCSNITDESVYALARANQRRPRRDADGNLVPGDCYNNMHHSSLERVHLSYCTNLTLRSVLRLLNACPRLTHLSVTGVQAFLREDLESFCREAPAEFTEHQRAVFCVFSGQGVTNLRRYLNSEHNLTEIARGARPIDEGVPNRVGPVFPGTAVNPMQVTPPGHHGAAAAFIDDGEPDAVDDDDGLEDGSEMVIDTQPMLHNHHAVMGGTAFPIQGVASTEQLLPPPPPAIQPQQHLVTNPFHFVPGQPFAIPPHGLQFYEAVRATESGAVSGTPTHVPLVGQATGLESTIAEGSHHSGVARNSPGTATSQNPDASQAVPPNPMGNIELAILTGNRNPDLGGSGGASV

SEQ ID NO: 29286 - protein, 381 aa, Oryza sativa (indica cultivar-group)
MASSTQGQVITCKAAVAWEANKPMTIEDVQVAPPQAGEVRVKILFTALCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 29287 - protein, 289 aa, Bacillus clausii KSM-K16
MDLHNYLANGIPPQKQDKQPGDEAVMEPRPIYEDDDYKGTGKLRGKVALITGGDSGIGRAVAVGYAKEGAHIAIVYLDEHEDAEQTKQRVEQEGVQCITISGDISDETFCKESVERTVTELGCLDILVNNAAEQHPVNDLRELTAEQLHRTFATNFYSYVYYTKAALDYLKPGSAIINTSSINAYRGNVTLIDYTSTKGAITAFTRSMAQALASKHIRVNSVAPGPIWTPLIPASFDEQKVSEFGTTTPMGRAGQPSELVGAYVLLASNDSSYMTGQAIHINGGDYISS

SEQ ID NO: 29288 - protein, 269 aa, Oryza sativa (japonica cultivar-group)
MGGDLYALDFDGVLCDSCGESSLSAVKAAKVRWPWVFEQVDAAMEEWIVEQMYTLRPVVETGYENLLLVRLLIEIRIPSARRSSVADGLSIQEILENWLKLKPTIMSEWNEDRDSLVDLFGSIRDDWIENDLSGWIGANRFYPGTADALKFSSSEVYIVTTKQGRFAEALLKELAGIEFPSERIYGLGTGPKVKVLQQLQQMPQHQGLTLHFVEDRLATLKNVIKEPALDQWNLYLVNWGYNTPKEREDAEGISRIQVIDLPGFSQKLK

SEQ ID NO: 29289 - protein, 334 aa, Anabaena variabilis ATCC 29413
MSDQANQGDLEIRPSPLLTVINDLHSKYKSLKEGIVANYIPELAKVNPDLFSISIVTVDGQVYQVGDYQQLFTIQSISKVFAYGLALEDHGRDYVLTRVGVEPTGEAFNSIILDEQSKRPYNPMVNAGAIATTSLIKGAGATERLNRVLEMFRRYIGHDVFVDISVFTSERSTGHRNRAMAHLMLNFGMIDRNLEEALDLYFQQCAVMVNCHDLAVMAATLANRGVNPVTGEQAVNSRYIKDILSVMYTCGMYNFAGEWAYKVGIPAKSGVCGGIMAVVPNQMGIAVFSPPLDIRGNSVRGVKVCEELSQQLGLHLFECVKVENGKWGVGNCEC

SEQ ID NO: 29290 - protein, 255 aa, Escherichia coli O157:H7 EDL933
MFNSDNLRLDGKCAIITGAGAGIGKEIAITFATAGASVVVSDINADAANHVVDEIQQLGGQAFACRCDITSEQELSALADFAISKLGKVDILVNNAGGGGPKPFDMPMADFRRAYELNVFSFFHLSQLVAPEMEKNGGGVILTITSMAAENKNINMTSYASSKAAASHLVRNMAFDLGEKNIRVNGIAPGAILTDALKSVITPEIEQKMLQHTPIRRLGQPQDIANAALFLCSPAASWVSGQILTVSGGGVQELN

SEQ ID NO: 29291 - protein, 711 aa, Thermoanaerobacter tengcongensis MB4
MGAYLTLIYGVIVIAALVIIGLIKFIFAQDKGNEKMQQISDAIKEGAMAFLNRQYKTIASLALIVAVIIVVANYYGHLSEGSSQALSFALHVGFAFITGAFCSALSGYIGMYMAVNSNIRAAAGARSGLNRALQIALKGGAVTGLAVTALSLFGVATLFLAYGGLSGQDELIKEAPSLIVGFGFGASFVALFAQLGGGIYTKAADVGADLVGKVEAGIPEDDPRNPAVIADLVGDNVGDCAGRGADLFESTAAENIGAMILGVGLYPIFGWKGILFPLVARAIGIIASIIGIFFVNTKDESKDPMIALNKGYFVTTVVNLIALFFAVKVMLSGHLPDGRPVNYLLLYGAVVTGVILSYIFVFLTDYYTSVNKRPVQEIAKASTTGAATNIITGTSVGMESTALPVIFISAAIYIAYKLGEMAIPHIGTAGLYGTAIATMGMLSTTAYILAMDTFGPITDNAGGITEMSGAPEEIRRVTDRLDACGNTTKALTKGYAIGSAALATFLLFSAYLDEVKKILGKPIDSWFPVDIGKPEVFIGAFIGAMIVYLFSSTAIRAVGKAAQYVILEVRRQFREIPGIMEGTAKPDYARAVDIVTKGALKEMVIPGLIVVVTPILVGVILGKEAAAAFLMIGTISGVILALYLNNGGGAWDNAKKFIELGNYGGKGSDAHKASVVGDTVGDPFKDTAGPSLHVLIKLISTITLVFVALFR

SEQ ID NO: 29292 - protein, 259 aa, Tulipa gesneriana
MPISRIAIGSPQEATQAGALKAALAEFISTLIFVYAGQGSGIAFGKLSVDGVTTPAGLVAAAIAHAFALFVAVSVGANISGGHVNPAVTFGAFLGGNITLLRGVLYIIAQLLGSSVACLLLRFTTGLGTGHFGLVAGVSIWSGLVMEIVMTCGLVYTVYATAVDPKKGDIGTIAPIAIGFIVGANILVGGAFTGASMNPARSRSGRALVSWSWTSHWVYWVGPLIGGGIAGIVYDLFFINSTHEPAPKHRLLIGGWRRR

SEQ ID NO: 29293 - protein, 111 aa, Prunus dulcis
GIIVLALTATLNSSRPQPCVVGSELCQPTSILQDVVLYTGKALASIGLGGTRYALATMGANQFDKPKYQASFFNWYFFTLYSTTAVALTVIVYIEDNAGWRWGFGYVSLPT

SEQ ID NO: 29294 - protein, 176 aa, Solanum tuberosum
SMSWKQRLEICIGSARGLHYLHTGDAKAVIHRDVKSANILLDESFMAKVADFGLSKTGPELDQTHVSTAVKGSFGYLDPEYFRRQQLTEKSDVYSFGVVLFEVLCARPVIDPSLPREMVNLAEWAMKWQKRGQLEQIVDPNLVGKIRPESLRKFGETAVQCLADYGVDRPSMGDVL

SEQ ID NO: 29295 - protein, 491 aa, Triticum aestivum
MTSKVANSSGSDNADAKLSPSGLPVREVPGGYGVPFLSPLRDRLDYYYFQGAEEYFRSRIARNGGATVLRVNMPPGPFITADSRVVAFLDARSFSVLLDDAKVDKTDTLDGTFMPSLALFGGYRPLAFLDAADPRHAALKRVMISLAAARMHHVAPVFRIAFGAVFDAADAGLGDGPVQFNKLNEHHMFDFTCSALFGGTPPSKAMGDGAVTKAIKWLGVQLHPLASKIIKPWLLEDLLLHTFRLPPLLVRRDYADLTAYFAEAAAGFLNDADKAQSGISRDELLHNLVFTAIFNAYGGFKIFLPHVIKWLARAGPALHARLASEVRAAVPNGSDITVSAVDKMPLVKSVVWEALRMNPPVEFQYGRARQDLVVESHAAAYQVRKGEMLFGYQPLATRDERVFKQAGEFVPDRFVGGEGRLLGNVVWSNGPENSEPAEGNKQCPGKDMVVAVGRLMVAELFRRYDTFTADVKEMPLEPVVTFTSLTRAKAE

SEQ ID NO: 29296 - protein, 185 aa, Rosa roxburghii
REGGFGYVYKGTLSNGTKVAVKRCKQEGQRSGQGLPEFETEIIVLSKIRHRHLVSLIGYCDEESEMILVYEFMEKGTLRDHLYESDVPRLSWKQRLEICIGSATGLDYLHKGAAGGIIHRDVKSTNILLDENLVAKVADFGLSRSGPLDETHVSTVVKGTIGYLDPEYMMSQQLTEKSDVYSFGV

SEQ ID NO: 29297 - protein, 142 aa, Dehalococcoides ethenogenes 195
MERTLLLVKPDGVNRGLSGEILGRMEKLGLKMIGLRMLQMDAVLADKHYAPHRERPFFKDLVTYITSGPIVAAVFEGENAVEKMRKAMGATDPAKSEKGTVRGDLGINIEQNTVHGSDSAENAKHEISLFFSESELVNYDRR

SEQ ID NO: 29298 - protein, 188 aa, Rosa roxburghii
GDGGFGNVYRGTLLNGTKVAVKRAYERDEHGSGSGQGLPEFETEIIVLSKIRHRHLVSLIGYCNERSEMILVYEFMEKGTLRDHLYDSDVPRLSWKQRLEICTGAARGLHYLHTGAAGGIIHRDVKSTNILLDANHVAKVADFGLSRSGALDETHVSTNVKGTFGYLDPEYMMSEQLTEKSDVYSFGV

SEQ ID NO: 29299 - protein, 204 aa, Solanum vernei
LNSSYRVPFESYRVPFVDLQEATNNFDEKFHIGLGGFGKVYRGVLRDGTKVALKRCKRESSQGIEEFQTEIEILSFCSHPHLISLIGYCDERNEMILVYDYIENGNLRSHLYGLDLPTMSWEQRLEICIGTARGLHYLHSSAVIHRDVKSINILLDENFVAKITDFGLSKKGTELDETHLSTLVQGTIGYLDPEYFIRGQLTEK

SEQ ID NO: 29300 - protein, 213 aa, Oryza sativa (japonica cultivar-group)
MTVGMINANPVVHERPERAAHPHPADAIDALDVFDTVRDIKDPEHPYSLEQLSVLSEESVSVDEKLGRIQYARTPVPFWRRVWSELVINLCDLEMIVCLDPRTTSGFLFLEDIQLPFLGHCSHLTITCRITFTPTVQHCSMATVIGLCLRLKLMQNFPPHFKIDIKVAPGSLANEESVNKQLNDKERVAAALENPNLRQLVDECLCSNDSHSH

SEQ ID NO: 29301 - protein, 183 aa, Rosa roxburghii
GHGGFGKVYLGVLEDSTKLAIKRGNPNSEQGINEFRTEMDMLSKLRHRHLVSLIGFCDENNEMILVYEYMANGPLRDHLYGSNLLPLSWKQRLEVCIGAARGLHYLHTGAAQGIIHRDVKTTNILLDENFVAKVADFGLSKAAPSLEQTHVSTAVEGSFGYLDPEYFRRQQLTEKSDVYSFGV

SEQ ID NO: 29302 - protein, 198 aa, Solanum vernei
VPFESYRVPFVDLQEATNNFDEKFHIGLGGFGKVYRGVLRDGTKVALKRCKRESSQGIEEFQTEIEILSFCSHPHLISLIGYCDERNEMILVYDYIENGNLRSHLYGLDLPTMSWEQRLEICIGTARGLHYLHSSAVIHRDVKSINILLDENFVAKITDFGLSKKGTELDETHLSTLVQGTIGYLDPEYFIRGQLTEK

SEQ ID NO: 29303 - protein, 178 aa, Glycine max
  misc_feature (62)..(62): Xaa can be any naturally occurring amino acid
  misc_feature (75)..(75): Xaa can be any naturally occurring amino acid
  misc_feature (122)..(122): Xaa can be any naturally occurring amino acid
  misc_feature (125)..(125): Xaa can be any naturally occurring amino acid
  unsure (1)..(178): unsure at all Xaa locations
MASSMISSPAVTTVNRAGADMVAPFTDLKSMAGFPDQKTNNDITSIASNGGRVQCMQVWPPXGKKKFETLSYLPXLNNTQLAKEVEYLLRKGWIPCLKFKLKHGFIYQEHNKSPKYYNGHYXTMXKLPMFDCTDASQVLKELQEAKTAYPNNFIHIIKFHNIHQMQYISFITYEPPSF

SEQ ID NO: 29304 - protein, 151 aa, Polaromonas sp. JS666
MGNKLYVGNLPYSVRDEDLQQSFGQFGSVTSAKVMMERDTGRSKGFGFVEMGSDAEAQAAINGMNGQPLGGRSVVVNEARPMEARPPRSGGFGGGSGGGGYGGGGGGGGYGGGGGGRSGGGGSDGGFRSPYGGGGSGGGRSGGGGGGRGGY

SEQ ID NO: 29305 - protein, 183 aa, Rosa roxburghii
GEGVFGKVYLGVLEDSTKLAIKRGNPNSEQGINEFRTEMDMLSKLRHRHLVSLIGFCDENNEMILVYEYMANGPLRDHLYGSNLLPLSWKQRLEVCIGAARGLHYLHTGVAQGIIHRDVKTTNILLDENFVAKVADFGLSKAAPSLEQTRVSTAVKGSFGYLDPEYFRRQQLTEKSDVYSFGV

SEQ ID NO: 29306 - protein, 277 aa, Ashbya gossypii ATCC 10895
MSEAFHFLAEFIDSVLPDALARRQGREPAFVLISGPQGSGKTFNAAQLLAHVAQQHRAVGLSIDDFYLPAGAQAAVAAGGNPLLAGRGLPGTHDVPLLRDTLARLRKGEGEVELPQYDKAAHGGRGDRCAARVRVQLPVDVVILEGWFLGFEPAAEAELARAAGTYGAAALREVNAALEDYSACLWRAAGVPSVGIVFDAQVRECVARWRIQQEHELRERCGAGMTDAQVHAFLERYLVCYDVYYARLVREGLGNLHRLTVGLDGDRKVTYVSQKNM

SEQ ID NO: 29307 - protein, 458 aa, Escherichia coli CFT073
MMESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 29308 - protein, 580 aa, Schizosaccharomyces pombe 972h-
MNNYGVSSIGTSLTPSPTGSIDEYTSKEVKHPEDVKVDASYEKEEVGYGELEVVPERGNLFQRWYRSFLPPEDGKPQKLKRTLTARHIQMIGIGGAIGTGVWVGSKNTLREGGAASVLICYSLVGSMVLMTVYSLGELAVAFPINGSFHTYGTRFIHPSWGFTLGWNYLASFLATYPLELITASICLQFWININSGIWITVFIALLCFVNMFGVRGYGEVEFFVSSLKVMAMVGFIICGIVIDCGGVRTDHRGYIGATIFRKNAFIHGFHGFCSVFSTAAFSYAGTEYIGIAASETKNPAKAFPKAVKQVFIRVSLFYILALFVVSLLISGRDERLTTLSATAASPFILALMDAKIRGLPHVLNAVILISVLTAANGITYTGSRTLHSMAEQGHAPKWFKYVDREGRPLLAMAFVLCFGALGYICESAQSDTVFDWLLSISNLATLFVWLSINVSYIIYRLAFKKQGKSYDEVGYHSPFGIYGACYGAFIIILVFITEFYVSIFPIGASPDAGAFFQSYLCFPVVVIVFIAHALITRQKFRKLSEIDLDTGFSKYDRLEESDKGPMTAKSLAKSVLSFCV

SEQ ID NO: 29309 - protein, 458 aa, Oryza sativa (indica cultivar-group)
MAAELASLPRGLHFFRLSGCGRSTLSVSRVSSASASMLSTVATCTTSVKTFSLSQLEKATDGFDSKRVLGQGGFGRVYHGTMDGGDEIAVKLLTREDRSGDREFIAEVEMLSRLHHRNLVKLIGICIEHNKRCLVYELIRNGSVESHLHGADKAKGMLNWDVRMKIALGAARGLAYLHEDSNPHVIHRDFKGSNILLEEDFTPKVTDFGLAREATNGIQPISTRVMGTFGYVAPEYAMTGHLLVKSDVYSYGVVLLELLSGRKPVCMSDTNGPQNLVTWARPLLCHKEGLERLIDPSLNGNFNFDDVAKVASIASMCVHNDPSQRPFMGEVVQALKLIYNDAEAACDDSYSHRDSSCDQYDDYHGALALDSGSGSWWNRSSNPSGFFDNRNPLPVITMEYSSGRIEGARDPRFALSTGGHAQSPALQNRSGPIRMKKKLASFYRSRGSFSEHGQLPRH

SEQ ID NO: 29310 - protein, 126 aa, Schizosaccharomyces pombe 972h-
MSKVPINSSKLSCGGPYNQAVKSGGLIFCSGQAAVKDGNFVPGTIQEQTRLTIENLAEVLRVAGSSLEKLVKVNIFLTDIDDFAAMNEVYKEMLPDPMPARTTVAAGKIPLSSKGGKIEIECIAAE

SEQ ID NO: 29311 - protein, 939 aa, Ashbya gossypii ATCC 10895
MTLIDGKAIAAEIRGEIAEEIARLCADGLFQAKLTIFQVGERHDSSTYVRMKRRAAAEAGIEVEFVQLGADVDEEEVLAAIDARNADETVHGILVQLPLPPGMDEERVTSRVAPEKDVDGFGSYNIGELNKRHGRPHFHPCTPKGIIELLRRMDVQIAGANVVVLGRSDIVGAPVACLLRALDATVTVLHSRSRDIPGYVGRADIVVVAIGQPEFVKGAWFTNPDAVVIDVGTNFVEDSTRKTGYRCVGDVEFGVASEKVRLITPVPGGVGPMTVAMLMQNTLDAAKKCHSAPRKLSPLPLQLQKPVPSDYEISRSQVPKNIAVVAREAGLLPSEVELYGSVKAKVKLDTLDRLAHRENGKYVLVTGITPTPLGEGKSTTTVGLVQALAAHLDKVAFATVRQPSMGPTFGIKGGAAGGGYSQVIPMDEFNLHVTGDIHAISMANNLLAAAIDTRMFHEATQKDAALYKRLVPEKNGTRKFTSTMLRRLQKLGIHKTDPNSLTESEIARFARLDIDADTITWRRVVDCNDRFLRGITVGEAPTERGYKRQTGFDISVASECMAILALADSLHDLRERLGRIVVAASRNGEPITCEDIGCAGAMAALLKDAIKPNIMQTLEGTPVFVHAGPFANISIGANSVLADKIALKLAGVDPNWSEAEKKKRQGYVVTEAGFDFTMGGERFLNIKCRASGISPDVVVIVATVRALKVHGGGPEVKAGAPLPSAYLNEDVDLLRKGCANLAKHIANARTYNLPVVVGINRMSSDTEREHEVIREEAIKAGAFDAIVSNHWEEGGQGAVKLAEGVIRATEECRPEFHYLYDTEGPSIEDKISTIAKTMYGAAEVEFLPEARKKIELYTKQGFNHLPICIAKTQYSLSHDANLKGVPTGFKFPVRDIRASIGAGYLYALAAEIQTIPGLPTHCGFMNIEINDKGEIDGMF

SEQ ID NO: 29312 - protein, 182 aa, Medicago truncatula
MNLKTSSEVETRALLDEICSFDRKGLFDLGHPLLNRIAESFVKAAGIGAVQAVSREAYFTAIDGHKVDKGGVIPQDVSPTNKRRLPAGLRGETSNKSLDAMVINTGKESLQWGVAAGIYSGLTYGLKEARGAHDWKNSAVAGAITGATLALTLEDSTHEHVVQCAITGAAISTVANLLKGIF

SEQ ID NO: 29313 - protein, 290 aa, Yarrowia lipolytica CLIB122
MTLADTLAAVHDNAEAIQTVSLDTRIKEEVTQDAEDSGELDKTSGEIQESHEKETEAQIKAQKDAMDMAKAEIDVAEGSVDDQDVSELQKVQRALHQANQPVRITQQKTGVTLPAMKLMTPPDGGWEVPENFSIVVGQIYRSSFPRPENFEYLKRLKLKSILVLIPEIYPDENLQFMKENNIQFFQVGMSGNKEPFVHVPHDVITRALEIAINPANHPLLIHCNRGKHRTGCLSGCIRRLQDWSLTMIFDEYRRFAYPKARPLDQQFIELYDSTEVVKRAWDYGWLPLQW

SEQ ID NO: 29314 - protein, 390 aa, Bacillus clausii KSM-K16
MAMDIQQAKMMEQLPSQFFAKLVNKAQRLAQEHNDLINLGQGNHDQPTPAFIVEALREASSEPQFHRYGPFRGYPFLKEAIAAYYKQQYGVELDPETEVAIVPGTKTAIVELCQCLLNKGDMALVPDPGYPDYLSGIAITGAIAKPMPLLRNNRFLPDYHELSSDVLDKAKMMFLNYPNNPTGATADARFFADTVAVARSHCIPVIHDFAYGAIGFNGTPRSFLQQEGAKDVGVELFTMSKLYNMAGWRVGFVLGNKEIVAMLEELQDHYHCSLFGGLQAASACALQSDQSSVHELVGLYKERSEALWEAAQEIGWQVEQPSGSFFAWFPVPKGYTSEEFSELLLDKAHLVVAPGNGFGQYGEGYVRIGLLADKTTLREAIARVGNLNLF

SEQ ID NO: 29315 - protein, 352 aa, Borrelia burgdorferi
MKKDYYEILGLSKGASKDEIKKAYRKIAIKYHPDRNQGNEEAASIFKEATQAYEILIDDNKKAKYDRFGHSAFEGGGFEGFSGGFSGFSDIFEDFGDIFDSFFTGNKGQERNRKHAKGEDLGYNIEISLENAYFGYKNNINIARQMLCDSCLGKKSEKGTSPSICNMCNGSGRVVQGGGFFRVTTTCSKCYGEGKIISNPCKSCKGKGSLTKQETIQLNIPPGIDNNQQIKMKGKGNVNPDNQEYGDLYVKILIRSHKVFKRNGKDLYAMLPISFTQAALGKEVKIKTIASKEIKIHIPKGINNEEQILIKNAGMPILQTEKFGNLILITKIKTPKNLNSNAINFLKTWAKN

SEQ ID NO: 29316 - protein, 496 aa, Schizosaccharomyces pombe 972h-
MSEDLFVSINFPNGKSVKQPIGLYINGEWHKSAETWETVDPSIEEVIAKVYLAGEKEIDYAVKSAKEAFKTWKKVPGSEKGELLMKLAELTEKHADTLAAIEAMDSGKPLVSNARGDVDGTIALLRYCAGWADKIYGQVIPTGPEKLAYAKRTPIGVCGQIVPWNYPLNMAGWKIAPALAAGNCIIIKSAETTPLSLLYFATLVEEAGFPKGVVNIISGLGTVAGSYMAKHPGIDKIAFTGSTKVGVIVQQLAASNLKAVTLECGGKSPFLVFEDADLDQAVKWAALGIMYNSGQICTSNSRIYVQDSVYDKFIELFKKHVIQDYIVGMPFDDNTVVGPVVNKTQYNRIKNYIEQGKKEGAKLVLGDEPLPLKQGYFISPTIFADCSENMTIVKEEIFGPVVAISKFKTEDEAIEKANNTTYGLAAMCFTKDLERAHRVSDELEAGMVFINSTENSDIQAPFGGIKMSGIGNELGSNGIEMYTQIKAVHINFNNKL

SEQ ID NO: 29317 - protein, 571 aa, Leuconostoc mesenteroides subsp. mesenteroides ATCC 8293
MTKNFKGIAASNGVAIAKAYLLVDPDLSFEKTTVTNVAAEQARVDDALKASSDDVKLIKAKATESLGAAEAEVFEAHLMVLADPEMSGAIKQKIEDDKVNAEQAVKEVTDMYISMFDAMTDNEYMQERAADIRDVTKRILSHLLNISLPNPALIDEEVVLVSKDLTPSDTAQLDRQFVKGILTDLGGRTAHASIMARTLEIPAVVGSEKATVEVSSGDLVIVDGLTGDVIVNPDADTLATYQKKAADYFAQRAEWAKLKDEKSVSADGKEFIVGANIGAPKDMQAVLDNGSEGVGLYRTEFLYMESDHLPTEDEQFEAYKSVVEQMGDKPVTVRTMDIGGDKHLDYWKLPEEENPFLGYRAIRISLDQTDIFRTQLRALIRASAFGNLWIMFPMIATLSEFRAAKKIYLEEREKLEKAGVATGEVKLGIMIEIPAAAILADKFAKEVDFFSIGTNDLIAYTMAADRGNDRVAYLYQPYNPSILRLINTVISAAHKEGKFVAMCGEMAGDPVAVPLLVGMGLDEFSMSAPSVLQTRSLMKKLNTADMKVLAEKALDVETNDEVIELVKEATK

SEQ ID NO: 29318 - protein, 484 aa, Propionibacterium acnes KPA171202
MSTRLGGSSPAAGCPAVPSRFGAAGSGAPSGTEQEQGLQRGLKNRHIQFIALGGAIGTGLFYGAAESIEQAGPAIMVCYLIGGAVIFLIMRALGEMSVEHPTSGAFSYYAYRNWSPRAGFVSGYNYWFNYIAVSMAELTVVGKYVNFWFPQIPEWLSAGAFLVLITIINLTAVRAYGEFEFWFAVIKVVAILAMIVLGVLIIATGLGGGPPTGIGNLWRHGGFFPTGISGMLCGFVVVMFSFGGVELIGITAGEADDPRRSIPRAINQVVYRILIFYIGAISVMLCLFPWNQIGKAGSPFVTIFDKIGVAGAANILNVVVLTASMSAYNSGLYSNGRMLYSLAAQHNAPGIFWKTNRLGAPWVGVLASSVVTATAVLLTYLIPGKVFLYIISIALISGVINWTMIIITNLKFRRRIGPEGVAALEFRMPGNPVTSYVVLVFLALVVVIMAMMPSYRVALVVGPVWLALLWVGYDVSCLVRRRHA

SEQ ID NO: 29319 - protein, 618 aa, Zea mays
MKSTVFSTAVVSIGYALLGWDFAALSEANHHMEKEFELLNGPSIEGITLAASTFGAIVITIFSGALLDWLGRRVILVYSSLVLFSGGVLMLWSPNIYIVLLASWRIMIGAIFAPSIVYFALLVYYLPESPRWLASDGKISEARVSLQWLRGKKHDVSGEIAAIVEGVDIISDSTVGAARAQSFSGTSASHTWPRSTFYWQLSDPLVDLLGSVHENMSEGGSRRNSFFPVFNSFSFPEHEHMNEHRDGNSDQQTRETYYAGEANNGDGLRASLLSQAASVEVNDTNTSFTSEGSSSYLRRHGTSVLAQEFMASIHDYDIEEEEEEIHGFALPHQSAPRDMESTGRHPFRHQIVRLSETADMKFKWRVLLQPGIRHALCYGMLIQALQQVRLCVIVDYVFNSAWSSVYLRTGYHSTGISGLLRCAPEIFEQSGVASLFSDIGLSPHSTSILMSTLNALLILPCITAAMLLMDVCGRRVIVLATTPVLILSLSVMSMSTLVNMGPFESAVLFHFALTICFWSYVIGLGPIPNILCSEIFPTKARATCASFCSLSFWFGGLLSAYCFPVMLSTIGLGGACGIYALVCCAPLFLVYYRIPETKMLNLELIAELFKLSRQEHVQ

SEQ ID NO: 29320 - protein, 268 aa, Zea mays
MDYSTQLLSDLLTTHIGHNLYESAKRLRLPELPAFALEHLLNRNSLIYGDLYGISKEASTIYRATLRYEGFSEIMVTLSKTGFFDAANHPLLQDTSRPTYKGFLDELLNNISTINTDLDIEASGGYDDDLIARLLKLGCCKNKEIAVKTVKTIKFLGLHEETQIPKGCSSPFDVICQRMEQRMAYGHNEQDMVLLHHEVEVEYPDGQPAEKHQATLLEFGKVENGRSTTAMALTVGIPAAIGALILNLTTIILAQYIGDLGVVGHQAG

SEQ ID NO: 29321 - protein, 434 aa, Methanocaldococcus jannaschii
MLGNDTVEIKDGRFFIDGYDAIELAEKFGTPLYVMSEEQIKINYNRYIEAFKRWEEETGKEFIVAYAYKANANLAITRLLAKLGCGADVVSGGELYIAKLSNVPSKKIVFNGNCKTKEEIIMGIEANIRAFNVDSISELILINETAKELGETANVAFRINPNVNPKTHPKISTGLKKNKFGLDVESGIAMKAIKMALEMEYVNVVGVHCHIGSQLTDISPFIEETRKVMDFVVELKEEGIEIEDVNLGGGLGIPYYKDKQIPTQKDLADAIINTMLKYKDKVEMPNLILEPGRSLVATAGYLLGKVHHIKETPVTKWVMIDAGMNDMMRPAMYEAYHHIINCKVKNEKEVVSIAGGLCESSDVFGRDRELDKVEVGDVLAIFDVGAYGISMANNYNARGRPRMVLTSKKGVFLIRERETYADLIAKDIVPPHLL

SEQ ID NO: 29322 - protein, 104 aa, Dehalococcoides sp. CBDB1
MELKLDDKGLIAAIVQDVKDGTVLMLGYMNTESFKLTQETGSVWFYSRSRQELWNKGATSGNKLIVKEMYLDCDNDAVLVKAEPMGPTCHTGNRSCFFKTVELK

SEQ ID NO: 29323 - protein, 234 aa, Brassica napus
  misc_feature (100)..(100): Xaa can be any naturally occurring amino acid
  misc_feature (123)..(123): Xaa can be any naturally occurring amino acid
  misc_feature (165)..(165): Xaa can be any naturally occurring amino acid
  unsure (1)..(234): unsure at all Xaa locations
MGLEMESPKEQSSYTVEQLVAVNPFNPEILPDLENYVNEQVTSQTYSLDSNLCLLRLYQFEPERMNTHVVARILIKALMAMPTPDFSLCLFLIPERVQMXEEQFKALIVLSHYLEELGGFQQXFWDEAAKNRHFSRTGSRVLEEAYPKHMPGRLLSLSYQKASKXSVLAEAVNMDGASLDKFIEHQVTNSGWIVVKEDGSIVLPQNEFNHPELKKNTGENVPLEHIARIFPILG

SEQ ID NO: 29324 - protein, 418 aa, Oryza sativa (japonica cultivar-group)
MEAAVDGRWTRVRTLGRGASGAVVSLAADDRSGALFAVKSAAAAAAAEQLVREGRILSGLRSPHVLPCLGFRAEAGGECQLFLEFAPGGSLADVVARSGGRLDECAIRAYAADVARGLAYLHGMSLVHGDVKGRNVVVGADGRAKIADFGCARTVGSDRPIGGTPAFMAPEVARGEEQEPAADVWALGCTVIEMATGRAPWSDMEDILSAVRRIGYTDAVPEVPEWLSAEAKDFLARCFARNPRERWTSSQLLEHPFLASAGCSVKTGEAAPQWVSPKSTLDVAFWESDTDDEEDDMPASPAERIKALACPCSALPDWDSDEGWIQVLNESSEACDTAVAKVEAEGKGRVLIEALETINESSGGDAECVDPEGTVRLITVASIGQQEVFCLGLINDPLVFSVNKSELTKSLFPQIVSF

SEQ ID NO: 29325 - protein, 600 aa, Yarrowia lipolytica CLIB122
MLIMFDTKANCNKFYHAKLLDDLDTVEVRYGRVGNEGVKHTYVGGQRKYDQMLRQKRNKGYKDALIAADVEDDGGVTVRSNVIDTALEEIKYLDDMSRVLVTTISQQNIHRITASTSIKFDSDDGLFKTPLGVIQQHGVEEAIRLLGEIETHVVNFEALVAKEGVSFDTPVAKKGPKKRKRADEEVQQGPIGTPEDGVKPEGEGEGEGEGEVVAETKTEPEPEPEPEPEPAEPSSPPSKRRRTRARATKTKAQRDAEEAAQREAEEQAEKAERARKAAERKAKAAEKKAAEKATKEAIEKAAAENEPAEEEPNAAVKPSAELEVIMSTLYTLNEQYFVIIPNKVKNAREIRHLLFNQTAIDEQKATCDALLETLKLIEDLKKKAAEESEKKPTKKKTDAEKTFNVEVKHVTDKRSFNRINTMFESSKNQIHGYTAKCAKVKNIYKIKLGSQQAPFAATSKKIKCVQELWHGTRLQNILSILGKGLLLPKLSPGQKVGAMFGDGLYFANQSSKSLNYCDGMLWTSDGSGKPETIYMFLASVALGNYFTPEGPVSTNPPEGYHSYWAKAGQSGVMNDEIIVFDASQIRLDYLLEIELRASDE

SEQ ID NO: 29326 - protein, 255 aa, Oryza sativa (japonica cultivar-group)
MPPSAAAAAAMAQSPRSLHTLISFGRGADGVDDDEATPASVDVGDAEGAGLDLDFAFAPPVSAAELAPADDIFAHGRIVPAYPVFDRSLLDLSPGDASTAAPSADTYCAWTPRSAPGSPGRDRFPKSASTGGESSSSSRRWRLRDLVGAGGRSRSDGKDKFAFLHHHAAAPPSSKLKTPPPPQQPQQKKQSAVKTKPAAKKGVVTEMDMATAHRLFYSKASAGGDRRPQQASYLTYRPAFSGLFALGRSQHHTAY

SEQ ID NO: 29327 - protein, 187 aa, Saccharomyces cerevisiae
MSIASYAQELKLALHQYPNFPSEGILFEDFLPIFRNFGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 29328 - protein, 187 aa, Triticum aestivum
  misc_feature (173)..(173): Xaa can be any naturally occurring amino acid
  unsure (1)..(187): unsure at all Xaa locations
KKVLANKLNTWSKLQEHYDAEGKNLVIKELFEKDPQRFEKYHRVFKGSDKTKSSILFDFSKNRVTDETLKLLLELAKEAKVEEMRSKMFTGEHINFTEDRAVLHIALRNLSDRPIYDNGADVMPEVREVLAHMKQFSEAVRSGEWKGYTGKTITDIVNIGIGGSDLGPVMVTXEALKPYAQEGLKGS

SEQ ID NO: 29329 - protein, 168 aa, Oryza sativa (japonica cultivar-group)
MANAGLKPVAGLLLVLNFCMYVIVAAVGGWAINHAIHTGYFIGSGMALPANFSPIYFPMGNAATGFFVIFAVIAGVVGAAAALAGFHHVRAWSHESLAGGGLLRVHRMDAHPARPWENHGVLHHHTLGNTAVLSARHSRREVEEGQVFLIKVVKSEWLSPHDNRLSRE

SEQ ID NO: 29330 - protein, 184 aa, Rosa roxburghii
GEGGFGKVYKGLIDGASTEVAIKRSNPSSEQGVNEFQTEIEMLSRLRHRHLVSLIGFCEEEGEMILVYDYMANGTLREHLYKCNKPPLSWKQRLEICIGAARGLHYLHTGARYTIIHRDVKTTNILLDENWVAKVSDFGLSKTGPNLHQTHVSTMVKGSFGYLDPEYFRRQQLTEKSDVYSFGV

SEQ ID NO: 29331 - protein, 165 aa, Oryza sativa
MTMVTPRAPELLQQDQDEEMLVPDQDVVVEGPQPMEDSGSTVENEQVPETSTSRFTWTIEDFSNHRKLYSDVFVVGGHKWRVLVFPTGNSVQSLSMYLDIADANEQPHGWSKYAQFSLAVINQLDSKYSLRKEAAHHFSTRESDWGFTSFMHLGDLYDPTKGYIV

SEQ ID NO: 29332 - protein, 183 aa, Rosa roxburghii
GEGVFGNVYKGTINGASTPFAIKRLKAESSQGALEFKTEIELLSQLRHVHFVALVGYCDDNGEMILVYDYMENGTLRDHLYNSENPPLPWEQRLQVCIGAARGLHYLHTGVKCMIIHRDVKSTNILLDDKWVAKVADFGLSKMGATTMTHISTMVKGSFGYLDPEYYRRQQLTEKSDVYSFGV

SEQ ID NO: 29333 - protein, 335 aa, Polaromonas sp. JS666
MVSLPSSFDAVNFNAGQALALARKTFEIEAAAVQGLAGRVGPEFARAVELMLTCRGRVVVMGMGKSGHIGRKIAATLASTGTPAMFVHPAEASHGDLGMITGLDVVLAISNSGESEELTSILPVLSRQGVPLVAITGGLQSALAKQARVTLDSSVAQEACPLNLAPTASTTAQLALGDALAVALLDARGFREEDFARSHPGGALGRKLLTHVSDVMRSGDAVPKVGPDTSFTELMREMSAKGLGASAVVDAQQRVLGIFTDGDLRRLVEKGVDLRSSRAGDVMHAHPRTVRPDALAVEAVELMEQFSITSVLVVDDAGVLCGALNTNDLMRAKVI

SEQ ID NO: 29334 - protein, 185 aa, Rosa roxburghii
GHGGFGNVYKGTINGASTPVAIKRLKAKSSQGALEFKTEIELLSQLRHVHLVSLVGYCDDNGEMILVYDYMENGTLRDHLYDSENPPLPWEQRLQVCIGAARGLHYLRTGVKCMIIHRDVKSTNILLDDKWVAKVADFGLSKMGTTTMSKTHISTMVKGSFGYLDPEYYRRQQLTEKSDVYSFGV

SEQ ID NO: 29335 - protein, 324 aa, Dehalococcoides ethenogenes 195
MLKLSSIYAPINEGLKGVEDEFKLVSESRKQSFPEMAEMLDYILVGGKVLRPALSMLSAMCFGTGIKKVLPLATSSEMLHIATLVHDDAIDKADTRRSRRTVNSVWGLEKAILLGDFLFAHAAEVAAETDNMRIVTLFAQTLQIIASGELKQAYASFNPDQSYENYLERISGKTAALFVMATKGGAILADASPSDEEIMRSYGYNLGLSFQIVDDILDFVGNAKDMGKPVGSDLNNGTVTLPALLLMDRYPENNPIKDMLGATDRSAHVARAVEMINSSDIIDLSYKEAKRYADLACQDLSKLPKTAARESLYQLAEFIVERKN

SEQ ID NO: 29336 - protein, 752 aa, Methanosarcina acetivorans C2A
MKTRSYKIEKGYPHPPGATCDEEGVNFSIYSEHADYVELLLFDKHDDLEPVLVLSTNRVEELTRPGKVESLVEASKEIGTSKEIGTSKEIKTSQKIETAETPGIALNKTFHFWHVYIRGLKPGVHYAYRIGGPFDPSGGYRFDGGKVLIDPYSRGNNKTLWDREKASVPGDNLSTSMRSVVIDPSRYRWENNSHITAEKVYEMPGKWEDLFGKSRLQELNETIIYELHVGGFTRSPSSGVKTPGTFSGIIEKIPYLKELGITAVELMPVFDFDDTISPEGKRHYWGYDPICFFAPHSGYCKNPERGDHTKEFRDMVKALHKAGIEVILDVVFNHTAEGDHLGPVFSFKGIDNSIYYHLEPDRQYYSNYSGCGNTVNCNHPISQKLIVDSLKYWTEEMHVDGFRFDQGSILSLDTDGKVMKYPPVIWQIELDDSLGYIKVIAEAWDAAALNQVGYFPGPRWAEWNGYYRDEIRRFVRGDPGLVGRVASRIAGSPDLYQSESRLPINSVNFVTCHDGFTLNDLVSYNYKHNEANGENNRDGTDNNLSWNCGVEGETEDPEIEALRERQIKNFASILLLSIGVPMISMGDEVRRTQKGNNNAYCQDNGTGWFDWNLVGRNRDMFRFWKLMIDFRKRHTTILRPRYFTGKENERGLKDISWYGCKLNSPGWDDPYARALSFTMGEPGDEEDIHVMMNMYWEPLEFEIPGLRERNWHRAVDTFLPPPQDIAGAGEEVQVNGSSCTVQGRSVVVLISK

SEQ ID NO: 29337 - protein, 202 aa, Synechococcus elongatus PCC 6301
MLKFLKQVGDYAKESLQAAKAIGQGLGVTFDHMQRRPVTVQYPYEKLIPSERYRGRIHYEFDKCIACEVCVRVCPINLPVVDWVYNKETKKKDLKNYSIDFGACIFCGNCVEYCPTNCLSMTEEYELATYDRHELNYDNVALGRLPYKVTDDPMVTPFREFAYLPKGEYDPHVVPSDRPRAGQRPEELVDQYKQAAAANEEN

SEQ ID NO: 29338 - protein, 186 aa, Brassica napus
MPSHSGDDNVLQVLIKNFDVLALPLVALVYPLYASVKAIETKSLAEDEQWLTYWVLYAIISLFELIFSKLLEWFPIWPFLKLVGICWLVLPQFNGAEHVYRHFIRPFYMNPQRASTNIWYVPQKKFNFFPKRDDDDILTAAEKYMEKHGTDAFERMIVRKDSYERGRRGGGGGSNNYMISDDDYRY

SEQ ID NO: 29339 - protein, 671 aa, Yarrowia lipolytica CLIB122
MSNHSSSASFSTVLQTINMSPPLRKHRSRFPLFDSVQRVSYSYSSKNSTANPSSANVTGYCDNVLDTDTQDELSKCHNPDEVVALDVVLGKGSFGKVYKGRIRKTNQVCAVKQVNLDEEDDIDEIALEVNFLASLRCPFITEYYGSVVDNRDYTLWILMEYCGGGSCADLIKSQPFREDHIAVVMRDTLRGLEYLHKQRKVHRDIKAANILLTTEGDVKLADFGVSGEMGLSIKKMRSFVGTPYWMAPEVISKAGYDYKADIWSLGITALELADGSPPLSGLSPMKALSVIPDRECPSLPHGNQFTELFREFIDACMCKDPDSRSSATQLLTLKFVRTTKRPSILVPLIQQHHKFVRKLKPAQKRVLNAPPYKGEQTAWDFSSDAPTTPSPLISAASASTFTTAYTDAAEGDEGEEGWKEAEKEQLSEYPQPFNGVSRTPGISHIEIRPDSSLSTALSIHHPEKRARYETPPPSSPVSTVLQTIPVQAESSLRSFQQHAFPPYTPNQSPQRSPSLYPDQKRAQLLSHLMSIEQEYPGISEELLVQVCHSSPRGPYSALSPPISSKSGSSSPGRAGVNAGNRPFGAFHQSGIICPLPRSPLTAATSAASSHMAPQASPLKRTHSVFHKFGSNSPKMATTDTNKEGYYLAPVTPPPGPRCQPSRVDVTQWSER

SEQ ID NO: 29340 - protein, 323 aa, Prochlorococcus marinus str. MIT 9303
MVVPFAAIFGQAEDCDRILMSGLQVLLVAGTHGNEINAPWLLDQWSQTPELINTHGVAVVPVIGNPEAFALGRRYLDCDLNRSFRLDLLRSPSILDREVVRAKQLLSFFGPEGSTPCQIVIDLHSTTSAMGSTLVVYGRRPADLALAALIQARLGLPIYLHDGDDDQQGFLVERWPCGLVIEIGPVPQGLLKACIIEQTRLAVQACLEALSSISSGSPTYPDQFVVHSHLGSLDLPRDGLGQPAACVHPYLQGRDWQPLQMGAPLFLRPDGEVFRFEGRDSPIPVFINEAAYVEKHIAMSLTCREVCPLPEQWQGALQQLVDC

SEQ ID NO: 29341 - protein, 524 aa, Lactobacillus sakei subsp. sakei 23K
MNKVKGPKKHKLIEYANGPSLEEINGTVEVPEGKTFWKTLLAYSGPGALVAVGYMDPGNWSTSITGGQSFQYLLMSVILVSSLIAMLLQYMAAKLGIVTQMDLAQAIRARTSKSLGIVLWILTELAIMATDIAEVIGAAIALYLLFNIPLVIAVFITILDVMLLLLLTKVGFRKIEAIVVALIVVIFVVFAYEVALSNPDWAGVIVGLVPTAKTFATTPNVGGMSPLTGALGIIGATVMPHNLYLHSAISQTRKIDRNNEEQVAQTVRFSTWDSNIQLTMAFFVNALLLIMGVAVFKTGAVKDPSFFGLFEALSDTSTMSNGILASVARTGILSTLFAVALLASGQNSTITGTLTGQVIMEGFVHLRMPLWLRRLVTRLLSVIPVLICVMMTSNKPPLEEHQALNTLMNNSQVFLAFALPFSMLPLLMFTDSRVEMGDRFKNSLVIRVLGWLSVIGLTYLNMLGLPGQIEAFFGDQATAAQLALADHIAYVLIAAVLALLVWMIVELYKGNQRFEQQLAAQAAE

SEQ ID NO: 29342 - protein, 86 aa, Anabaena variabilis
ADSVNGAKIFSANCASCHAGGKNLGVAQKTLKKADLEKYGAYSAMAIGAQVTNGKNAMPAFKGRLKPEEIZBVAAYVLGKAEAEWK

SEQ ID NO: 29343 - protein, 252 aa, Oryza sativa (japonica cultivar-group)
MAAATPNGIPASRPLASSVPIEAVLFDIDGTLCDSDPLHHVAFQEMLLEIGYNNGVPIDEEFFINNIAGRSDVEAAQNLFPDWPLEKGLKFLEDKEAKYRSLAKERLEPVKGLAKVVQWVKDHGYKRAAVTNAPRINSELMISLLGLTDFFQAVIVGGECEKPKPAPFPYLKALKELQVSADHTFIFEDSASGTRAGVAAGIPVVAVATRNPEKSLLDAGATLIIKDYEDPKLWSALEEIDREEAKLKKADA

SEQ ID NO: 29344 - protein, 388 aa, Thermoanaerobacter tengcongensis MB4
MNFEDRIAKRAKAIEISTIRYFFNMAREVEGAISLAIGEPDFITPEHIRNAAKKALDEGMTGYTVNAGLIELRREIADYLKRRYSLYYDPEKEILVTIGATEAIYVTLSTLAEEGDEVLIPEPSFVAYHPCTVIAGAKSVFVPTYEEDDFILRADVLEKYITERSKVLILPYPNNPTGAVMPKEALEEIAKVVEKHDLIVVTDEIYSELVYGGFKHTSFASLPGMWERTITINGFSKSYAMTGWRLGYIAAPEHFTKHIAKLHQYAVTAAATMCQYAGIEAMRNGDEDIIKMREEYDKRRKFLLESVREMGLSCFEPKGAFYIFPSIKTTGLTSMEFAKRLLYEAKVAVVPGNAFGEHGEGYVRLAYATSMENLEEAVKRMKEFMAKL

SEQ ID NO: 29345 - protein, 399 aa, Propionibacterium acnes KPA171202
MAVKKVALLTAGGFAPCLSTAISGLIQRYTEVAPEVEIIAYKHGYEGLLKGDFLEVTDTVRKNAEILKRFGGSPIGNSRVKLTNAADLVKRGLVAEGDDPLKVAADRLVADGVDILHTIGGDDTNTTAADLAAYLAENNYGLTVVGLPKTIDNDVVPIRQSLGAWTAAEQGSRFAQNIVGEHNSGSRMLIVHEVMGRNCGWLTAATAAKYREWLDTQQWLPEIGLSKKAWDVHAVYVPEAHIDLEAEAARLNKVMDEVGNVTIFLSEGAGLDAIIEEMEKDGQEVPRDPFGHVKLDKVNLGAWFGKQFADKLGAEKVMVQKSGYFSRSAASNEADLELIGRCTDLAVDCALAGKTGVIGQDEENGDTLTNIAFDRIKGGKPFDTTQPWFTAMLSEIGQA

SEQ ID NO: 29346 - protein, 120 aa, Brassica napus
  misc_feature (30)..(30): Xaa can be any naturally occurring amino acid
  unsure (1)..(120): unsure at all Xaa locations
DARVSFEGGFAHVLAATQSPEEAGKKWFQXTSDAVREFLWVFEDTKNTNIENILSLSGDHRYRMNYMDFVQSHVENNADVTPSCAPVSESRASNFGLLKIDRRVRLTHFSEKPTGVDPKS

SEQ ID NO: 29347 - protein, 626 aa, Yarrowia lipolytica CLIB122
MQMLNRTRKGSGLHGSDRWLVYKSKLGDRCGQSLRLHYSISMEKDYSDTPESAEFTETHTGQVETAHMSKWQRFKYGFGPADISHIDTEGLTPMEITALKTANSPLQRGLKGRHLQMIAIGGSIGTGLFVGSGSTLANGGPAALLIAYGIIGIMLLLTMHALGELAVCFPVSGGFCTYFTRFIDTAWGFAMAWNYVMNWFVVLPLELVAASMTVNFWNEMNGTHINAAAWVSVFWAVITCINLFGVKGYGEAEFVFSIIKVVAIVGFVIFGIVMACGGGPERGDFHHYMGGTLWQHPGAFAHGFKGVCAVFVTAAFAFAGTELCGLAAAETENPRKMLPRATKQVFWRICLFYIVSLTIVGLLVPWNNDQLLNGSSSADAAASPFVIAIRLAGVKGLPSVMNVVIMISVLSVGNASVYGFSRTMAAMGESGQAPKIFAYIDREGRPIFGILVVLAFGLFSFIAAAGAETRNEVFNWLLALSGLSSVFVWGSICLAHIRFRLALKYRGRGTDELTFRAAFGVWGSVLGLILNCLVLMAQFWIALYPLGAKTPNASDFFQAYLAAPVVIAFWIFWKVWKRDGFLGLKDLDIDTGRREMDLDKVRAEMAIEDEELSRRSFLYRTYNFWC

SEQ ID NO: 29348 - protein, 199 aa, Prochlorococcus marinus str. NATL2A
MKKNPTIEFAKIVSGVFSNKEQALNNPKKFAHIQIHIRPLFFKTYNCFAFYSEQRYQHDIWNPYRQSINKLSQKEEIFIFSNYKIEDKERFTGGALDISLLDNISKYKLYKKPGCSMYFKEKKPGNFLGTIESGCKCYIEYGSDKTYVKSKVTVNKNILISEDSGYAIETDKKVWGSEFGPLIFKKIVNFDCFINEYWK

SEQ ID NO: 29349 - protein, 545 aa, Aspergillus oryzae
MAQDKDAKSQSPTSIMNDPKKASLPENAHIEVAAGSLTTETGIDDLPISMFVWLVAFTASIAGMLFGYDTGIISAVLVYIHDGLDNRTLTSNEKELITSLCSGGAFFGSILAGLTADKLGRKAAIYFGCALFTIGAVLQGAAYTIAQMAVGRVVVGFGVGSAAMVVPLYIAEVAPAKARGRLIGLNNMSITGGQVTSYAIGAAFANVNHGWRYMVGLGALPALILAALMPFCPESPRHLVYNHRQEEARGVLRRIYGHPSDVQLASVLASISAACDEAREINEGATRWTKMKQLHAVPSNLRALISACGLMVISQLSGFNTLMYYSSTLFALVGFDNPTAVGIVVAGTNFIMTWVNMMVIDKMGRRRLLLSTAWGMSVGLIAIAVAFSFIPVDLDTLDLKSNSVSPPAIVVLVFIIWFVLFYGVSVGNTAWMSTDFFPLEVRAMGTMWITCSSWGSNVIVSSTFLSMMKSMTPSGAFGFYAGICGVGYVLIYFFYPEVSGLSLEEIKEVFKHGFGVRYARNLRKERRDIIQERLRIQGKTAVVGH

SEQ ID NO: 29350 - protein, 127 aa, Mycoplasma gallisepticum R
MLSRIMNKLNKQNIINHVNNLQLKKSVPNFQVGDTVSVSIKIADEKRTRIQKFDGLVLRRKGSGLSETFIVRKESSGVGVEKNFHVHNPNIEIELKRKGKVRRAYISYMRERSGKSARIKEKVVNTK

SEQ ID NO: 29351 - protein, 297 aa, Zea mays
MESSKSPQSSKNSRIVVPSDSNRSRFDNDGFSSETASNQMVVFNSEAADELGENRLQKSVITKGISPSIGAFTVQCAKCFKWRLIPTKEKYEEIRERIIQEPFVCKRAREWRPDITCNDPEDISQDGSRLWAIDKPNIAQPPHGWERQIRIRGEGGTKFADVYYTSPTGRKLRSLVEVDRFLQENPEHVAQGVTLAQFSFQIPRPLRQDYVKKKPKLINASDEASTITSKSSEPEEVNPIAWAVPTKHEGDASEEASFADETLASEVVLTRKRKIGSSLSVEPNHLSDELEPKLEDA

SEQ ID NO: 29352 - protein, 293 aa, Dehalococcoides ethenogenes 195
METGTFKVKSGLAQMLKGGVIMDVTTPEQAKIAEEAGACAVMALERVPSDIRAAGGVARMADPTIIEKIMKVVSIPVMAKCRIGHFVEAQILESMGVDYIDESEVLTPADESFHVWKHDFKVPFVCGCRDLGEALRRIGEGAAMIRTKGEAGTGNIVEAVRHMRSVMGSVRRVQSMSADELSAYAKEINAPLELVLELHKTGKLPVVNFAAGGVATPADAALMMQLGADGVFVGSGIFKSSDPAAMAKAVVKAVTHYKDAKVLAEISKGLGDAMPGLDIKQIEPDKLISRRGW

SEQ ID NO: 29353 - protein, 362 aa, Glycine max
MEDGAGRGLECPKTMDGKASNGNGLEKEIPSCCLKAKASIPESEAKCHSTVVSGWFSASQTCSGKSGKAVYFNNPMWPGEAHSIKVEKILYKEKSEYQEVLVFESSTYGKVLVLDGIVQLTEKDECAYQEMIAHLPLCSIHSPKNVLVVGGGDGGVLREVARHSSVEHIDICEIDKMVIDVSRKFFPQLAVGFEDSRVHLHVGDAVDFLKSAPEGKYDAIIVDSSDPVGPAQELVEKPFFDTIARALRPGGVLCNMAESMWLHTHLIQDMISICRETFKGSVCYAWASVPTYPSGMIGFLLCATEGPPVDFVNPINPIEKLEGANEHKRELQFYNSEMHSAAFALPAFLKREVSLLRDLSLQ

SEQ ID NO: 29354 - protein, 1077 aa, Vibrio vulnificus CMCP6
MPKRTDIQSILILGAGPIVIGQACEFDYSGAQACKALREEGYRVILVNSNPATIMTDPDMADATYIEPIQWEVVRKIIEKERPDAVLPTMGGQTALNCALALEKHGVLAEFGVEMIGATADAIDKAEDRSRFDKAMKSIGLECPRADTAKTMEEAYKVLDMVGFPCIIRPSFTMGGTGGGIAYNKEEFEEICRRGLDLSPTNELLIDESLIGWKEYEMEVVRDKADNCIIVCSIENFDPMGIHTGDSITVAPAQTLTDKEYQLMRNASLAVLREIGVETGGSNVQFGINPKDGRMVIIEMNPRVSRSSALASKATGFPIAKIAAKLAVGFTLDELQNDITGGATPASFEPTIDYVVTKIPRFNFEKFAGANDRLTTQMKSVGEVMAIGRNQQESLHKALRGLEVGATGFDEMVDLDSPDALTKIRHELKEAGAERIWYIADAFRAGMSVDGVFNLTNIDRWFLVQIEEIVKLEEQVKAGGFAGLTQDVLRQMKRKGFSDARLSKLLGVAESEIRRLRDQFDIHPVYKRVDTCAAEFSSDTAYMYSSYDDECEANPTDKEKIMVLGGGPNRIGQGIEFDYCCVHASLALREDGYETIMVNCNPETVSTDYDTSDRLYFEPVTLEDVLAIARVEKPKGVIVQYGGQTPLKLARALEAAGVPIIGTSPDAIDRAEDRERFQQAVDRLGLLQPENATVTTMEQAVEKSREIGFPLVVRPSYVLGGRAMEIVYDEQDLRRYFNEAVSVSNESPVLLDRFLDDAIEVDIDAICDGERVVIGGIMEHIEQAGVHSGDSACSLPAYTLSQEIQDKMREQVEKLAFELGVRGLMNTQFAVKDNEVYLIEVNPRAARTVPFVSKATGAPLAKIAARVMAGQSLESQGFTKEIIPPYYSVKEVVLPFNKFPGVDPLLGPEMRSTGEVMGVGATFAEAYAKAELGCGNVYPEGGRALLSVREGDKQRVVDLASKLLKLGYKLDATHGTAVILGEAGINPRLVNKVHEGRPHILDRIKNNEYTYIVNTAAGRQAIEDSKVLRRGALAEKVNYTTTLNAAFATCMSHTADAKASVTSVQELHAQVQASLKA

SEQ ID NO: 29355 - protein, 792 aa, Xanthomonas axonopodis pv. citri str. 306
MKFSENWLRSHVPIQATRDELSATLTAIGLEVEEVTPLGESLGQVVVARIVEAVRHPEADRLQVCSVDAGQGELMQIVCGAPNARAGLVAPLALVGAKIGELTITAAKLRGVASNGMLCSAKELGLDSDASGLFELPDDAPVGQALAEYLGLPDASIEIKLTPNRADCFSVRGIAFDVAAACASEVVAFDAVAVAPVSTRSLAVELDAGKDAPRYCGRVIEGIDPAAKTPVWLAERLRRSGVRPVSLLVDITQYVMLELGQPMHAFDLETLHGPIGVRRSRAGEQLALLDGRQVTLDDSFLTITDAGRAVALAGLMGGLDTRVTETTRNVFLESAYFDPAAIMGRGRKLGLHTDAGHRFERGVDPALPPQAIEVATRLVLELAGGTPGPVVHAQLPEHLPQPVHIRLRRARIARVLGIQIDDADVVRMLRALGMHVEAVAEGWEVMAPSRRFDIAIEEDLIEELARIHGYDRVPTTLPGGASRIAMPSETQLDELSVRRQLVARELQETINYAFVDAALLERWQLTEGLVPLANPLSAELAIMRPRLLPGLVATLGRNAARQAGRVRLFELGKVFAAAADTGAAPGESQHVAAAVCGDALALQWGEPARKVDFHDLKGDLMALAAASGAQLEFQPSTQPFGHPGRSADIYREGVCIGWIGQVHPRLAKALDIDVDVIAFELQLMPLVQRTLPRAGELSRFPSVRRDLAFLVPDEVSWAAVSASVRTTVGPLLREVQLFDRYVGQGVEPGFKSLAMGLILQDNSRTLTDRDVDAVVADVVAVIEREHRARIRS

SEQ ID NO: 29356 - protein, 491 aa, Malus x domestica
MTSILMGYDIGVMSGASIYIEKDLKVTDTQIEIMIGVIEIYSLIGSAMAGKTSDWVGRRYTIVISGAIFFIGAILMGFSTNYTFLMCGRFVAGIGVGYALTIAPVYSAEVSPTSSRGFLTSFPEVFVNIGILLGYLSNYAFSFCPLDLGWRLMLGVGAIPSVGLAVGVLAMPESPRWLVMQGRLGEAKRVLDRTSDSKEESMLRLADIKEAAGIPEECNDDIVQVSGHSHGEGVWKELLVHPTPTVRHILIAAIGFHFFQQASGIDALVLYSPRVFAKAGITSTNQLLLCTVGVGLSKTVFTLVATFFLDRVGRRPLLLTSMAGMVGALVCLGTSLTIVDQHEGVRMTWAVILCLCCVLAYVGFFSSGIGPIAWVYSSEIFPLRLRAQGCGMGVAVNRLMSGILSMTFISLYKAITMGGTFFLYAAIGTVGWIFFFTMLPETQGRTLEDMEVLFGKFHKWRKANKLLEKKKRVAHGDIGTSDPDNRAHLLA

SEQ ID NO: 29357 - protein, 713 aa, Bacillus cereus G9241
MLKVKRPFDAYLDEMNKITILLPHAYGTSRTFRLQEGSNVKDLPIAHTIALPDATKYECFIEEPLDVGKYYTVRDERNEETDLQIGAVIRTAIFDEKYYYEGTDLGAVHKKEATTFKVWAPTARLAKVRIYKSDKEYIDHEMYREANGVWAHTLQGDLAGEKYTFLVCINLIWNEAVDPYAKSVTVNGKYGVVIDLEKTNVTKRGQLPPLQAMTDAILYELHIRDATIHPNSGVSKKGTYKGLMEEGTTGQNGTLTGLSHIKDLGVTHVELLPLYCFGGVDEANPSSAYNWGYNPLYYNTPTGFYATNPSDPYNRIVECKQLIETFHEHGIRVIIDVVYNHVYERELSSFEKLVPGYYFRHGENGMPSNGTGVGNDIASERKMMRKFIVESILYWLTEYNVDGFRFDLMGILDVDTINIIEKEVRNIKRDALLLGEGWDLQTPLPLEEKATLNNAKKMPHIAQFNDQFRDGIKGSTFHINKRGFAFGGYVDCHHLQYIASGSLLSMKETGLFLEPAQSINYVECHDNMTMWDKLMRSNEESEEILKKRHLLATAMVILSQGIPFLHAGQEFYRTKQGNENSYNANDEINQLDWDRKEKEIETVNYIKGLIAIRKEHGAIRLQNADLIKKYMTFLQTSPEVLAYHLEGVESFGPWKEIVVLFNSGLEAKTVQLPKEETWHVLVNEKQAKIEPISSFRGKELRLAPISTYILTIM

SEQ ID NO: 29358 - protein, 291 aa, Triticum aestivum
  misc_feature (120)..(120): Xaa can be any naturally occurring amino acid
  misc_feature (225)..(225): Xaa can be any naturally occurring amino acid
  unsure (1)..(291): unsure at all Xaa locations
MNFKGARMPSAPAGAGALVKLGLLGGAALYLGNKTLYNVEGGHRAIVFNRLEGIKDKVYPEGTHIVIPWFERPIIYDVRARPNLVESTSGSRDLQMVRIGLRVLTRPMPERLPTMYRTLXGENYNERVLPSIIHETLKAVVAQYNASQLITQREAVSREIRKILTERAKNFNIALDDVSITSLSFGKEFTHAIEAKQVAAQEAERAKFIVEKAEQDKKSAIIRAXQGEAKSAELIGNAIANNPAFVALRQIEAAREIAHTIAASNNKVFLDSGDLLLGLQSLKMLNNNNKK

SEQ ID NO: 29359 - protein, 115 aa, Escherichia coli O157:H7 EDL933
MSTTIEKIQRQIAENPILLYMKGSPKLPSCGFSAQAVQALAACGERFAYVDILQNPDIRAELPKYANWPTFPQLWVDGELVGGCDIVIEMYQRGELQQLIKETAAKYKSEEPDAE

SEQ ID NO: 29360 - protein, 453 aa, Staphylococcus epidermidis RP62A
MGVILLNSNNNNHEQQRSLDEINNTINFNHNDSASQKFLAFLGPGLLVAVGYMDPGNWITSMQGGAQYGYTLLFIILISSLSAMLLQSMTVRLGIATGMDLAQMTRHFLNKPVAIMFWIIAELAIIATDIAEVIGSAIALDLIFGIPLIVGALITVFDVFLLLFIMKFGFRKIEAIVGTLIFTVLAIFVFEVYISSPQITDMLNGFVPHKEIITNQGILYIALGIIGATIMPHNLYLHSSIVQSRKYDRHSIHEKAQAIKYATIDSNIQLSIAFVVNCLLLTLGAALFFGTKTEDLGGFYDLYLALKTEPALGATLGGIMSTLFAVALLASGQNSTITGTLAGQIVMEGFLKLSIPNWLRRLITRSLAVIPVIICLIVFKGNTEKIEQLLVFSQVFLSIALPFSLIPLQLATSNQNLMGPFKNKTWINIISWLLIIVLSGLNVYLIIQTFQEL

SEQ ID NO: 29361 - protein, 478 aa, Arabidopsis thaliana
MASTAATAALSIIKSTGGAAVTRSSRASFGHIPSTSVSARRLGFSAVVDSRFSVHVASKVHSVRGKGARGVITMAKKSVGDLNSVDLKGKKVFVRADLNVPLDDNQNITDDTRIRAAIPTIKFLIENGAKVILSTHLGRPKGVTPKFSLAPLVPRLSELLGIEVVKADDCIGPEVETLVASLPEGGVLLLENVRFYKEEEKNEPDFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 29362 - protein, 216 aa, Zea mays
MKLEVMPKPKQRVLEAQQREEAMEMSGLDLWKHEKPPRICPLPPSLPPPPPAFDEAALVPPLNFAVVDDGIFRSGFPGTANFRFLKSLNLRSIVYLCPEPYPGTNTEFLEKNGIRLHQFGIEGRKEPFVNIPDDKIREALKVVLDPRNQPLLIHCKRGKHRTGCVVGCLRKLQEWCLSSVLDEYHRFAAAKARITDQRFMEMFDVSSLKHLTPSHC

SEQ ID NO: 29363 - protein, 698 aa, Yarrowia lipolytica CLIB122
MFTSIPIIDLSEDTPTILAKLRPALFNVGFCYIKNYGVDPGLIQRVTELGKQLFDLPQTEKQRIDMSNSPHFLGYSRLGDEITKNQTDWREQMDLATELPAPKDDEPLYRRLRGPNQWPDEKLIPGFRQAFEAYIEQMGPVSIHFVSLIAQALGLEADAFAHLFEQHQQHKLKVVRYPDVDEVKVKVEGETKVKGGVKKEDPVDIDVKLEPQESSLHADETKVKLEDEPVEIKQDDDSIERKASVKQECHAERSIYTQGVGPHKDSELTSYLLQCTPHRGLQVLNSNNEWIDVPPIEGTLVVAMGQAMEALTRGYCVSTTHRVLAPEAGSGSRFSIPFFQGISYDANFRDFKLPSEVEESLKKNKVVTEDTGQYRHDMFSNIGEATFMNRIRSHPTVAKRWYKDVIDVTKLDTLPRVLSRLSRIFAGAEKTMMFHNSPLPLSFDDFARSVLEYSHEKVTRDDLSQLFALWPNLYRTEVRRDGMLMLSLENITSVALTQTRDARQKQFDDLCWKWLRQHPVTWSKGPEIDQKKQSSFTKKRGISETAESLRKTPVTKQRIFKLAKPDTKLGGTVLERIKARKAASAHLNKKSEQEEKSESQQRFLDSNIPRVVDVLVGAGKGNSTSIPMDRAIRMVNDSVRRNLSEKEARAILVRVSQVVPSFCKLVEVGDQAVLRLGKKTRGAVQAELREFEESEHSK

SEQ ID NO: 29364 - protein, 89 aa, Prochlorococcus marinus str. NATL2A
MNSEPITQESSTRICNHMNKDHEDAVNAYAKYYGKIKTFKSAKMISLSPEAVQLKIDDETLEIKFDHILQDCSDAHKTLVRMIKAIPKL

SEQ ID NO: 29365 - protein, 507 aa, Oryza sativa
MAAVAGTGVFAEILEGEVYRYYADGEWRVSASGKSVAIVNPTTRLTQYRVQACTQEEVNKVMETAKVAQKAWARTPLWKRAELLHKAAAILKEHKTPIAECLVKEIAKPAKDAISEVVRSGDLVSYTAEEGVRILGEGKLLVSDSFPGNERNKYCLSSKVPLGVVLAIPPFNYPVNLAVSKIGPALIAGNALVLKPPTQGAVAALHMVHCFHLAGFPKGLINCVTGKGSEIGDFLTMHPGVNCISFTGGDTGIAISKKAGMVPLQMELGGKDACVVLEDADLDLVAANIVKGGFSYSGQKCTAVKVVLIMESVADIVVEKVKAKLAKLTVGPPEADSDITPVVTESSANFIEGLVMDAKEKGATFCKEKGATFCQEYRREGNLIWPLLLDHVRPDMRIAWEEPFGPVLPVIRINSVEEGIHHCNASNFGLQGCVFTKDINKAIMISDAMETGTVQINSAPARGPDHFPFQGLKDSGIGSQGITNSINMMTKVKSTVINLPSPSYTMG

SEQ ID NO: 29366 - protein, 745 aa, Pseudomonas syringae pv. tomato str. DC3000
MSQLDKDAFEVLLANCADEPIQFPGAIQPHGLLFTLKEPELTILQVSANVQSVLGKVPDQLAGQTLDCVLGAGWAEVIRSTSANDSLVDVPRLLMSVEGVEFEALLHRSQEALVLELEIQDKAAQAISYSERTGNMGRMLRQLHAAADLQTLYEVSVREIQRMTGYDRVLIYRFEEEGHGQVIAEASAPAMELFNGLFFPASDIPEQARELYRRNWLRIIPDANYTPVPLVPQLRPDTQQQLDLSFSTLRSVSPIHCQYMKNMGVLSSMSVSLIQGGKLWGLISCGHRTPLYVSHELRSACQAIGQVLSLQISAMEALEVSRQRETKIQTLQQLHQMMATSDTDVFDGLAQQPQLLMDLVGATGVAIIEDRQTHCYGNCPEPSDIRALHTWMMAGGEPVYASHHLSSVYPPGEAYQTLASGVLAMSLPKPVDNGVIWFRPEVKQSVQWSGDPNKPLNLDASDNTLRLQPRTSFEIWKVEMTGIATKWSHGDVFAANDLRRSALENDLARQVSKEQQAVRARDELVAVVSHDLRNPMTVISMLCGMMQKSFSSDGPHTSRRISTAIDTMQQAASRMNVLLEDLLDTSKIEAGRYTITPQPLEVSQIFEEAYTLLAPLAMDKSIEISFNAEPDIKVNADPERLFQVLSNLIGNAIKFTPKLGRIGVAAMSNGDEVVFTVRDSGEGIPPEQLPHIFERYWTVKEGNPTGTGLGLYISQGIIKAHGGELAAQSQVGHGSEFRFTVPIAH

SEQ ID NO: 29367 - protein, 198 aa, Escherichia coli CFT073
MNMSASALVCLAPGSEETEAVTTIDLLVRGGIKVTTASVASDGNLAITCSRGVKLLADAPLVEVADGEYDVIVLPGGIKGAECFRDSTLLVETVKQFHRSGRIVAAICAAPATVLVPHDIFPIGNMTGFPTLKDKIPAEQWQDKRVVWDARVKLLTSQGPGTAIDFGLKIIDLLVGREKAHEVASQLVMAAGIYNYYE

SEQ ID NO: 29368 - protein, 462 aa, Polaromonas sp. JS666
MSHFCPGYPKPREKRSSVWALFRSARNSWIDALYARSYSMQMGEVHLPGVDLYMVNDPALVRRMLSGQPDQFPKSPLLADALRPLLGDSILTTNGDQWQRQREMMNPAFAQAKLDVAFPVMRAAADDLVERLTEAAQRGSELNIEVELTHVTADIIYRTIFSEPLSGDDAHKVFDAFARFQALAPKLMLPSMYGVRWLVWPWNVWQSRRAASDIRRLLEKLIRSRHEAWLRGDDLGKNDILSALMTSRDRKTGEPFSFDELVDQVAVLFLAGHETSASALTWAVYLLSAVPEVQERVHQETCRVFGQRTPEQRDMKALVLTRNVFRETLRLFPPVGFMARESAQTCPMRDKMVPKGASVMISPWLIHRHRERWSDPDAFNPDRFDDDASRESIRQSYLPFGMGPRVCLGAAFALQEATLILASLIRAFRLETVTGHTPMPVGRLTIRSDNGVRLRIFKREDQ

SEQ ID NO: 29369 - protein, 998 aa, Pyrus pyrifolia
MLLFLPLLLLLLPPLPTTLSLNQEGLYLQHFKLSLDDPDSALSSWNDADSTPCNWLGVSCDDASSSYPVVLSLDLPSANLAGPFPTVLCRLPNLTHLSLYNNSINSTLPPSLSTCQNLEHLDLSQNLLTGGLPATLSDVPNLKYLDLTGNNFSGPIPDSFGRFQKLEVLSLVYNLIESTIPPFLGNISTLKMLNLSYNPFHPGRIPAELGNLTNLEVLWLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEEILMLHNEFSGEIPARLGECQSLARVRLGHNRLSGEVPVGFWGLPRVYLMELAENELSGPIAKSIAGATNLSLLILAKNKFSGPIPEEIGWVKNLMEFSGGDNKFSGPLPEGIARLGQLGTLDLHSNEVSGELPVGIQSWTKLNELNLASNQLSGKIPDGIANLSVLNYLDLSGNRFSGKIPFGLQNMKLNVFNLSYNQLSGELPPLFAKEIYRSSFLGNPGLCGDLDGLCDGRAEVKSQGYLWLLRCIFILSGLVFIVGVVWFYLKYKNFKKANRTIDKSKWTLMSFHKLGFSEYEILDCLDEDNVIGSGASGKVYKVILSSGEVVAVKKLWRGKVQECEAGDVEKGWVQDDGFEAEVETLGRIRHKNIVKLWCCCTARDCKLLVYEYMQNGSLGDLLHSSKGGLLDWPTRFKIALDAAEGLSYLHHDCVPPIVHRDVKSNNILLDGDFGARVADFGVAKEVDVTGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDVSDHGSVA

SEQ ID NO: 29370 - protein, 657 aa, Ashbya gossypii ATCC 10895
MSVELAEKLLACVAHEQQQDVEVTARQLRELPLAQLVAAGLAVSRLQLENVRTGYGGKVYAELGPARGLADELVLGSTGVGDIVRVFAPKSRDEALEGVVFRCSAQQVVVALDEGGEAAALQLQSASSVVMVKTVNTVTYKRMESTLRKLAEHGDEISNPIAQYLLCQRPFHAQPPEQGVEFHNPDLNASQRDAVAFALRNEISIIHGPPGTGKTHTLVELIRQLYDRGHRVLVCGPSNIAVDTVLERLSRPIPGAELLRVGHPARLLPGNLAHSLDILAKEGDGGSIVRDIGREINQRIADVRKIKSSRDRKKAWQEVRDLRKELKQRERNVVSELILAARVVVCTLHGSSAYSLCHMYDKCARLFDTVIIDEVSQSLEPQCWIPLISHYQSNISKLVIAGDNKQLPPTVKTEDDAHVRQVLSTTIFDKLERHYGDQFKKLLDVQYRMNERIMAFASESLYAGKLKAWQGVVGLASADLPGVDESDDTSAPLVWYDTQGDDFPEAEEAAGGPALMASKFNENEAYLVLHHISQLRACNVPQEAIGVISPYNAQVALLKKIIHGQHPLVEISSVDGFQGREKECIVLSLVRSNDSFDVGFLRDERRLNVAMTRARRQLCVIGNMETLERSQSQFLRSWVRWSEEHSEIRYPDLSEIL

SEQ ID NO: 29371 - protein, 247 aa, Pseudomonas syringae pv. syringae B728a
MQTAAALRHAKRILVITGAGLSADSGLPTYRGVGGLYNGKTDDGLPIEMALSGPMLRRDPELCWKYIAELGKACLGGEPNVAHYAIAQLQRIKPECWVLTQNVDGYHRAAGSPPERLIEIHGQLSPLFCQSCGAEDSQLSEHLQRPLPPLCPACSGILRPSVVLFQEMLPEKALETLHEQLAKGYDAVLSIGTTASFPYIHEPVIRTRVSGGFTAEINPQPTDHSAQMDVFLPYRAAHVMAELISHI

SEQ ID NO: 29372 - protein, 998 aa, Pyrus pyrifolia
MLLFLPLLLLLLPPLPTTLSLNQEGLYLRHFKLSLDDPDSALSSWNDADSTPCNWLGVECDDASSSSPVVRSLDLPSANLAGPFPTVLCRLPNLTHLSLYNNSINSTLPPSLSTCQTLEHLDLAQNLLTGALPATLPDLPNLKYLDLTGNNFSGPIPDSFGRFQKLEVLSLVYNLIESTIPPFLGNISTLKMLNLSYNPFHPGRIPAELGNLTNLEVLWLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEEILMLHNEFSGEIPARLGECQSLARVRLGHNRLSGEVPVGFWGLPRVYLMELAENELSGPIAKSIAGATNLSLLILAKNKFSGPIPEEIGWVKNLMEFSGGDNKFSGPLPEGIARLGQLGTLDLHSNEVSGELPVGIQSWTKLNELNLASNQLSGKIPDGIANLSVLNYLDLSGNRFSGKIPFGLQNMKLNVFNLSYNQLSGELPPLFAKEIYRSSFLGNPGLCGDLDGLCDGRAEVKSQGYLWLLRCIFILSGLVFIVGVVWFYLKYKNFKKANRTIDKSKWTLMSFHKLGFSEYEILDCLDEDNVIGSGASGKVYKVILSSGEVVAVKKLWRGKVQECEAGDVEKGWVQDDGFEAEVETLGRIRHKNIVKLWCCCTARDCKLLVYEYMQNGSLGDLLHSSKGGLLDWPTRFKIALDAAEGLSYLHHDCVPPIVHRDVKSNNILLDGDFGARVADFGVAKEVDVTGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDVSDHGSVA

SEQ ID NO: 29373 - protein, 919 aa, Synechococcus elongatus PCC 6301
MSEAEWVTIEGSPSILDVLVSQTETAFSLDVATLFPFELDDFQKEAIAALDQGRSVVVCAPTGSGKTLIGEYAIYRALARGKRVFYTTPLKALSNQKLRDFREQFGSDRVGLLTGDTSIARDAPIVVMTTEIFRNMLYGTRIGEVGTSMIDVETVVLDECHYMNDQQRGTVWEESIIYCPPTVQLVALSATVANGGQLTDWIDQVHGPTDLIYSDYRPIPLAFSFCGNNGLFPLLDETGKSIHPSFKVRRKTKGAKHDRKGREIPEIPSLGFVVGQLQQRQMLPAIYFIFSRRGCDKAVRDLGPISLVNADEAARLKQRVNAFLAQSPEAARSGHVEPLLRGIASHHAGVLPAWKGLIEELFQEGLVKVVFATETLAAGINMPARTTVIASLSKRTDSGHRLLLPSEFLQMSGRAGRRGLDDQGYVVTVQSRFEGSQEAAHLATVGPDPLVSQFTPSYGMVLNLLQKHSLEEAKELVERSFGRYLATLSLKPEQEKIAAIAAERDRLQAELADVDFATLAEYDKLYGRLKEEKRLLKILHEQAEEVVHRDLAMALSFAVAGTILSLKGRHVPVPEPLPAVLIAKIPGSGQFPWLLCLGMDNRWVVATTSDVVGLHAELARISAVDFLHPPAQLHKPGQHHKGDEATAWIAEKLWELSQRHHLALAGSDLAEEVVQQAEQVEAVNTLLINHPVHCWQNRKRLHKRQQQLQALEDEIGDRRARLEKLGQRHWQEFLSLMSILENFSCLEDLKPTEMGQNVAALRGDNELWLGLVLMSGELDGLTPAEFAAASEALVTEVSRPDLWTRFDVPPAVEDALMGVRGLRRQLQQQQSRRNVFTPIWLELDLTGLVKAWAEGMEWNELCAATSLDEGDIVRVLRRTIDFLAQIPHMPYLQGGVKNTASTALGLINRFPVKDMEDEA

SEQ ID NO: 29374 - protein, 987 aa, Pyrus pyrifolia
LPTLPTTLSLNQEGLYLQHFKLSHDDPDSALSSWNDADSTPCNWLGVECDDASSSSPVVRSLDLPSANLAGPFPTVLCRLPNLTHLSLYNNSINSTLPPSLSTCQNLEHLDLSQNLLTGGLPATLSDVPNLKYLDLTGNNFSGPIPDSFGRFQKLEVLSLVYNLIESTIPPFLGNISTLKMLNLSYNPFHPGRIPAELGNLTNLEVLWLTECNLVGEIPDSLGRLKNLKDLDLAINGLTGRIPPSLSELTSVVQIELYNNSLTGELPPGMSKLTRLRLLDASMNQLSGPIPDELCRLPLESLNLYENNFEGSVPASIANSPHLYELRLFRNRLTGELPQNLGKNSPLKWLDVSSNQFTGTIPASLCEKRQMEELLMIHNEFSGEIPARLGECQSLTRVRLGHNRLSGEVPVGFWGLPRVYLMELVENELSGTIAKTIAGATNLTLLIVAKNKFWGQIPEEIGWVENLMEFSGGENKFSGPLPESIVRLGQLGTLDLHSNEISGELPIGIQSWTKLNELNLASNQLSGKIPDGIGNLSVLNYLDLSGNRFSGKIPFGLQNMKLNVFNLSNNRLSGELPPLFAKEIYRSSFLGNPGLCGDLDGLCDGRAEVKSQGYLWLLRCIFILSGLVFIVGVVWFYLKYKNFKKANRTIDKSKWTLMSFHKLGFSEYEILDCLDEDNVIGSGASGKVYKVILSSGEVVAVKKLWRGKVQECEAGDVEKGWVQDDGFEAEVETLGRIRHKNIVKLWCCCTARDCKLLVYEYMQNGSLGDLLHSSKGGLLDWPTRFKIALDAAEGLSYLHHDCVPPIVHRDVKSNNILLDGDFGARVADFGVAKEVDVTGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQATKKEGKLTPYYYEDVSDHGSVA

SEQ ID NO: 29375 - protein, 52 aa, Zea mays
  misc_feature (24)..(24): Xaa can be any naturally occurring amino acid
  unsure (1)..(52): unsure at all Xaa locations
PDGLRIVVSVDGKGKSFVRAVVWXPGSAVSEFDGDSKRVLSCDFKPKRLFRI

SEQ ID NO: 29376 - protein, 125 aa, Brassica napus
MEMEFESRYEINRTVEFIISKSFTRIALQFPDELLKESTKVVRALKSKLKEMNSENDREVRFFVMADTTYGSCCVDEVGALHIDSQCVVHYGQTCLSPTSVLPAFFVFSFSSPFLSPPFTPPYSS

SEQ ID NO: 29377 - protein, 544 aa, Arabidopsis thaliana
MAVVSKNQTQQQTPNPGGGVSRIEDSTNGKTCHQCRQKRTDLVGSCVTKKKDKTCPIKLCTKCILNRYGENAQEVALKKDWICPKCRGNCNCSYCMKKRGQKPTGILVHTAKKTGFSSVSELLKTSGSDKYFYTKKVKPENSIEQKHVSIKKSRKTKREELKDINNGCSNENVVVKKSNPKKIKLSDSVHATTEVIKKVLAEGKKKKTTAKGIKENNVAEKIKRIKPALKKKEEDQVEIKIPQGNISITVSGIDLAPEDAGNVFQFLEFCSAFGKALDLRKGQAECVIREMLSGRSKRRQQYSTLTQMIIQLLTVILEDRGETSVCLSATDPSWFTTIGECLSESEVKLDDFPPEMFEKGISQYEKLNSSKRLKLLNFLCDETLGTLVMRNCIDSQNIESVERKKEAKEKINAAKDKEKQLKQKLQDELAQAVKAKNGIPLLITEHDAIVSRINAETQEVYSEMQNAIDMLSKKSQGSDDAVRTNPVELDDNGLIFWRLKSYNDEQNILLQDLGSWNEVCPHEKWFSFSSEQKPEIEKYISFIR

SEQ ID NO: 29378 - protein, 228 aa, Schizosaccharomyces pombe 972h-
DRCGLLLERHAKIATDGQKPFLKKDSDFKEVPSGDIDLETAISLIKPTVLLGCSGQPGKFTEKAIREMSKHVKHPIIFPISNPTTLMEAKPVQIDEWSNGKALMATGSPLPPLTRNGKEYVISQCNNALLYPALGVACVLSRCKLLSDGMLKAASDALATVPRSLFVADEALLPDLDNAREISRHIVFAVLKQAISEGMSTVDLPKDDAKLKEWIIEREWNPEYRNFV

SEQ ID NO: 29379 - protein, 380 aa, Oryza sativa (indica cultivar-group)
MCEKDQNFHWGYDLFRDPFAPIGYYGPPHGYGDGNYCDLHYARDASHPDETHLHSSALTYDLYNPSVGIYHPGNAGEHDHDTVYIEPTSSNSCPDTDDSFPMDEEVGKRFYPMVPVPHVPKINGEIPSVDEATMDHERLTERLRLYELVEHKVKGDGNCQFRALSDQLYQSPDHHEFVRQQIMSQLKSNRDAYDGYVPMAYDDYLEKVSRNGEWGDHVTLQAAADKYGVKIFVMTSFKDTCYIEIQPKVQKSNKVVLLSFWAEVHYNSIYPQNGRRRRGRGDGGRSLTTTTITTIDAWAAKLFFLDQDDPEKRLIKMTQKESWCSSSCWSDDDHGHLIVGGGHCGDDYISPNDIEDTWKYGIHGRNNFVLVRSGPVYSCC

SEQ ID NO: 29380 - protein, 170 aa, Boechera stricta
SLLLSLASAEQCGRQAGGVFCPNGLCCSEFGWCGDTEPYCKQPGCQSQCTPPGPTPTGDLSGIISSSQFDDMLKHRNDAACPARGFYTYNAFITAAKSFPGFGTSGDTATRKKEIAAFFGQTSHETTGGWASAPDGPFSWGYCFKQEQNPTSNYCEPSATWPCAPGKRYY

SEQ ID NO: 29381 - protein, 239 aa, Thermoplasma acidophilum
  misc_feature (1)..(1): Xaa can be any naturally occurring amino acid
  misc_feature (17)..(17): Xaa can be any naturally occurring amino acid
  misc_feature (62)..(62): Xaa can be any naturally occurring amino acid
  misc_feature (122)..(122): Xaa can be any naturally occurring amino acid
  misc_feature (126)..(126): Xaa can be any naturally occurring amino acid
  misc_feature (150)..(150): Xaa can be any naturally occurring amino acid
  misc_feature (215)..(215): Xaa can be any naturally occurring amino acid
  misc_feature (224)..(224): Xaa can be any naturally occurring amino acid
  unsure (1)..(239): unsure at all Xaa locations
XSLIFLDYDGTLVPIIXNPEESYADAGLLSLISDLKERFDTYIVTGRSPEEISRFLPLDINXICYHGACSKINGQIVYNNGSDRFLGVFDRIYEDTRSWVSDFPGLRIYRKNLAVLYHLGLXGADXKPKLRSRIEEIARIFGVETYYGKXIIELRVPGVNKGSAIRSVRGERPAIIAGDDATDEAAFEANDDALTIKVGEGETHAKFHVADYIEXRKILKFIEXLGVQKKQEGHHHHHH

SEQ ID NO: 29382 - protein, 247 aa, Propionibacterium acnes KPA171202
MRIMDSPSLDEKFHAVLFDLDGVLTPTALIHMRAWQEMFNEELSRHQGQNPYTDEDYFAYVDGKPRYDGVRDFFASRGITLPEGDPSDGPAAQTICGLGNRKNDLFNTVLARDGIRPYPGSRRWVDRLHESGMAMAVVSSSRNAAAVLKAAGMVEDFSVLVDGNRSKAERLPGKPAPDTYLRGAELLGVPAEQCVVVEDAVSGVRAGAAGGFGMVLGVNRGVGADRLREAGADRVVDDLDEMVEEMA

SEQ ID NO: 29383 - protein, 800 aa, Staphylococcus epidermidis RP62A
MLISNEWLKDYVNVDQSVQALAERITRTGIEVDDIIDYTKDIKKLVVGHVLSKTPHPNADKLNICQVDLGEEEPVQIVCGAPNVDEGQHVIVAKVGGRLPGGVKIKRAKLRGERSEGMICSLQEIGISSHVTPKNYESGIYVFPEAVKPGTDALEALYLNDQVMEFDLTPNRADALSMIGTAYEVAALYQTKMNKPQLTSNESQESAKDELTIEVKNEDKVPYYSARVVHDVTIGPSPVWMQFRLIKAGIRPINNVVDISNYVLLEYGQPLHMFDQEQIGSQSIEVRQAKKDETMRTLDGEERRLLDTDIVITNGKDPIALGGVMGGDFSEVTEQTRHVVVEGAIFDPVSIRHTSRRLNLRSESSSRFEKGIATEFVDEAVDRACYLLETYASATVLKDRISYGDLGSFVTPIKITADKVNRTIGFNLTDEEIIDIFEQLGFKTENKNGDIIVNVPSRRKDISIKEDLIEEVARIYGYDDIPSTLPVFKDVTSGELTDRQFKTRTVKETLEGAGLDQAITYSLVSKNHATDFALQNRSTIELLMPMSEAHSTLRQSLLPHLIDAVSYNVARKNTNVKLYEIGRVFFGNGEGELPDEVEYLSGILTGDFVNNKWQGKKEPVDFYLTKGIVERVAEKLNLQFDFRAGQIDGLHPGRTAIVSLNGKDIGFIGELHPTLAANNDLKRTYVFELNYDAMMEVSVGYINYEPIPRFPGVTRDIALEVNHEVTSSELLSIIHENGEDILNDTLVFDVYEGEHLEKGKKSIAIRLSYLDTENTLTDERVNAVHDKILEALKKHGAIIR

SEQ ID NO: 29384 - protein, 435 aa, Magnetospirillum magnetotacticum MS-1
  misc_feature (431)..(431): Xaa can be any naturally occurring amino acid
  misc_feature (433)..(433): Xaa can be any naturally occurring amino acid
  unsure (1)..(435): unsure at all Xaa locations
MANSVGMAIGGRFKGERLNRPDLPLFDYNVYAICSDGDLMEGVSQEAASIAGHLRLSNLCWIYDNNTITIEGHTELAFSEEVAARFLAYGWQVLRVADANDTHAISAAIETFLQSSDRPTLIIVNSIIGYGAPTKQNTSKAHSDALGPDEVKGAKRAYGWPEESEFLVPDGVYDTFSEGIGKRGAALYAQWQGFFDAAKAADAEHAEDLSAFLEGRLPEGWDKDIPVFAPDPKGLATRESSGKVLNAIAQHVPFLLGGSADLAPSNKSNLTFEGAGSLTPFEPGGRNIHFGVREHAMGSIVNGLGLVGLRAYGATFLVFADYMRPPIRLAALMELPVFHIFTHDSIGVGEDGPTHQPVEQLLSLRCIPGLVTLRPADANEVAEAYRVIFSLKDQPAVLALSRQPLPTFDRSKYGAASGTAKGAYVLADCEXHXRT

SEQ ID NO: 29385 - protein, 146 aa, Brassica napus
  misc_feature (51)..(51): Xaa can be any naturally occurring amino acid
  misc_feature (67)..(67): Xaa can be any naturally occurring amino acid
  misc_feature (71)..(71): Xaa can be any naturally occurring amino acid
  misc_feature (124)..(124): Xaa can be any naturally occurring amino acid
  unsure (1)..(146): unsure at all Xaa locations
YFKRNNGKNMGTIRTSKKANLALAKDNPRFEFKDKDTPSKTSPRFQPPTKXLKKCRILDSIISHGCXLGEXASTFIIGERSRLDYGVELQDTLMLGADSYQTESEIASLLAEGNVPIGIGRDTXIRKCIIDKNAKIGKNVMILNSD

SEQ ID NO: 29386 - protein, 401 aa, Zea mays
MADAGEGRRVCGMPEKAQLHVAMLALQFGYAGFHVVSRLALNMGISKLVFPVYRNIIALCLLVPFAYFLEKKDRPQLTLNFVIQFFLLALCGITANQGFYLLGLDNTSPTFASAIQNSVPAITFAMAAALRIEKVRLDRRDGVAKVAGTLACVAGASVITLYKGPTIFGPSGGGGGGDKLQLQQVAVAVAAGEKNWTLGCVYLIGHCLSWSGWLVLQAPVLKKYPARLSVTSYTCFFGVIQFLVIAAFMERDADAWKFHSGSELFTILYAGFIASGVAFAVQIWCIDRGGPVFVAVYQPVQTLVVAIMASLTLGEKFYLGGIIGAVLIIAGLYLVLWGKSEERARIARDAAAALVVSGAGDREGLLAAGGGGGGGIRSKAAASAAVTQPLLLPSSTSTDNV

SEQ ID NO: 29387 - protein, 478 aa, Solibacter usitatus Ellin6076
MFANYINGEWIAAGATFENRNPANTDEVVAVMAKGSAADIAAAADAAGAAFPAWSAMSGPARGNILYKAADILDKTFDSVAADMTREEGKTLPEAKGEVRRAINILRYFAGEGSRLPGMLVPSERDRVHMFALRKPVGVVGLITPWNFPSAIPAWKLAPALICGNTVVIKPASAAPLSAWRIVEALHQAGIPKGVVNFIAGSGGELGQALVNAAPLKAVSFTGSCEIGDWLHAEASKRRLRIQLEMGGKNPTIVLADADFGSAVENVVNAAFFSTGQKCTATSRAIVEDAIYDKFVAAVVARTRKLKVGDGMQPGIDIGPCVDQSQMETVLRYIEIGRKECGEPACGGKRLTEGALAKGYFVEPTVFAGVTPDQTIAREEIFGPVLAIMRARDFEDAMSIANSIPFGLSSSIQTTNLSRAFEYIYRAEAGLLTVNLPSAGVEYQLPFGGTKDSSFGPKEQGPAALEFYSDYKTVYLKY

SEQ ID NO: 29388 - protein, 410 aa, Yarrowia lipolytica CLIB122
MTVATQAGRYGNLTPEQTLKLKDMWAHLLGAMGVLDETTAKQLSASVHTGGAAASEAPAPKKSGGGLFGRKKAAPEPEEDLSNQASFKDVLGTISIEQLRLAFWNMVRCDNPDNLLLRFLRARKWDVPKALSMMAATFKWRLQEGDVEEIEFKGELGALKENDEEFLLQLRSKKAYIHGRDLEGRPIVYVRPRFHNPKAQKEKCIENFTVHIIETARLTLNDPVDTAAVLFDLSGFALSNMDYAAVKFIIKCFEAHYPECLGVLLIHKAPWIFSGIWNIIKNWLDPVVASKIHFTKNTSDLEKYIPKKYIPKELGGDDPFVYEYIEPKEGEGDRLQDEATRNKMLQDRIQIYSGLEKNTIDWIKSTKQTEGPLLQERSELTKKLRSQYWQIDPYLRAPSILDRLGEITYA

SEQ ID NO: 29389 - protein, 395 aa, Myxococcus xanthus DK 1622
MIRYIDDLQLTGKRVFIRVDFNVPMEGRRVTDDTRIREAMPTIRRALEMGGKVILASHLGRPKGPDPKLSLEPVAVRLAELLGGKHEVILTDDCVGDGVKKQVKELKDGQVVVLENLRFHKEEEANDETFARELAALADVYVNDAFGTAHRAHASTAGMVPFVKEKAAGFLMRKEIEYLGKVLKNPDKPFVAILGGSKVSDKIKVIESLLPKVDALLVGGAMAYTFLKAQGVEVGKSRVEGDKLSLATRLLEAAHRFKTQLVLPVDHIVGTEPTENSPATETPDNAIPPDMMGLDIGPKTRAIFAQHIRDARTVVWNGPMGLFEVPKFAEGTRSVAAAMAINTQATTVIGGGDSAAAVEQMGFADKMSHVSTGGGASLEFLEGRDLPGIKALETR

SEQ ID NO: 29390 - protein, 465 aa, Rickettsia conorii str. Malish 7
MSFLRKKSFESVKEIGSSSGLSKTLGAFDLILLGLGAMIGTGVFVVTGIIAAKYSGPAVMLSYAIAGITCIFVALVYTELAAMLPTSGSIYTYSYVAFGEVFAWMIGSVIILELGVAAGIVAAGWSGYVQGILAAGGINLPKELTTVPTNGGIINLPAFLISGFIGFILYLGTKDSKRLNAILVFIKMTAIFVFILAAAPHFDATNWSNFMPFGFSNVLVGASILFLAFTGFGTIATAAEECKNPKRDIMIGIIGSLVLTTIVYVTMAGLVTGIAPFDQLNNDQPLAYALTINNSKIGSAIVATGAVCGMMTVLMMNIYGTSRIFYAIARDGLLPKSFAKLHPKYDSPYITIIIFASLAAILGGFCSTELLTQLTSMGALIDYITVTIIVVLFRVTLPDAQRPFRCPLVFIIVPFILIACAYLLFIQIYDGEFNLLTAGRALIYWFITIFVLYIIRSFFMQKEQN

SEQ ID NO: 29391 - protein, 400 aa, Arabidopsis thaliana
MATMISNLPRDLIEEIFSRVPLTSMKAVRLTCKSWNNLSKSESFTKVHIGRAATREEKTMIVDVMPHKLNLMSIVIDDVTPSAEFKGQFSLLHKNYRINQVLHYEGLLLCIMKDPTRIVVWNPYLGQTRWIQLRYFHRPHGIDHFRYALGYADKESCSSLKFLRFLDYFYKAPEEEFFWYEIYDFDSGLWTTLNVTPHWGIYSTCPCVSLKGNTYWPAKERSTQGFQDYIIRFDFTRERFGPLLALPTDRESSFVSLSCVKEEKLAALFKHRLHHDSYEYEFEIWITTKIEVEMVSWSKFLRMDMRPKMELPLTFYIDEEKKVFMGFDHGEYPKLLFLNVVGETGFLRKFENIQYRSPCSYVPSLVQVKKLARDRLRKQRSLENRRFAQNILRLARNGKS

SEQ ID NO: 29392 - protein, 237 aa, Acinetobacter sp. ADP1
MSAPKLSLCVEDTGYEIAFAGRSNAGKSSAINSLTNQKQLARASKKPGRTQMINFFSLGNPDQRLVDLPGYGYAAVPEDMKRIWQKELENYLIHRQSLQGLVLLMDIRHPLQHFDTMMLEWAHSRKLFVHILLTKADKLNRGPANQVLLDVKQTLKKMKLSFSIQLFSSLNKQGLEELASVMAGRLNYTLDKTLDFDLDAIPEATEDDLNDELMDQDETSEFNTENIDDHLDQEPKI

SEQ ID NO: 29393 - protein, 205 aa, Corynebacterium glutamicum
MTLAPRIGTATRTTSESDITVEINLDGTGKVDIDTGLHFSTNMLTAFGVHGSFDLKVHAKGQTSRSTHHTVEDTAIVLGKHSLRYCDKKGIRRFASCQLPMDEALVESVVDISGRPYFVISGEPDHMITSVIGGHYATVINEHFFETLALNSRITLHVICHYDRDPHHITEAEYKAVARALRGAVEMDPIPSLRERFTHELFYHL

SEQ ID NO: 29394 - protein, 270 aa, Oryza sativa (indica cultivar-group)
MDSEHWISSLAAAKRFYAAQLGHVDDMAGIGMEEVEMEMEDDGEGMELELEMQLEEATWPDVACPYCYEDHDIASLCAHLEEDHPYEPHTAAYFCKQATGVDFAMAQNNLEKLMMPCPICFEKITRDMLNHITMQHGYLFKSGRRMRRFVIPESQALSLLSRDLRDAQLQALLGGGHRQRRSNTTATNISADPLLSSFGLGFSTLDSEERSKAPVPIRDDTSIHKDTPAQPWESRIDSSLTSEEREQKRKQATDRATFVQGLVLSTLFED

SEQ ID NO: 29395 - protein, 494 aa, Pseudomonas aeruginosa PAO1
MIDLNPIQPICIAGEWRAGGGDLYESLYPATGEAVARLHAASLEDVEEAMAGAHRAFRESGWAQRKPHERATVLYRIAALIRERSEELAQLQRLDNGKPIRETRNLVASAAATFQFFAAACETLEESITPSRGDFVSMSVYEPMGVVVAITPWNSPIASEAQKLAPALAAGNAVVVKPAEITPLAALALARICDEAGLPRGLVSVLPGKGALIGDALTRHPLARRVSFTGGTRTGKHIARIAADKMMPVSLELGGKSPTMVLADADLDHAVAGVLYGIFSSSGESCIAGSRLFVASERYDEFMERLATGAAALRVGDPADERTQMGPLISARHRESVERYVEMGVAEGGRLRTGGLRPHGGAFDRGYFYTPTIIEGLTNGARLCREEVFGPVLVAMPFASEEALIEEANDSCYALAAGIWTRDFQRAWRLGRAVQAGTVWINTYKQFSISTPFGGWRDSGLGREKGRLGILQYMEQKSLYWGLNEQPLAWAGSH

SEQ ID NO: 29396 - protein, 450 aa, Oryza sativa (indica cultivar-group)
MRCLPFLHGDSKEEDPVNKSASVRSLSTTSTERDVRSGSDFNSLNVSDMSAESIRRTQYPSFTDRPSNLRVFSFSELKNATRNFSRSLMVGEGGFGCVYRGVIKNSDEPTERTEIAVKQLNRKGLQASYFSSELYRLQAFNAHSNFLLLGQKEWLTELNVLGIVEHPNLVKLIGYCAEDDERGVQRLLVYEYMPNGSVDDHLSSRSNSTLSWPMRLKVALDAARGLKYLHEEMEFQVIFRDLKTSNILLDENWNAKLSDFGLARHGPSEGLTHVSTAVVGTLGYAAPEYMQTGRLTAKSDIWGYGVLLYELITGRRPIDRNRPKGEQKLLDWVKPYISDIKRFPIIIDPRLEGHYNLKSMTKLASVANRCLVRLPKSRPKMSEVYEMVQKIVASIETGTPQPPLHYHGSVSEPGSKRPKKGSLKRRFQEFKFGCRQIVWRGWKPEIIKTC

SEQ ID NO: 29397 - protein, 368 aa, Arabidopsis thaliana
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISAISSPNSCDENMTKATKPLEPQKDEKQLVPEEALIVLAGPLTRSKSKKFNQAINGLLKELKKNQEDVTQSSFIVITAQEAR

SEQ ID NO: 29398 - protein, 238 aa, Prochlorococcus marinus str. MIT 9303
MADLQTQMKQAVAAAAVEQIKDGMVLGLGSGSTAALMIQALGAKLASGELREIVGVTTSFQGEVMAAELGIPLRNLTAVDRIDLAIDGADEVDPSFQLIKGGGACHVQEKLVASRADRFVVVVDSTKIVDRLNLGFLLPVEVLPGAWRQVQGRLAELGGIADLRMAQCKAGPVVTDQGNLVLDVSMAGGIGDPEDLECRINNLPGVLENGLFVNLTDEVLVGQISDGVAGVRRLQRRE

SEQ ID NO: 29399 - protein, 481 aa, Malus x domestica
MTSILLGYDIGVMSGASLFIKENLKISDVQVEIMNGTLNLYSLIGSALAGRTSDWIGRRYTIVLAGTIFFIGALLMGFAPNYAFLMFGRFVAGVGVGYALMIAPVYTAEISPASFRGFLTSFPEVFVNIGILLGYVSNYAFSKLPIHLNWRIMLGVGAFPSVILAVGVLAMPESPRWLVMQGRLGDAKRVLQKTSESIEECQLRLDDIKEAAGIPKESNDDVVQVSKRSHGEGVWKELLLHPTPAVRHILIAALGIHFFEQSSGIDSVVLYSPRIFEKAGITSYDHKLLATVAVGVVKTICILVATVFLDKFGRRPLLLTSVAGMVFSLSCLGASLTIVDQQHGKIMWAIVLCITMVLLNVAFFSIGLGPITWVYSSEIFPLQLRAQGCSMGVAVNRVTSGVISMTFISLYKAITIGGAFFLYAGIAAVGWVFFYMLYPETQGRTLEDMEVLFGKYHKWREANALLQKAKQVDGDDKGQVH

SEQ ID NO: 29400 - protein, 353 aa, Magnaporthe grisea 70-15
MASATEGKSPHDVCFEERPMPKLASEHDVLVAVNYTGICGSDVHYWHHGSIGDFVVKDPMVLGHESAGTVVEVGSAVKTLQVGDRVALEPGYPCRRCRDCLAGRYNLCPEMRFAATPPYDGTLAGFWTAPADFCYKLPESVSLQEGAMIEPLAVGVHIVRQAKVSPGQSVVVMGAGPVGLLCAAVARAFGATTVVSVDIVESKLEVAKQIAATHTYLSQRISPQDNAKALIAAAGLEDNGGADVVIDATGAEPSIQTSIHAVRVGGSYVQGGMGKPDITFPILAFCCKEVTASGSFRYSAGDYRLAIDLVANGKVNLKALITETVPFDKAQEAFTKVSEGQVIKVLIAGPNEK

SEQ ID NO: 29401 - protein, 441 aa, Xylella fastidiosa Ann-1
MMPRSLTHPSDVPAMSSHYKSSSHMAKETLLYAQSGGVTAVINATAAAVITEARSHRIKVLAARNGILGALREDLIDTSKESITAIRALTHTPGGAFGSCRFKLKSLEADHDKYERLLEVFKAHNVRWFLYNGGNDSADTALKVSQLAKTFDYPLHCIGVPKTIDNDLAITDASPGFGSAAKYTAVSICEAARDVAAMAETSTKVFIYEAMGRHAGWLAAAAGLAGQGQEEAPHIILLPERTYDETAFLAKVQQVVDRVGWCVVVASEGIRSNDGRFVADAGGTTDAFGHTQLGGVAAYLASRVKQALGLKVHWTLPDYLQRSARHIASKTDWEQAQAVGKAAVHYALEGMNAVMPVIVRTSDTPYRWKIEPAALTKIANHEKTLPASFLRRDGFGISERARTYFEPLIRGEAPMPYERNGLPRHVHLKNQSVQKRLPAWE

SEQ ID NO: 29402 - protein, 706 aa, Propionibacterium acnes KPA171202
MTDTNTAPFDTSALGSTLIDGGCRFGLWAPRAERVELALVADDGSQVNHDMTRDEHGVWTVEVSDVQAGQRYGYRVHGPWDPDRGMRFNPAKLLLDPYARAITAGVDYHGPIMDHTPESNYEPDLTDDATSVPLAVVIDDPGPPTPIARRHDISESVIYETHVKGYTRLHPLVPEHLRGTYAGLAYPAVIEHLKSIGVTAIELLPVQQFISEPFIVGRGLSNYWGYNTLGFFAPHAAYCSVGSMGTQVREFKDMVTSFHEAGIEVFLDVVYNHTGEGGHEGPTLSFRGIDHESYYRLTNDHRNDYDVTGCGNSVDTSHPEVLAMVLDSLRYWVTEMGVDGFRYDLATTLIRDKSHGVDQNHLFKQALVEDPILNKVKHIAEPWDLGPYGYQVGAWGPHWSEWNDRFRNYVRDFWRGAVRGVEELATRLCGSPDLYGQPTSSVNFITAHDGFTMRDLVTYNMKHNQGNGEDNHDGSNDNRAWNCGWEGETTDQSIVMLRHRQVRNLVATLLLATGVPMITAGDEMGRTQQGNNNAYCQDSPISWIDWEDAEAWSDVTDLVKIITALRREHPALRPSRYRHHDPVGDANDSYPRRADLAWFSGHGGEMVNNDWHDESRRTLGMYTSDDNEAFLIWFHAGDRPIEIILPSVRWGESWHVVASTALPGEIPDEAVPAGLSVTLPSRCVVVMQASPFGLTAPLRAKRTLGG

SEQ ID NO: 29403 - protein, 326 aa, Boechera fecunda
GKMKTNLLLFLLFSLLLSLTSAEQCGRQAGGALCPNGLCCSEFGWCGDTEPYCKQPGCQSQCTPGGTPPRPTPTGDLSGIISSSQFDDMLKHRNDAACPARGFYTYNAFITAAKSFPGFGTTGDTATRKKEIAAFFGQTSHETTGGWASAPDGPFSWGYCFKQEQNPTSNYCEPSATWPCAPGKRYYGRGPMQLSWNYNYGLCGRAIGVDLLNNPDLVANDAVIAFKAAIWFWMTARPPKPSCHAVIAGQWQPSDADRAAGRLPGYGVITNIINGGLECGRGQDGRVADRIGFYQRYCNIFGVNPGGNLDCYNQRSFGNGLLDAAI

SEQ ID NO: 29404 - protein, 586 aa, Medicago sativa
MCGILAVLGCSDDSQAKRVRILELSRRLKHRGPDWSGLHQHGDNYLAHQRLAIVDPASGDQPLFNEDKSIIVTVNGEIYNHEDLRKQLPNHKFRTQCDCDVIAHLYEEYGENFVDMLDGIFSFVLLDTRDNSFIVARDAIGVTSLYIGWGLDGSVWIASELKGLNDECEHFEVFPPGHLYSSKDREFRRWYNPPWFNEAVIPTTPYDPLVLRNAFEKAVIKRLMTDVPFGVLLSGGLDSSLVAAVTARYLAGTKAAKQWGAKLHSFCVGLKGAPDLKAGREVADFLGTVHHEFQFTIQDGIDAIEDVIYHTETYDVTTIRAATPMFLMSRKIKSSGVKWVISGEGSDEIFGGYLYFHKAPNKEEFHQETCRKIKALHRYDCLRANKSTYAWGLEARVPFLDKDFIKVAMDIDPEYKMIKHEEGRIEKWILRKAFDDEENPYLPKHILYRQKEQFSDGVGYGWIDGIKDHAAKHVTDRMMLNASHIFPFNTPLTKEAYYYRMIFERFFPQNSARLTVPGGASVACSTEKAIEWDASWSSNLDPSGRAAFGVHNSAYENQVNSVAKTVEPEKIIPKMEISNLGVAIQS

SEQ ID NO: 29405 - protein, 464 aa, Thermoanaerobacter tengcongensis MB4
MSKEYRFPEGFWWGSATSAVQIEGAADEDGKGMNVWDYWYQKEPNRFFNGIGSQVTSDFYHRYKEDIKLMKELGHNSFRFSISWSRLIPGGTGKVNEKAVEFYNNVINELLENGIEPFATLFHFDMPIEMQNIGGFENRKVVEYFAEYAKTCFELFGDRVKRWITFNEPIVPVLGGYLYNFHYPDIVDFKRAVQFGYGTVLASARAIEEFKKLKINDAKIGIVLNLSPVYPRSNHPADLKAAELADLFHNRSFLDPSVKGEYPKELVEVLKAYNHLPEYKEEDLELIKDNTVQYLGVNYYQPLRVKAKENMPNPYGVFTPNWFYDEYIMPGRRMNPYRGWEIYEKGIYDLLKRIKDEYGNIECFISENGMGVEGEERFIKDGIIQDDYRIEFIKEHLKWVHKAIEEGCNVKGYHVWTFMDNWSWLNAYKNRYGLVAIDLKTQKRTIKKSGYWFKEVAENNGFVD

SEQ ID NO: 29406 - protein, 452 aa, Salmonella typhimurium LT2
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWKAALYMPAFGAIVVALFAFAMMRDTPQSCGLPPIEEYKNDYPDDYNEKAEEELTAKQIFMQYVLPNKLLWYIAIANVFVYLLRYGILDWSPTYLKEVKHFALDKSSWAYFLYEYAGIPGTLLCGWMSDKVFRGNRGATGVFFMTLVTIATIVYWMNPAGNPNVDMACMIIIGFLIYGPVMLIGLHALELAPKKAAGTAAGFTGLFGYLGGSVAASAIVGYTVDFFGWDGGFMVMIGGSILAVILLVVVMIGEKRHHDELQLKRNGG

SEQ ID NO: 29407 - protein, 483 aa, Prochlorococcus marinus str. NATL2A
MPARFSQQNQRVRPNSNEDKVVARAKEHFEKTLIQISGDIAGSVAALEHPTKNDALNYGEIFLRDNVPVMIYLLTQKRYDIVKKFLTVSLDLQSTTYQTRGVFPTSFVEEKGKLIADYGQRSIGRITSADASLWWPILCWLYVRKSGDQSFGTSQQVQRGVQLLLDLVLHPTFEGNPVLFVPDCSFMIDRPMDVWGAPLEVEVLLHASLKSCIQLMELSRKHQKSRLLDQRLVLTRQWVHDLRQFLLKHYWVTSKTMQVLRRRPTEQYGEDQHQNEFNVQPQVVPSWLQDWLENRGGYLIGNIRTGRPDFRFYSLGNSLACMFGVLTAPQQRALFRLVLHNREHLMAQMPMRICHPPMDIEEWQNKTGSDPKNWPWSYHNGGHWPSLLWFFGASILLHEKRYPKADVLLMGQMRALIEECYWSQLNQLPRQKWAEYFDGPTGTWVGQQSRTYQTWTIVGFLLMHHLLRAEPDDVLMLDLEEEF

SEQ ID NO: 29408 - protein, 313 aa, Spirulina sp. PCC 6313
NGFGRIGRNFLRCWAGRTDTNIELVGLNDTSDPRTNAHLLKYDSMLGKFAGDVSADDTTITVNGKTIKTVSDRNPDNLPWKDWGIDLVIESTGVFIDKVGASRHINAGAKKVLITAPGKNEDGTFVVGVNEDQYNHDIHNIISNASCTTNCLAPVAKVLLENFGIVKGVMTTTHSYTGDQRLLDASHRDLRRARAAALSIVPTSTGATKAVALVLPELAGKLNGIALRVPSPNVSVVDFVVQVEKKAIAQEVNEAFRAAAEGPMKGILEYNELPLVSIDYRGTDASSIVDSSLTMVMGGNMVKVVAWYDNEWG

SEQ ID NO: 29409 - protein, 408 aa, Arabidopsis thaliana
MRKRKQQVYNDNLIVSRSNKRSSTSGKETCYFDPIPVDLVINILSRLSLECIARCRCVSKLWSSIIRRPNYNQLFPVKSSATPRLLFVFKVARELFFNSSPQHFNPNNSSLVATSLQKTSSTRFSQLCRPVHGLICSQHIEENYLFALISNPTTGEYIALPKQRMEEMNSETIIEKVRYSFGYDPIDKQFKVLRITWLHRGSHEWSSEYQVLTLGFGNISWRNTQCCVVHYLLEDSGICINGVLYYPARLDNRKYTIVCFDVMTEKFSFTSIDKDMTIMTNLSFSLIDYKGKLGACICDHTLFELWVLENAEEHKWSKNIYNMPYSRSRLEETSYLKCAGMIASGEILLYPISSANTSTDARYPFIYYYNLERNIITRVTLQVPILKQFTYARLFYTFSNFLENVTLI

SEQ ID NO: 29410 - protein, 1354 aa, Arabidopsis thaliana
MAQSSTEPKFSLRLIIDEEKNKVVLAEAGTIVRLLAKHRKSDPVTIGCLRNLYTSVVDMELDDFETDACKQMLLYPKNIREAQYRNFKLNIDTNESLKCFGCRFFSICRMCSNFNTSLCKCGKLMNEEISFLEYEENDVEGVFMRDKSSFIITDDLRLTDDSTSSLLQTLKDLGCADVSKLREQVLDIGLKEVMTLMQCVFTSNTPLTDAFLKNQSSNTVRKIYRKLSDDKGDEAEPDKVITIDAIVRKQDMKILYVECGEDFVDLLFTFLAIPLESIWEISGNSITIGRIGNLFRSFKDLSDNEVLSASKCMIPYYYRCQKQLLKIRTPTPRVYLGHCYSKTLSYSQSFYLTTKRTTKRMTFVDPKSDCCGRSKDGKGFVKRGTKFIVSDDLIVTPKISSSTFSVLKKFQILTDDLEVQAITISNADALNLLGASLVTSSALSSAFGNLIVKKPKEENVSWNPVSKKPKKSFLIYLAFVFLSSITLMAKSSEEPKFSLRLIVDEEKNKVVLAEACRDFVDVLFSLLTLPMGTIVRLLENHRKSEPVTLGCFNNLYRSVVDMGSDCFETEACKQMLVYPKSVKDLQCKRLKLNINPTEDIKCFKCSSYCGLYSNFSTSKCRCGKFMNEEIQLENEEQDLGRFQDDDNGVFVSGRCSFVLTDDLEVSVKSTELVLNKLKSLGCADVGKLGERLLDIGVKEVLTLLGCIFSSNAPLKDIFLNKKITQGATKFYKSQSPCLEKKEDEAEPEKVVTLKAFVRKQDMKILFVECGEEFVELLFSFIAVPLESAWEISGSSISLGCIGNMCRTFRDLNEETQMSTSTCALPSFYNFQMQLPGIITQQPPVYYRYRLYDYRQMNYGLTTNGNRTTYYRKDRIVRVDLKDPKSRGSDKSAQGFLKKATKCTVLDDLTITSMNSCSTVCLLKKLQSHADDLEVQVISISNAEALDLLRASLVTSSALSTTLWNLIAKKLKEETDLWDTVSKKGSVHVTFTATMLQIRLRRDSPTETGNGARPSPTETVTVACPDHLVLADLPVAKGIGSVTPTTVIKPVGRRSRRQLGERVHFCVRCDFPIAIYGRLIPCDHAFCLECARSDSICYLCDERIQKIQTIKMMEGIFICAAPHCLRSFLKKLDFEAHVHDLHGSLLQADAEKEDGNQSDVQSTMQQSSASESTLRAPLRSQLQQSRELNRSASFAKSQSGFSQVQNYPPDSDNSRPPGFETASPKPGIRFPDYPQPMNLMQPPSLPVPMNQNPGLPQQFGFPSYPTTESGSSQQFFNGAQYEMTRTESGGGSEQSSLLGYPPPSPMTNLNFQGSYPPPSWNPGMAPPHTTQQVNRGRDGQSFGWPQENRDGFGQE

SEQ ID NO: 29411 - protein, 105 aa, Zea mays
  misc_feature (62)..(62): Xaa can be any naturally occurring amino acid
  misc_feature (72)..(72): Xaa can be any naturally occurring amino acid
  unsure (1)..(105): unsure at all Xaa locations
MASLAALSVKPEAIKGLAGSSISGRKLADHRPPARSIHRPHAADVAAKYGDKSDYFDLDDLXSHTGQRDLYXSDAPWSYNPLQSKFFHTTAAADTKRGLLHKMMI

SEQ ID NO: 29412 - protein, 235 aa, Rickettsia conorii str. Malish 7
MKDIEYWEKNFESCKYSDQLIERLLFLNTQVKQPIDIREVQKGIYYARKYHGAQMRQSGDPYYSHPIAVTIMVAEFVAKEVPKLFTFRMLQAALLHDTIEDTELTEEIISNIFDEEVARHVAGLTRIKPWGKISSEKSLMLLIKQKRYDTALIKLFDRIHNLQTLEAKSPEKAHKIIKETLKSFLVLSEILEIPSVSELIYAECYKNNLKFNINSTFNKIINFDSFPFSQNKLLP

SEQ ID NO: 29413 - protein, 219 aa, Burkholderia thailandensis E264
MAFLLHQARFFTTVNHLRDLPPTVQPEIAFAGRSNAGKSTAINVLCNQKRLAFASKTPGRTQHINYFSVGPAAEPVAHLVDLPGYGYAEVPGAAKAHWEQLLSSYLQTRPQLCGMILMMDARRPLTELDRRMIEWFAPTGKPIHSLLTKCDKLTRQESINALRATQKSLDAYRDAGYAGKLTVQLFSALKRTGLDDAHALIESWLRPAAADEDHAAVAE

SEQ ID NO: 29414 - protein, 800 aa, Oryza sativa (indica cultivar-group)
MASIGWHLSLEPNIDSFTVADNKLVLLNFEQQQLVHWMMPPRFRCQDYLLPLLLALSPAAAAAREVEYHHCHCDGGGGGGGGGGLWSMDSIFRWRKVSDLLIAAAYFSIPLEILYFVAGLRHLLPFRWVLVQFGAFIVLCGLTHLLTAFTYEPHPFMVVLLLTTAKFLTALVSFLTAITLLTLIPQLLRVKVRESLLWLKARELDREVVLMKRQEEASWHVRMLTHEIRKSLDRHTVLYTTLIELSRLLGLTNCAVWMPAAGEMCLTHELRRDGGGEDGVVGVDDADVVEVRGSDGVKLLGPDSVLAAASGGKEEGTGAVAAIRMPMLKVSDFKGGTPEVIQTSYAVLVLVPPAGKSWGRHEMEIVEVVAGQVAVALSHATLLEESRAMRDRLAEQNRELLQARRDALMANEARQAFQGVMSQGMRRPIHSILGLVSMVQEEALAPEQRLVVDTMARTATVVSTLVNDVMEMSADSRERFPLETRPFHLHAMIRDAACVARCLCDFRGFGFAVHVENALPDLVVGDERRIFHVLLHMVGNLIGRTEPGHVTLRVRAADDDVLDDRLGQRWDPWRPSYSTGYSSVKFVIGVKRQQNGDAGSPLSRRPSGKGIDLRLSFSMCRKLVQMMQGNIWAILNPQGLPESMTLVLRFQLQSPLTSSSLGGSFEQKHSSPSCQIAGLKVLLIDDDDDINLVVARKLLEKLGCVVSSPPSGSGFLSSVGSSAAAFQLVMVNLEMKRVKALDVATRISQYRSGRWPIVMAMASDQKAWEKCAQSGINGILKKPVILQELKDELARILQST

SEQ ID NO: 29415 - protein, 282 aa, Brassica napus
  misc_feature (144)..(144): Xaa can be any naturally occurring amino acid
  misc_feature (155)..(155): Xaa can be any naturally occurring amino acid
  misc_feature (164)..(164): Xaa can be any naturally occurring amino acid
  misc_feature (171)..(171): Xaa can be any naturally occurring amino acid
  misc_feature (254)..(254): Xaa can be any naturally occurring amino acid
  unsure (1)..(282): unsure at all Xaa locations
MDRLTSLPDELLYHILSLLPTKSAVVTSALSKRWLNLWKLNPNLDIDDSVFIHAEDGKGKREEIRQSFVGFVDRVLAMQGDSPINSFSLKCITGIHPDTVNRWICNVLKRGVSDLSLFTDFTCEDTEEDSYQLPRELFFSSTLXLSWKLRSEHCXVDWGVASKXSSSLTMXLKSLDIDSDLIFCGEIEEFIPSFPALEELRMASMEWLEPDVTVSSATLRKLTLHGTGCEEYVNPTSVSFDTPELVVLSYFDLXVAEDYPLVNMNKVVHAGINLIGTDKQGK

SEQ ID NO: 29416 - protein, 70 aa, Zea mays
MSTLISTVQKDKTRSKNMSDPSGQSSTTAVRGDSNGGGNSGSGGGSFASQPQRAKVRTQVWAGVLGITNK

SEQ ID NO: 29417 - protein, 428 aa, Listeria monocytogenes str. 1/2a F6854
MNVNAEGHLEIGGVDTLKLADKYGTPLYVYDVALIRDRARGFKKTFEELGVKAQVAYASKAFSAVAIYQLMAEEGLSLDVVSGGELYTAIKANFPPERIHFHGNNKSAEEIHMALDYGIGCFVIDNYYEISLLEDILIERNEKASVLIRVTPGIEAHTHDYILTGQDDSKFGFGLTNGQAEKAIKQVLHASASFDLIGLHCHIGSQIFETTGFKLAARRIMDKLVEWHQTLGFDSKVLNLGGGFGVRYTAEDEPLEPSEYVRQIMDEVRDVAESNDIDIPEIWIEPGRSLVGEAGTTLYKVGSRKEVPGIRNYIAVDGGMSDNIRPALYDAHYDAVLAANPEKVAEETVAIAGKCCESGDMLIWDLPLPKSNAGEVLAVFCTGAYGYAMASNYNRIPRPPVVFVENGVDKLIVARETYENLVQNDLSL

SEQ ID NO: 29418 - protein, 356 aa, Prochlorococcus marinus str. MIT 9303
MSSTHLPGGNQALLGCSATELESWAVAEGQPAFRGRQLHDWLYAKGARSFDAITVLPKSWRISLQQRGLTIGRLLEVNRAVAVDDTTKLLLATVDGETIESVGIPTQQRLTVCLSSQVGCPMACRFCASGKGGLQRSLATHEIVDQVLSLREAMDRRPSHVVFMGMGEPLLNIEAVLASIRCLNIDLGIAQRRITVSTVGVPHTLPQLAELAMKRLGRAQFTLAVSLHAPNQELRERLIPTACAYPFETLLQDCRHYLAVTGRRVTFEYILLGALNDQPQHAEELAERVRGFQSHVNLIAYNPIDDEGFQRPNPETIEAFRRVLEQRGVAVSLRASRGLDQNAACGQLRRQHAAIG

SEQ ID NO: 29419 - protein, 491 aa, Yarrowia lipolytica CLIB122
MQVTLPDGKSYDQPTKLFINNEWVDGHGGSIESVNPATEQVICSVEAADESDVDKAVQAARNCYENVWRKVTGAERAQLMRKLADLVEKNKDLLTSIEAADSGKPKYGNCDGDVDELIYVLRYYSGLAEKAGNGVTISTSNEKFAYTIHEPYGVCGQIIPWNYPIAMAAWKLGPCLAAGNVLVMKLSEYTPLSMLVICNLVKEAGFPPGVVNVVNGYGAKAGNRLAEHPDVDKIAFTGSTATGRSVMKAATGNMKAVTMELGGKSPLLIFDDCDLAKAIEWAHIGIMYNMGQVCSATSRILVQEGIADKFVEGFIKQCNEASILGCPLDQKTSHGPQVNKIQYEKVLGYIEKGKAEGAKCILGGEAAPQNGKGYFIKPTAFTNVNKDMTIWKEEIFGPVVVIDTFKTEEEAIAKANDTPYGLAAALFTENIRRAHRVVKELRAGQVWVNSDNDSDPRVPFGGVKQSGIGRELGEYGLSIYTQAKAVHINLD

SEQ ID NO: 29420 - protein, 569 aa, Xylella fastidiosa Ann-1
MSQTRPWLQHYPSGISTEIDTDAFRTIADVFNTSVIKYRHCPAYTNFGKTLTYGEVDLLTKQFASYLLNVLKLKKGDRIALMMLNCLQYPVATFGALCAGLTVVNVNPLYTARELKHQLVDAGSTVLVVMDNFCTTVQQIIADTPIKQVITTELGDLLDFPKRSLINFAVKHIKKLVPEYQLPRSIRFREALALGSKHSMPPIHIASDDLAFLQYTGGTTGTPKGAMLTHRNMVANMQQVSQWLQTSNSLKEGCETVLTALPLYHIFALTANSLVFMKIGGCNHLISNPRNMRAFVKELQRVRFTVITGVNTLFNKLLNTPGFDKLDFSSLKIALGGGMVIQRSVAEQWKQVTHVPLIEAYGLTEASPAACINPLNLQEHNGSIGMPIPSTDVCIKDDTNGVLPIGEMGELCIKGPQVMKGYWQRPEETSEVLDADGWLHTGDIVKMDKQGFLYIIDRKKEIILVSGFNVYPKEIEEVIAMIPGVAEVAAVGVPDEQSGEVVKVVIVKKDPMLTAEEVKAHAATNLTRYKLPRIIEFRATLPKTDVGKILRRELRDAAPASNTFTAQPK

SEQ ID NO: 29421 - protein, 81 aa, Brassica napus
  misc_feature (3)..(3): Xaa can be any naturally occurring amino acid
  misc_feature (29)..(29): Xaa can be any naturally occurring amino acid
  misc_feature (40)..(40): Xaa can be any naturally occurring amino acid
  misc_feature (47)..(47): Xaa can be any naturally occurring amino acid
  misc_feature (52)..(52): Xaa can be any naturally occurring amino acid
  misc_feature (60)..(60): Xaa can be any naturally occurring amino acid
  misc_feature (63)..(63): Xaa can be any naturally occurring amino acid
  misc_feature (66)..(66): Xaa can be any naturally occurring amino acid
  misc_feature (68)..(68): Xaa can be any naturally occurring amino acid
  misc_feature (73)..(73): Xaa can be any naturally occurring amino acid
  unsure (1)..(81): unsure at all Xaa locations
MNXFSDLNSSVSKPSLSHIAPLEAILFDXDGTLCDSDPIXLIAFQEXLQQIXFNNGVPIXEKXFIXNXGGKPXSEIALALF

SEQ ID NO: 29422 - protein, 946 aa, Arabidopsis thaliana
MQTIIISPLVSHRLCLARAVPCNRLLNNHHRAPPSIRLSNHRSTTSLRLFSSAGSLCVCKSDAEYFAKAAASRDSEMATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLEKMLCACSGEQFRFEDQPGSPESLATRDFSASGLSSRNGGGDWDSKLEDIQVDEAESTLKEALSLNYEEARALLGRLEYQRGNFDAALQVFKGIDIKVLTPRIIKAIVEKTLPCKPRSKAVIVPPTTMSMHSVSLLLEAILLKARSLEELGSYKEAAEECKIILDVVENALPSGMPDGISGFAKLQDIFQKALELLPLLWKKAGNHHETIASYRRALSRPWNLDPQRLAVTQKSLALVLLYGSVEACPKDNIEEAIVLLMLLVKKMVVGDIQWDPELMDHLTYALSMTGQFEVLANYLEQTLPGVYTRGERWYLLSLCYSAAGIDKAAINLLKMALGPSESRQIPHIPLLLFGAKLCSKDPKHSRDGINFAHRLLDLGNSQSEHLLSQAHKFLGVCYGNAARSSKLDSERVFLQKKSLFSLNEAAKRGKADPELDVIFNLSVENAVQRNVQAALDGAVEYSSMVGGVSTKGWKHLAIVLSAEKRLKDAESILDFTMEEAGDIEKIELLRLKAVLQMAQEQPKKAMKTCSSLLGLIRAQEKSEQSEKFETEAWQDLASVYGKLGSWSDAETCLEKARSMCYYSPRGWNETGLCLEAKSLHEEALISFFLSLSIEPDHVPSIVSIAEVMMKSGDESLPTAKSFLMNALRLDPRNHDAWMKLGHVAKKQGLSQQAAEFYQAAYELELSAPVQSFI

SEQ ID NO: 29423 - protein, 475 aa, Vicia faba var. minor
MTMEEKEEHSTEAAVTSHNDSKLFDDDDRVKRTGTVWTTSSHIITAVVGSGVLSLAWAIAQLGWIIGLSVMIFFSLITWYTSSLLSECYRTGDPHFGKRNYTFMEAVHTILGGFYDTLCGIVQYSNLYGTAVGYTIGASISMMAIKRSNCFHSSGGKDGCRISSNPYMISFGVIQIFFSQIPDFHEMWWLSIVAAIMSFTYSLIGLGLAIAKVAENGSFKGSITGVSIGTVTEAQKVWGVFQSLGNIAFAYSYSQILIEIQDTIKSPPSEMKTMKQATKISIGVTTIFYMLCGGMGYAAFGDLSPGNLLTGFGFYNPYWLIDIANAALIIHLVGAYQVYAQPLFAFVEKIMIKRWPKIKKEYKLTIPGFRPYHLNLFRLIWRTIFVITTTFISMLIPFFNDVLGLIGAAGFWPLTVYFPVEMYIKQKKITKWSYKWISMQTLSVICFVVSVVAFVGSVSSIVVDLKKYKPFTTDY

SEQ ID NO: 29424 - protein, 584 aa, Vibrio angustum S14
MKSDIDICRDTLLSPIEDIAKQAGIQPQELTPQGSLKAKIKPAILNRLADQAEGKLVVVTAITPTPLGEGKTVTTIGLAQGLAKIDRSVMACIRQPSMGPVFGVKGGAAGGGYSQVAPMDKLNLHLTGDIHAVTAAHNLAAAAIDARLYHESRLGYDLFCEKTGLPALRIDINNITWKRVMDHNDRALRMITIGQNEPDKTINGLERHDGFDITAASELMAILALSDDLHDMRKRIGRIVVAYDLDGNPVTTEDLQVAGAMTVTLCDAIEPTLMQTLEGVPTLIHAGPFANIAHGNSSIIADKIALKLSDFTITEGGFGSDMGFEKACNIKAQQAKRGPDCAVVVATLRGLKANSGLYDLRPGQALPDGIFAEDHDALVAGFENLKWHISNAARYGVPVVVAINRFPQDTDKELAQLQAMIKTESFETFVDVAISEAFGKGGDGAIKLAECVVKACQHKANFTPLYHLNQPLEEKIMAVAEVGYGASHVELSEVAQQQLVKFKELGFDELAICMAKTPLSISTDPSIKGAPKGFTVPVRELKLCAGAGFIYALCGNVMTMPGLPEKPAFMNLDIDENGNIIGLS

SEQ ID NO: 29425 - protein, 486 aa, Vicia faba var. minor
MVENISRTNLSYRGDTGGIEEAIDDAPLQTDSKFYDDDGRVKRTGTVWTTCSHIITGVIGSGVLSLAWSVAQMGWIAGPATMIFFSIITLYTSSFLADCYRSGDTEFGKRNYTFMDAVHNILGGPSVKICGVVQYLNLFGSAIGYNIAAAMSMMEIRKSYCVHSSHGEDPCHVSGNAYMIAFGVAQLFFSQIPDFHNTWWLSIVAAVMSFFYSTIALALGISKVAETGTVMGSLTGISIGTVTPAQKVWGVFQALGNIAFAYSYSFILLEIQDTIKSPPSEGKAMKKAAKLSIGVTTTFYLLCGCTGYAAFGDAAPGNLLAGFGVSKAYILVDMANAAIVVHLFGAYQVYAQPLFAFVEKEAGKKWPKIDKGFEVKIPGLPVYNQNIFMLVWRTIFVIVPTLIAMLIPFFNDVLGVIGALGFWPLTVYFPVEMYIIQKKIPKWSRKWICLEIMSTFCLFVSVVAGLGSLIGVWIDLKKYKPFSLEN

SEQ ID NO: 29426 - protein, 1203 aa, Nicotiana tabacum
  misc_feature (197)..(197): Xaa can be any naturally occurring amino acid
  misc_feature (206)..(206): Xaa can be any naturally occurring amino acid
  unsure (1)..(1203): unsure at all Xaa locations
MKMGYCMNHCENAAYRLMSSSSSSVLPPSKIYSSRTHLFPLYSSKAAVYKSSSFLHLQSRPSVLGHTHLRKRVNFSIVNEQSPSNDSVVQKGKQQKLGKRTDIKKILILGAGPIVIGQACEFDYSGTQACKALREEGYEVILINSNPATIMTDPEMADRTYIEPMTPELVEQVLERERPDALLPTMGGQTALNLAVXLAESGVLDXYGVELIGAKLGAIKKAEDRDLFKQAMKNIGIKTPPSGIGNTLEECIEIAGEIGEFPLIIRPAFTLGGTGGGIAYNREEFEAICKSGLAASLTSQVLVEKSLLGWKEYELEVMRDLADNVVIICSIENIDPMGVHTGDSITVAPAQTLTDKEYQRLRDYSIAIIREIGVECGGSNVQFAVNPVDGEVMVIEMNPRVSRSSALASKATGFPIAKMAAKLSVGYSLDQIPNDITKKTPASFEPSIDYVVTKIPRFAFEKFPGSEAILTTQMKSVGESMAVGRTFQESFQKAVRSLECGYSGWGCTQVKELDWDWDKLKYSLRVPNPDRIHAVYAAMKRGMKVDDIFELSYIDKWFLTQLRELVDVEQFLLARSLSDLTKDDFYEVKKRGFSDRQIAFATKSSEEEVRSRRLSLGVKPAYKRVDTCAAEFEADTPYMYSSYDIECESAPTGRKKVLILGGGPNRIGQGIEFDYCCCHTSFALQDAGYETIMMNSNPETVSTDYDTSDRLYFEPLTVEDVLNIIDLEGPDGIIVQFGGQTPLKLALPIQNYLDERRPKTRSGAGFVRIWGTSPDSIDAAEDRERFNAILNELQIVQPKGGIAKSEKDAVAIATEVGYPVVVRPSYVLGGRAMEIVYNNDKLVTYLENAVKVDPERPVLIDKYLTDAVEIDIDALADLHGNVVIGGIMEHIEQAGVHSGDSACMLPTQTISDSCLETIRSWTTKLAKRLNVCGLMNCQYAISASGEVFLLEANPRASRTVPFVSKAIGHPLAKYASLVMSGKSLHDLNFTKEVIPRHVSVKEAVLPFEKFQGCDVLLGPEMRSTGEVMGIHYESSIAFAKAQIAAGQKMPLSGTLFLSLNELTKPQLTTIARAFLGIGFQIIATSGTARVLELEGMPVERVLKMHEGRPHAADLIANGQIQLMVITSSGDTLDQIDGRKLRRMALAYKIPVITTVAGALATADAIKSLKCNKIKMTALQDYFDVKKVEAELKNLQCASSVSTS

SEQ ID NO: 29427 - protein, 152 aa, Glycine max
MTTEQTFIAVKPDGVQRGLIGPIITRFENRGFKLAGIKMVTPSKEHLEKHYADLSDKPFFPGLIAYMGSGPVCAMVWEGCDAVKTGRSILGATNPLASAPGTIRGDYALDVGRNVCHGSDSVENGKKEIALWFKDGEVQSWKSAQHDWVYEK

SEQ ID NO: 29428 - protein, 146 aa, Oryza sativa
ACAINAWPDLRVHFRFIYCVEDLVVNHKQREWESCFGKLNLDPKPVTDCYKGERGHQLSLKYGRQTDALQPPHKYVPWVVVDGQPLYEDYENFEAYICKARPPTPTVLEVAEAVNRVSYYDSGDIRLKPDEDGHAKIKKVVPDDDD

SEQ ID NO: 29429 - protein, 320 aa, Bordetella parapertussis 12822
MPSQLEALRRHTVVVADTGDFEAMRALRPTDATTNPSLILKAVQQEAYRPLLVQTARAHQGASPAEITDRLLVAFGRQILDIVPGRVSTEVDARLSFDTRATVERARGLIALYQAAGVPRERVLIKIASTWEGIQAARVLQAEGIRCNLTLLFCLPQAAACADAGVQLISPFVGRIYDWHKKNAGAEWVEDARRGANDPGVQSVSRIYRYYKRFGIETEIMGASFRNVDQILALAGCDLLTISPELLTRLSQTEGEVPAALSPQAGHDDADAVRLDGGEVAFRTQLNEDAMASEKLSEGIRLFVADARKLDALIESHGAA

SEQ ID NO: 29430 - protein, 472 aa, Oryza sativa (japonica cultivar-group)
MAKKKDVEVEELDEEVVAAAAAPAADGGEEQEAEPPARRPSTFAELGVVPELVAACDAMGWKEPTRIQAEAIPHALEGRDLIGLGQTGSGKTGAFGLPIIQALLKQDKPQALFACVLSPTRELAFQIGQQFEALGSAIGLSCTVLVGGVDRVQQAVSLAKRPHIVVGTPGRLLDHLTDTKGFSLNKLKYLVLDEADKLLNVEFQKALDDILNVIPKERRTFLFSATMTNKVSKLQRACLRNPVKVEVASKYSTVDTLRQEFYFVPADYKDCFLVHVLNELPGSMIMIFVRTCESTRLLALTLRNLRFKAISISGQMSQDKRLGALNRFKTKDCNILICTDVASRGLDIQGVDVVINYDIPMNSKDYVHRVGRTARAGNTGYAVSLVNQYEAMWFKMIEKLLGYEIPDRKVDNAEIMILRERISDSKRIALTTMKEGGGHKKKRRKNEDDEEEEERNAPVSRKSKSFNKSRRR

SEQ ID NO: 29431 - protein, 120 aa, Rickettsia conorii str. Malish 7
MMYNKENVFAKIIDKNLPAEIIYEDEQILAFKDIAPVAPVHIIVIPKNEYIDYADFISKASIDEIKHFFAKLSDIANEAGLDKDGYRLITNKGEKSGQTIFHFHFHIIGGEKLIGLINND

SEQ ID NO: 29432 - protein, 1080 aa, Bordetella parapertussis 12822
MPKRTDLKSILIIGAGPIIIGQACEFDYSGAQACKALKAEGYRTILVNSNPATIMTDPETADVTYIEPITWQAVEKIIEREKPDALLPTMGGQTALNCALDLAHHGVLKKHNVELIGANEHAIEKAEDRQKFKQAMTDIGLESAKSGVAHSMDEAWEVQRRIAADIGTAGFPVVIRPSFTLGGSGGGIAYNAEEFEVICRRGLEASPTKELLIEESLLGWKEFEMEVVRDKADNCIIVCSIENLDPMGVHTGDSITVAPAQTLTDKEYQIMRNASIAVLREIGVDTGGSNVQFAVNPQNGRMIVIEMNPRVSRSSALASKATGFPIAKVAARLAVGYTLDELRNEITGGATPASFEPTIDYVVTKVPRFAFEKFPQADARLTTQMKSVGEVMAMGRTFQESFQKALRGLEVGVDGLNQKTTDREKLQIELGEPGPERIWYVGDAFAQGFTLDEVHGLTRIDPWFLAQIKEIVDIELALEQKTLADLDYAILWELKRCGFSDRRLAFLLDSSESEVRKLRHQLNVRPVYKRVDTCAAEFATNTAYMYSTYEEECESQPTDRKKIIVLGGGPNRIGQGIEFDYCCVHAALALREDGYETIMVNCNPETVSTDYDTSDRLYFEPLTLEDVLEIVHKENPVGMIVQYGGQTPLKLARALEANGVPIIGTSPESIDVAEDRERFQKLLNKLGLRQPPNRTARTEAEALAHASEIGYPLVVRPSYVLGGRAMEIVHEQQDLERYMREAVKVSNDSPVLLDRFLNDATEVDVDCLADGQTVFIGGVMEHIEQAGVHSGDSACSLPPYSLSAEVIAEIKRQTTMMAKALNVSGLMNVQFAIQGGDVYVLEVNPRASRTVPYVSKATGLQLAKIAARAMAGRTLADQGITREVVPPYFSVKEAVFPFVKFPGVDTILGPEMKSTGEVMGVGNSFGEAFVKSQLAAGVRLPDSGTVFISVRNQDKPRAVEVARGLHNLGFKLVATRGTAAEIEAAGIPVQVVNKVTEGRPHIVDMVKNGEVSLVINTVEERRNAIADSRTIRTQALANRITFFTTIAGVRAAVEGMQFMRQGLGLQVYPLQELHAGLTAQ

SEQ ID NO: 29433 - protein, 668 aa, Oryza sativa (indica cultivar-group)
MWKMVDALLRCSALVALVLHFVVNGCSAVNTEGSALLKFQSRVEEDPHGAMAGWSERDGDPCSWNGVRCVDGRVVILDSDWKCSLPIRSRIIVAKCSRNLKDLSLRGTLGPELGSLSHLRALVLSNNLFDGPIPKEMSDLAMLEILDLSNNNLTGEVPQEIAEMQSIKHLLLSNNNFQWPLIQNSYRNFDQEIDFDVYDERGDVDQRSENGFESDSSSEENTKDNNNLSARLSSQFAARNPTVQLSRRRLLEDTNLAAASANAPVPAVASVPSTGTGSFSAFKEIKVPPPLSPPSSPPMSSGPPQRSKRWLYAIVISSIALLLIGIACMFLLCRNKSVATIGPWKTGLSGQLQKAFVTGVPKLQRSELEGACEDFSNIVASYPHYTVYKGTLSSGVEIAVVSTVIATNKDWSKHSEGRFRKKIDLLSRINHKNFINLLGYCLEENPFMRMMVLEYAPNGTLYEHLHVEGFDHIDWNGRMRVIMGVAYCIQHMHELNPSITHPDLHSSAILLSEDGAAKVADMSVWQEVISKGKMPKNDDIVDHHEPVSADPAGNVCSFGLLMLEIISGRPPYSEHKGSLANLAMECIKDDRNISCLLDPTLKTHKENELEIICELIQECIQSDPKKRPGMREVTTRLREVLAISPEAATPRLSPLWWAELEILSVEAT

SEQ ID NO: 29434 - protein, 162 aa, Candida glabrata CBS 138
MSKVYFDIEADGQPLGRVVFQLYDDVVPKTAANFRALCTGEKGFGYAGSPFHRVIPDFMLQGGDFTAGNGTGGKSIYGGKFPDENFVKRHERPGLLSMANAGPNTNGSQFFITTVPCPWLDGKHVVFGEVSEGYDVVKKVESMGSSSGATRARIIVSKSGEL

SEQ ID NO: 29435 - protein, 504 aa, Zea mays
  misc_feature (197)..(197): Xaa can be any naturally occurring amino acid
  misc_feature (457)..(457): Xaa can be any naturally occurring amino acid
  misc_feature (484)..(484): Xaa can be any naturally occurring amino acid
  unsure (1)..(504): unsure at all Xaa locations
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLXGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKAPFFTSPRYLPPTKSDKCRIKDAIISHGCFLRECAIEHSIVGVRSRLNSGCELKNTMMMGADLYETEDEISRLLAEGKVPIGVGENTKISNCIIDMXCQGWKERLHNKQRGRPRSRPAGRRILXIRSGIVVVLKNATIKDGTVI

SEQ ID NO: 29436 - protein, 469 aa, Synechococcus elongatus PCC 6301
MASALTPNASHSVSVLVRMPSNTAAMLHVVQAIATTGANLTEMELLQRTNQWIDRRLIVEAASEEQAAAVVEAIAAVPDLELLDSEDRTFALHRGGKISVEPKLPLTSQAQLAMAYTPGVGRVCKAIAANPDRVYELTVKQNMVAIVTDGTAVLGLGNLGPAGALPVMEGKAMLFKAFGDVDAFPICLDTQDTDEIVETMKRIAPVFGGVNLEDIAAPRCFEIEARLKQELDIPVFHDDQHGTAIVTLAALENALKLVKKSLSQVRIVMNGAGAAGLSVASLLREAGATNIIICDSRGILSCDRSDLTPQKQAFAIEAGGSLADALVNADVFIGVSVPGVLTVEMVETMASDRIIFAMANPIPEIQPELIQGRAAVIATGRSDYPNQINNVLAFPGVFRGALDCRAKSLTSSMFLAAARAIAALVPPETLSAEHIVPSAFDSRVAPAVAAAVVEAAQANGLAQTLAVTH

SEQ ID NO: 29437 - protein, 333 aa, Pseudomonas putida KT2440
MTLRIAINGFGRIGRNVLRALYTQGYRQDLQVVAINDLGDSTMNAHLLKYDSVHGTFDATVEADHESLTVNGDRIAVSAIRNPAELPWKAEAIDVVFECTGLFTDRAKAAAHLAAGAGKVIVSAPAKGADATVVYGVNHDILRASHQIISNASCTTNCLAPIAQVLHREFGIEQGLMTTIHAYTNDQVLTDVYHSDPYRARSATQSMIPSKTGAAEAVGLVLPELAGKLTGMAVRVPVINVSLVDLTVNLKREATAEQVNQLFLEASKHSKVLGYNALPLVSCDFNHNPLSSIFDANHTRANGRMLKVLAWYDNEWGFSNRMLDNCLALHRAG

SEQ ID NO: 29438 - protein, 120 aa, Beta vulgaris subsp. vulgaris
VSEEYKLVPDTLYLTVNLIDRFLSGNYLEKQKLQLLGVTCMLIASKYEEVSAPQVEDFCYITANTYAREEVLNMERKVLNFLCFQLSVPTIKTFLRRYVHAAQATEDSLVDLEFLAKYLV

SEQ ID NO: 29439 - protein, 319 aa, Pseudomonas putida KT2440
MKHLLVGDIGGTNARFALWRDNQLHEVNVFATVDYTNPEQAIEAYLESQGIARGGLAAVCLAVAGPVDGDEFRFTNNHWRLSRTAFCKTLQVERLLLINDFTAMALGMTRLREGEFREVCPGQADPSRPALVIGPGTGLGVGSLLRLGEQLWKALPGEGGHVDLPVGNAREAAIHQQIHSQIGHVSAEAVLSGGGLVRLYQAICALDGDTPRHKTPAHITDAALGGEPRALAVVEQFCRFLGRVAGNNVLTLGARGGVYIVGGVIPRFAELFLRSGFAASFADKGCMSGYFTGVPVWLVTAEFSGLEGAGVALQQALDH

SEQ ID NO: 29440 - protein, 108 aa, Pseudomonas aeruginosa PAO1
MDIIETIKEQIANNPILLYMKGSPNAPQCGFSSRAAQVLMACGEKFAYVDILQNPEIRANLPKYANWPTFPQLWVNGELVGGSDILAEMFEKGELQTLVKDAAAKANA

SEQ ID NO: 29441 - protein, 481 aa, Vicia faba var. minor
MVVEKNASNNHHQTFYVSIDQQIDSKFFDDDGRVKRTGTSWTASAHVITAVIGSGVLSLAWAIAQLGWIAGPIVMFLFAWVTYYTSVLLCECYRNGDPVNGKRNYTYMEVVHSNLGGFQVQLCGLIQYLNLVGVAIGYTVASAISMMAIVRSNCFHRSGGKDPCHMNSNIYMIAFGAVQIIFSQIPDFDQLWWLSIVAVVMSFTYSTIGLGLGIGKVIENKKFAGTITGINDVTKAQKTWGSLQALGDIAFAYSFSMILIEIQDTIKAPPPSESKTMKKATLISVIVTTFFYMLCGCFGYAAFGNSSPGNLLTGFGFYNPFWLLDIANAAIVIHLIGAYQVYCQPLFAFVENYTAKRFPDSDFVNKDVKIPIPGLDRYKLNLFRLVWRTVYVILTTLISMLLPFFNDIVGLLGAIGFWPLTVYFPVEMYIIQKKIPKWSTKWICLQLLSGACLIITIAATIGSIAGLILDLKVFKPFKTIY

SEQ ID NO: 29442 - protein, 394 aa, Coccidioides immitis RS
MSSQNQEFTEGPQVYRPGGFHPVYLGEVYNGKYEVLRKLGSGRYSTVWLVQNREALKILSAECYGGLKDTYEREILEHLRDADPSHPGYAYISTLVDSFEHQGPNGRHVCLVFRVMGETLRSFGTWFEHHMIPNEIMRRFTIQLLLALDYAHDHNVIHTDIKPDNIFVQIQDESLISKLYLPNNPADPAGFDTSTNPSSIQCQPLKWDYFQNGANLLEFDIALGDWGVASWTHSHLTELIQPVALRAPEVLIKAPWGPSTDLWNLGAVILEVFRAVRMFSGRVPPDGHYEVRSHLHEIVDLFGPFPKSLLQKGDQELVQEYFDSAGKVKHLPPLDRPGLESEAFLGKLDRKNKRQFVIFLRSLMKVDPEERKTTMELLAEPWLDAVLKPVSFGV

SEQ ID NO: 29443 - protein, 329 aa, Triticum aestivum
MLLCHRILPRLLSLSLPSSPTSKLLIRPSRLPPRGPFLPRCAALSQLAAPQTVDHSDAEESADHFDAEEPQEPQEPQEVQVKLPLDRLFLPPGASVTPGDEEVVTARVLKGSNIVLGTYARGDAQVVNADFIKSSVRPDDCPRDGLPEFALVGRSNVGKSSLLNSLVRRKRLALTSKKPGKTQCINHFKINDSWYLVDLPGYGYASAPQVARKDWDEFTRNYFLSRDNLVSVFLLIDASIPAKKIDLDYASWLGQNKVPMTLVFTKCDKRKKKKNGGKRPEENVECFQSLIREYFEAAPPWIMTSSVTNQGRDEILLHMSQLRNYWRKH

SEQ ID NO: 29444 - protein, 249 aa, Xylella fastidiosa Ann-1
MRPKIVAGNWKLHGSHAFAQALVAQVAAGLPLPGVSVIILPPLLYLSDLVQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLDLVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 29445 - protein, 504 aa, Gibberella zeae PH-1
MSLLTNSCAYFALASSLRRIQNIIVRSAPSLSIVQTVKLPPDFSTPVSTLAWAPSSARILVANADQIHVVSIVDSSFRAAIRNPAAGGGKQTLVQFGAYDDEVFACAAFGLKFSIFDLPTSKAIEINNPKFYLPSSAPRGYSLRPQSSHLAILTRTSGRDAVSIHEPRTRRVLRSWFPETVDAHGLAWTPDGKWLLLWEASAHGHKLLLYTPDGQFFRSVGASTIAQGQDADLETGIKCCGLSHDASFCAIGDGSRTVSALHTKTWRDGLKLTHPTTVIPKDTLQVWQEQLNTSSQGGTSYTFLRANQMVSPPTRLVDGKPPPDVKTGCSSLAFDASLTLLVTRLDDAPTTLWIWDVTAAELRAVLMFHSAVDYQWHPTVRELLLVTCQDDKYRGVSFVWDPLSEGPKPVSLGSHLPNGKLTGKPQAAWINGEPEFPVLLLSDAQNGVLVSCADAAQCPTPWHEGAASDRTLGSVHDIGDTVDVSALMADDTSTLDDTFSFKHN

SEQ ID NO: 29446 - protein, 449 aa, Thermoanaerobacter tengcongensis MB4
MIELVKFPKDFTWGVATSSYQIEGAVNEDGRTPSIWDTFSKTEGKTYQGHTGDVACDHYHRYKEDVQIMKEIGVKAYRFSIAWPRIFPEEGKYNPKGMDFYKRLVDELLKREIIPVATIYHWDLPQWAYEKNGGWLNRESVKWYVEYASKLFEELGDVIPLWITHNEPWCSSILSYGIGEHAPGHKDWREALIAAHHILLSHGEAVKVFRDMNLKGAQIGITLNLTPAYPASEKEEDKLAVQYADGFANRWFLDPIFKGNYPEDMMELYSKIIGEFDFIREGDLETISVPIDFLGVNYYTRSIVKYNEDSMLKAENVPGPGKKTEMGWEISPESLYDLLKRLDREYTKLPMYITENGVAFKDEVTEDGRVHDYERIEYIKEHLKAIARFIEEGGNLKGYFVWSLLDNFEWAHGYSKRFGIVYVDYETQKRILKDSAFWYKGVIEKGVIE

SEQ ID NO: 29447 - protein, 435 aa, Xylella fastidiosa Ann-1
MNQIRQAPAASASNANESKQEIRNYTMNFGPQHPAAHGVLRLILEMDGETVVRADPHIGLLHRGTEKLAESKPFNQSIGYMDRLDYVSMMCNEHAYVRAIETLIGIQVPERAQYIRTMFDEITRILNHLMWLGSNALDLGAMAVMLYAFREREELMDVYEAISGARMHAAYYRPGGVYRDLPDTMPKYKQSRWHKGKALKRLNAAREGSMLDFLEHFTDTFPQRIDEYETLLTDNRIWKQRTVGVGVIEPDVAKAWGMTGVMLRGSGIAWDLRKKQPYAKYDAVDFDIPLGTCGDCYDRYLCRVAEMRESNRIIKQCVQWLKVNPGQVMVENFKVAPPKRESMKDDMEALIHHFKLFSEGYCVPAGETYSAVEAPKGEFGCYLISDGANKPFRVHLRAPGFAHLSSMDAVVRGYMLADVVAMIGTYDLVFGEVDR

SEQ ID NO: 29448 - protein, 287 aa, Methanocaldococcus jannaschii
GPLGSMINAKTKVIGLIGHPVEHSFSPIMHNAAFKDKGLNYVYVAFDVLPENLKYVIDGAKALGIVGFNVTIPHKIEIMKYLDEIDKDAQLIGAVNTIKIEDGKAIGYNTDGIGARMALEEEIGRVKDKNIVIYGAGGAARAVAFELAKDNNIIIANRTVEKAEALAKEIAEKLNKKFGEEVKFSGLDVDLDGVDIIINATPIGMYPNIDVEPIVKAEKLREDMVVMDLIYNPLETVLLKEAKKVNAKTINGLGMLIYQGAVAFKIWTGVEPNIEVMKNAIIDKITK

SEQ ID NO: 29449 - protein, 222 aa, Brassica napus
MASMLARRSLNTLRTRHLVLSGKALQGSHLSGLQSRAISYGSKKDDEEEEQLAKEISKDWNTVFERSINTLFLTEMVRGLSLTLKYFFDPKVTINYPFEKGPLSPRFRGEHALRRYPTGEERCIACKLCEAVCPAQAITIEAEEREDGSRRTTRYDIDMTKCIYCGFCQEACPVDAIVEGPNFEFATETHEELLYDKEKLLENGDRWETEIAENLKSESLYR

SEQ ID NO: 29450 - protein, 154 aa, Arabidopsis thaliana
NRGETLDSIPTDLILDILSRLPTKSIARFHCVSKLWSSMLASQDFTRLFVNRSSSNPRLLLGIVRGGEWSFYSSPQPKNPYEKSSLEVAADFHMKLSEIKQHQHHGTSYAFGLIYLRTVWMSKEGNYEVCVICKPSTGQYMRSYHLNRQESLAI

SEQ ID NO: 29451 - protein, 503 aa, Pisum sativum
MAITVSSRQLFIDGEWRVPILNKRIPNINPSTENIIGDIPAATKEDVDLAVDAAKRAISRKNGRDWSAASGSLRARYLRAIAAKIKEKKDELGKLESIDCGKPLEEALADLDDVVACFEYYAGLAEELDSKQKAPISLPMDTFKSYILKEPIGVVALITPWNYPFLMATWKIAPALAAGCAAILKPSELASVTCLELGEICKEVGLPRGVLNIVTGLGHEAGASLASHPDVDKISFTGSSATGSKIMTTAAQLVKPVSLELGGKSPIVVFEDVDLDKVAEWTGFGCFFTNGQICSATSRLIVHESIAVEFVDKLVKWAENIKISDPLEEGCRLGPIVSEAQYKKVLNCISSAKSEGATILTGGRRPEHLKKGYFVEPTIITDVTTSMQIWREEVFGPVLAVKTFSTEEEAINLANDTHYGLGSAVMSNDLERCERLSKALQAGIVWINCAQPSFIQAPWGGIKRSGFGRELGEWGLENYLSVKQVTRYTSDEPWGWYQPPSKL

SEQ ID NO: 29452 - protein, 506 aa, Methylobacillus flagellatus KT
MSLDSLKGLGIKVPYKNKYDNYIGGQWVAPVDGEYFDNISPVTGKVFCQVPRSNEKDINLALDAAHAAKEAWARTSGTGRANILLKIADVMEANLETIAIAETIDNGKPIRETMAADIPLAIDHFRYFASCIRTQEGGISEIDHETVAYHFHEPLGVVGQIIPWNFPILMAAWKLAPALAAGNCIVMKPAEQTPASILVVMELIGDLLPPGVLNVVNGHGVEAGKALATSPRIAKIAFTGSTSVGRLIMQYASQNLIPVTLELGGKSPNIFFEDVMDKDDAYFDKALEGFTLFALNQGEICTCPSRALIQESIYEQFIERAIKRVKAIKQGSPLDKSTMIGAQASSEQVEIIMSYIKLGLEEGAQLLTGGNATKLPGDLSEGYYIEPTVFKGHNKMRIFQEEIFGPVLSVTTFKDEKEALEIANDTMYGLGAGLWTRDGSRAYRVGRGIQAGRVWTNCYHLYPAHAAFGGYKQSGIGRENHRMMLDHYQQTKNLLVSYSPNALGFF

SEQ ID NO: 29453 - protein, 199 aa, Oryza sativa (indica cultivar-group)
METELCSSRVLSLPRYDSGDEELSVLPRHTKVIVTGNNRTKSVLVGLQGVVKKAVGLGGWHWLVLKNGVEVKLQRNALSVLEPPTGNEDDDDIDGNNSFCSSSDMGDKDMDYLAIIEYHKPTKPRVRHSRPWSSCTKSSNRGNFHPSSILQTRVNLTRLGTPTLWRYWKHFNLVSSLDPTNLTFHFHGLMLKNYAQVDL

SEQ ID NO: 29454 - protein, 522 aa, Glycine max
MISLIKNKINHLAPPTHHYSSLLLLPLSSKHTSSTMAAPSSETKSPSSSNTQLPLKPIPGSYGMPFFGAISDRHNYFYHQGRDKFFATRIEKHNSTVIRTNMPPGPFISSDPRVVALLDGASFPILFDNDKVEKLNVLDGTFMPSTKFTGGFRVCAYLDTTEPNHALIKQFFLNVLAKRKDSFVPLFRNCLQESFAEIEDQLSKNTKADFNTVFSDASFNFMFRLFCDGKDPSQTNLGSKGPKLVDTWLLFQLAPLATLGLPKIFNYIEDFLIRTLPFPACLTKSGYKNLYEAFKTHATTALDEAEKLGLKRNEACHNVVFTAGFNAYGGLKNQFPYVLKWLGLSGEKLHADLAREVRRVVNDEGGVTFTALENMPLVKSVVYEVMRIEPAVPYQYARARENLVVSSHDASFEVKKGEMLFGYQPFATRDPRIFEDAEVFVPRRFVGEGEKMLKHVLWSNGRETEEPSASNKQCPGKNLVVLLCRLFLVELFLRYDTFEFEYTQAGFGPTITIKSLTKASTI

SEQ ID NO: 29455 - protein, 924 aa, Prochlorococcus marinus str. MIT 9303
MSSVAHVTTASDVANLELDPLAIFSFPLDEFQLEAIAALNHGHSVVISAPTGSGKTLVGEYAIHRAIAHGQKVFYTTPLKALSNQKLRDFREQFGSQNVGLMTGDLSVNREASIVVMTTEIFRNMLYAEADQADDPLADVEAVVLDECHYMNDSQRGTVWEESIIHCPASVQLVALSATVANAGQLTDWIERVHGPTQLVFSDYRPVPLQFSFCSAKGLHPLLNDAGTGLHPNSKVWRAPKGHKRKGRSPKPPQPEPPPIRFVIAQMAEREMLPAIYFIFSRRGCDKSVKDLGSQCLVSPTQQEQIRQRLRTYSETNPEAVRDGIHADALLRGIAAHHAGVLPAWKELIEELFQQGLVKVVFATETLAAGINMPARSTVISALSKRTERGHRPLMGSEFLQMAGRAGRRGLDSQGYVVTVQSRFEGVREAGQLATSPADPLVSQFTPSYGMVLNLLQRHDLKKARELVERSFGRYLASLDLVYEEESLEQLRLQLGQLQGVAGDVPWQDFEDYEKRRSRLREERRLLRILQQQAEETLANELTLALQFASVGTLVSLKAPQLRGRVTPAVIVDKLEGPGQFPLLLCLTDENVWLLLPCPAVVSLHAELSCLQVTEMIEPDLQRSGELRHGDQHSGSLALAVAHMAKRHDMTTPQYDLAGEVLAQAQRVRGLEDELEQQPAHRWGDRKQLKKHRRRMEELELEICERQQSLHQRANRHWETFLSLIEILQHFGCLDDLDPTEIGRTVAAMRGDNELWLGLALMSGHLDDLHPANLAAVFEAISTEVNRPDLWSGYPPPASAEEALHDLAGIRRELLRAQEHCHVVVPAWWEPELMGLVDAWARGTAWSDLIANTSLDEGDVVRILRRTVDLLAQVPYCEAISEQLRRNARLALKAINRFPVCEAEDLLDAAAVDEELNPATERVA

SEQ ID NO: 29456 - protein, 392 aa, Chlamydophila pneumoniae CWL029
MDYYSILGISKTASAEEIKKAYRKLAVKYHPDKNPGDAAAEKRFKEVSEAYEVLSDPQKRDSYDRFGKDGPFAGAGGFGGAGGMGNMEDALRTFMGAFGGEFGGGSFFDGLFGGLGEAFGMRSDPAGARQGASKKVHINLTFEEAAHGVEKELVVSGYKSCETCSGQGAVNPQGIKSCERCKGSGQVVQSRGFFSMASTCPECGGEGRIITDPCSSCRGQGRVKDKRSVHVHIPAGVDSGMRLKMEGYGDAGQNGAPSGDLYVFIDVESHPVFERRGDDLILELPIGFVDAALGMKKEIPTLLKTEGSCRLTVPEGIQSGTILKVRNQGFPNVHGKGRGDLLVRISVETPQNLSEEQKELLRTFASTEKAENFPKKRSFLDKIKGFFSDFTV

SEQ ID NO: 29457 - protein, 678 aa, Chlamydophila pneumoniae CWL029
MGVVQNQVISSIRDVLKLVWELRFAEHKMLLLSRQSGSGGTFQLSCAGHELAGVLAGKSLIPGKDWSFPYYRDQGFPIGLGCDLSEIFASFLARTTPNHSSARMMPYHYSHKKLRICCQSSVVGTQFLQAAGRAWAVKHSSADEVVYVSGGDGATSQGEFHEMLNFVALHQLPLITVIQNNHWAISVPFEDQCGADLASLGRCHQGLAVYEVDGGNYTSLTETFSHAVDQARQHSVPALILIDVVRLSSHSNSDNQEKYRSALDLKLSMDKDPLILLEKEAINVFGLSPFEIEEIKAEAQEEVRKSCEIAEALPFPSKGSTSHEVFSPYTETLIDYENSESAQNLRNSEPKVMRDAISEALVEEMTRDSGVIVFGEDVAGDKGGVFGVTRNLTEKFGPQRCFNSPLAEATIIGTAIGMALDGIHKPVVEIQFADYIWPGINQLFSEASSIYYRSAGEWEVPLVIRAPSGGYIQGGPYHSQSIEGFLAHCPGIKVAYPSNAADAKALLKAAIRDPNPVVFLEHKALYQRRIFSACPVFSHDYVLPFGKAAIVHPGKDLTIVSWGMPLVLSLEVAQELASRGISIEVIDLRTMVPCDFATVLKSLEKTGRLLVIHEASEFCGFGSELVATMSEQGYAYLDAPIRRLGGLHAPVPYSKVLENEVLPHKESILQAAKSLAEF

SEQ ID NO: 29458 - protein, 312 aa, Boechera parishii
SLLLSLASAEQCGRQAGGALCPNGLCCSEFGWCGDTEPYCKQPGCQSQCTPGGTPPGPTPTGDLSGIISSSQFDDMLKHRNDAACPARGFYTYNAFITAAKSFPGFGTTGDTATRKKEIAAFFGQTSHETTGGWASAPDGPFSWGYCFKQEQNPTSNYCEPSATWPCAPGKRYYGRGPMQLSWNYNYGLCGRAIGVDLLNNPDLVANDAVIAFKAAIWFWMTAQPPKPSCHAVIAGQWQPSDADRAAGRLPGYGVITNIINGGLECGRGQDGRVADRIGFYQRYCNIFGVNPGGNLDCYNQRPFGNGLLGAA

SEQ ID NO: 29459 - protein, 359 aa, Dehalococcoides sp. CBDB1
MVNKRDYYEVLGLERSASDEDIKKAFRKMAMKHHPDRNHEEGAADKFKEVNEAYEVLSNPEKRAAYDRFGFSAGADSFGQGGFENFDFGGLGSIFETFFGGATQGAKRGPRRGPDMSYDIKISLEEAATGVEKDITTERLEYCTECSGTGAKAGTSPVKCTSCNGTGQVYQVQKSVFGRFTSVTPCPKCRGEGTIIGEPCTKCRGTGKEYVKRTVQVKIPAGVADGNQIRLNGYGGVGDKGASAGDVYINVGIAEHADFKRDGDDVIYELEINFAQAALGTEVNVPGLNTEHKLKIPSGSQNGKYFVLKGKGIPHLNRFGSGDEMVHLNVVTPEKLSRKQKQLFEELEKSFAEDKKQAT

SEQ ID NO: 29460 - protein, 473 aa, Synechococcus sp. WH 7803
MASTAQDVLRQIKDEGIELIDFKFTDLHGKWQHLTICSDLLEADSFEEGLAFDGSSIRGWKTIDASDMAMVPDPSTAWIDPFYSHKTLSMICSIQDPRTGTLYDRCPRALAQRALAYLSGSGLADKAFFGPEPEFFLFDDVRYNSSEGGSFYSVDTIEASWNSGRLEEGGNLGYKIQLKEGYFPVAPNDTAQDIRSEMLLMMAQLGIPIEKHHHELAGAGQHELGMKFAELIKAADNTMTYKYVVRNVAKKYGKTATFMPKPVFNDNGSGMHVHQSLWKAGQPLFFGEGTDANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQIDPGAPTNEDLFELSAERLSAIDTVPASLNGALEALNADHHYLMEGGVFSKDFINNWIDLKYEEVQQLRQRPHPHEFTMYYDA

SEQ ID NO: 29461 - protein, 373 aa, Vibrio angustum S14
MTTVKINLLDFDRKGLRKYFAEELNEKPFRADQIMKWIYHFGCDDFDQMTNINKKLREKLKRVAEIRAPYVSEAQHSTDGTIKWAMRVGDQDVETVYIPDEDRATLCVSSQVGCALECKFCSTAQQGFNRNLRVSEIIGQVWRAAKEIGVQKETGRRPITNIVMMGMGEPLLNMKNLIPALEIMLDDLGFGLSKRRVTVSTSGVVSGLEQMIGNIDVALAISLHAPTDELRSQIMPINDRWNIEAFLDVVRRYVNSTNANRGRVTVEYVLLDHVNDDMEHARQLAKVLKDTPAKINLIPFNPYPGSPYKKPSNSRIDRFMKTLMEYDFTVTVRKTRGDDIDAACGQLVGDVIDRTKRTQAKLNTGEQIAVKAV

SEQ ID NO: 29462 - protein, 157 aa, Brassica napus
TIWIASSFVVQSVVDAGVSPFLITFICNSLFVVYLPIFEISRYLEDTYGSSILFWRSKRSHLLELAESEKEALLGQDVVISDASEVSGVVVREDGNGLDEKGRWTRMRVAKVSLLICPFWFLAQLTFNLSLKYTTVTSNTILSSASSLFTFLVSLLF

SEQ ID NO: 29463 - protein, 143 aa, Vibrio angustum S14
MTIERTFSIVKPDAVKRNLIGAIYQRFENAGLNIVAAKMLHLDSAKAQGFYAEHEGKPFFDDLVAFMTSGPVMVQVLEGENAITRYRELMGKTNPEEAACGTIRSDFALSMRHNSVHGSDSPESAAREIAYFFAEDEICPRGE

SEQ ID NO: 29464 - protein, 456 aa, Prochlorococcus marinus str. NATL2A
MATHDIFMPALSSTMTEGKIVEWLKKPGDKVERGESVLVVESDKADMDVESFQDGFLASIVMPAGSSAPVGETIGLIVETSDEIAEAQANAPSPSPQSGSQEKESSSPQVQEKQASVDSPKATVVTKTSLAPLVSESSVNQDQFLNDGRIVASPRAKKLASQMGVDLATVRGSGPHGRIQAEDVQSAKGQPISVPWIAESNAPAKIISDVPRIEKKSVDSGKPPAPGKSFGSRGETISFNTLQQAVNRNMEESLNTPCFRVGYSILTDELDDLYKQVKSDGVTMTALLAKAVGLTLARHPQVNAAFSSEGIAYPSQINVAVAVAMEDGGLITPVLQNADKTSLTDLSLQWADLVKRARNKQLEPQEYSSGTFTLSNLGMFGVDRFDAILPPGTGAILAVGASLSKVVASKDGSISIKKQMQVNLTADHRVIYGADGALFLKDLAYLIENNPCSLSS

SEQ ID NO: 29465 - protein, 201 aa, Escherichia coli CFT073
MIRSKRAVSTTVTSRHTLMTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 29466 - protein, 847 aa, Rosa hybrid cultivar
MEMPGRRSNYTLLSQVPDDHFAAATATSFYESEGKNNNNKAKGDSRGFDWETGGGEYRAAPANRIGNVYSSVGLQRQSSGSSFGESSLSGEYYAPTLSTTAANEIDGFGYVNDDGFKTGGGGGEFRGKGGGMDGGVGPPGGSSSGKSWAQQTEESYQLQLALALRLSSEATCADDPNFLDPVPDESSSRLSSSADAVSHRFWVNGCLSYFDKVPDGFYLIHGIDSYVWSMCTDVQESGRIPSIESLKSVDPGTGSSIEVVLIDRRSDPSLKELQNRVLSISYACITTTEIVDQLAKLVCSRMGGSASVGEAEFFSIWRESSDDLKDCLGSVVVPIGSLSIGLCRHRALLFKVLADTIDLPCRIAKGCKYCTRDDASSCLVRFGIDRELLVDLIGNPGCLCEPDSLLNGPSSISISSPLRFPRLRTVEPTIDFRSLAKQYFSDCQLLNLVFDEAPAGSAGDEDNKGFSMYPKQKFTDGNNLFLVSGLGDDTSMHVDDRNPQFLKSFNPSQNIVHQQTVLKDQIPLKRIPPIGHRDISRLDTSKDSRFGEGLQVVPSKPNKELTLDVDDLDIPWSDLVLKERIGAGSFGTVHRADWHGSDVAVKILMEQEFHAERFNEFLREVAIMKRLRHPNIVLFMGAVTKPPNLSIVTEYLSRGSLYRLLHKPGPILDERRRLYMAHDVAKGMNYLHRRNPPIVHRDLKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDLNPQVASIIEACWANEPWKRPSFASIMESLRPLIKAPTPQPSHADMPILT

SEQ ID NO: 29467 - protein, 511 aa, Synechococcus elongatus PCC 6301
MAALSLADRVVVTAEQMQAIESRLFAAGMPVAALMEKVAGLLSQRLQMAYPDRTQRWGIWVGPGHNGGDALVVARELHLQGYPVQIWHPFERRKPLTEAHLQFAQHLGISIACDYPEHCDRWLDGGFGFGLNRPLNEATQTAIAQLNDSGKPILSIDLPSGLDTDSGEPLGAAIRAERTYCLGLWKQGLLQLVAAPWHGELERVDFGIAEADIVAVLGPVPDRQILTDEAAIAALPLPIAADAHKYRRGQLLLIAGSQRYRGAALLAALAARSSGVGMMTLAVPASLSAIAIAQVPEALVVACPETETGEIAELPIDRDRYNAIAIGPGVGTGPTIRTILHRVLQQSTPFLIDADALTVLAQHPEDWALRPAEARTVITPHAGEFQRLFGSAPTPASLSSAASERSLILVRKGPSPTVVTPVGASWALVDSTPALARGGRGDVLTGLLGGLLAQTDAVSAAIAATWWHSRTAQAIAQKQTALGVTPTELAAQLTPWLGQRLQSEIAQYLAS

SEQ ID NO: 29468 - protein, 530 aa, Bordetella parapertussis 12822
MHQRILILDYGSQVTQLIARRVREAGVYSEIHAGDVDDAFVRDQVAQGLKGIILSGSHASAYEEGSMRVPAAVFEVGVPVLGICYGMQSMAQQLGGTVSFSDHREFGYAEVRAHGHTKLLDGLADFTTDEGHGMLKVWMSHGDKVTELPPGFKLMASTASCPIAGMADEDRGFYAVQFHPEVTHTVQGKAMLARFVKDICGCEGDWNMPDYISEAVARIREQVGSDEVILGLSGGVDSLVAAALIHRAIGDQLTCVFVDHGLLRLDEGKQVMQTFAENMGVKIVHVDATSQFMGKLTGVADPEAKRKIIGREFVEVFQDEAGKLQGAKWLAQGTIYPDVIESAGAKTGKATSIKSHHNVGGLPDTLNLQLLEPLRELFKDEVRELGVALGLPPQMVYRHPFPGPGLGVRILGEVKHEYAELLRRADAIFIEELRNAKDPASGLTWYELTSQAFAVFLPVKSVGVMGDGRTYEYVVALRAVQTFDFMTADWAPLPHPLLARVSSRIINEVRGINRVVYDVSSKPPATIEWE

SEQ ID NO: 29469 - protein, 322 aa, Yarrowia lipolytica CLIB122
MMFDTFSPITPPSEAAPNAVLASAQTVLRAQAATIAHITDLYDTDPEVQQQFAKGIQYLHNAVVGGNKVVLTGMGKSHKIACKLSATMNSLGMHATPLHPTEALHGDLGIVKPGDVVVMITASGNTPELKQLLPHLDATLLTLTCEPNSSLGHLSHAVFACPVPDSHKEKNIYGMAAPTTSTTACLVVGDSICIALCESLQLDKAERNRTFGRNHPGGVIGEAFKNELPPVQSVCSYSTSSHNEMLLLRTTSGNQWVVVDNTWLVPTRNILGLIDAGFTDQMETQIRLEELEKVDQSRLAGVPPGQRVVVVKEDEIVGVYER

SEQ ID NO: 29470 - protein, 477 aa, marine gamma proteobacterium HTCC2207
MSIAASSSTKKLSILQITIVAALGGLLFGYDTGVIAGSQLYFTKYFNLSAAEQGWAVSSALYGCLVGALAGGYLTKRISRKYTLILAASLFAVSAWGSGMAATLNELAIYRIIGGLAVGMASLAAPMYIAEMAPPKYRGRMVSYYQLAVVIGFFVVFLATYFIGGGDTQNMTPEVLAQLHEHNVNQGWRIMLWSELLPALAFLGLLFTVPHSPRWLISQGRTEEAKTVLAQITSSEQEAASEFADIEASLTHSPAPNLAMLFGKGIGFALFLGVMLSIFQQVTGINAILYYGAEIFSNALGYGPEDALKQQLWLGAVNLIFTFVAIYKVDSWGRKPLFIAGSIGMCAGLTVLGLTIYTQQMGVVSLIAVLVFIASFAMSMGPVVWVMLSEMFPNNVRSVAMSIAVAAQWLFNALVANSFPLVNQSTLNQEGFNGALPYFIFASFCVVAMIFVWKLVPETKGKTLEEMEALWSAKDAG

SEQ ID NO: 29471 - protein, 224 aa, Zea mays; identical to SEQ ID NO: 1330

SEQ ID NO: 29472 - protein, 135 aa, Xanthomonas campestris pv. vesicatoria str. 85-10
MSKLNKTILADFEAAQIQRKLPEFNQGDTVVVNVKVKEGNRERVQAYEGVVIGTKNAGLNSSFTVRKISHGFGVERVFQTHSAIIDSVEVKRRGKVRAGKLYYLRGLEGKAARIKEDLAAAAQAKAARQAAAKVE

SEQ ID NO: 29473 - protein, 315 aa, Ustilago maydis 521
MSSQQNDDEVITAYPNYYPDRQKQQLPGEDQSMEPLAEHVKVEKWDNNGKPYLEEYKGSGKLHGKSAIITGGDSGIGRSAALFFAREGANVTIAYLPEEEKDADAVEKLVRQAPMGTNEILRVPGNLEKESDCKLVVQKHLDKWGTIDIVVNNASKQVPCKQFEDIDLDVTESTFRSNVLGAFALTKYALPHMKRGSTIIQSTSVTAYKGSAQMIDYSSTKGALVSFTRSMALHLAPRGIRVNAVAPGPIYTPLQPASRSADNMEGWGIGGAPLHGRPGQPAEMGATYVYLADAGSSNIMTGQVLHLSHGSWFGS

SEQ ID NO: 29474 - protein, 267 aa, Bacillus cereus G9241
MWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEMAHKKINDFPDVPFLLMQACEDKLVDKIRVRTWFDNVKISDKAFKEWPNCYHELLNEYERDEILNYIQSFTEIRINNIIETNK

SEQ ID NO: 29475 - protein, 143 aa, Methylococcus capsulatus str. Bath
MAVERTLSIIKPDAVAKNVIGEIYSRFEKAGLRIVAAKMAQLSREQAEGFYAVHRERPFFNDLVSFMISGPVMIQVLEGENAIAKNRELMGATNPRDAAPGTIRADFAVSIDENAVHGSDGPETAAQEIAYFFESDELCPRTR

SEQ ID NO: 29476 - protein, 525 aa, Pseudomonas putida KT2440
MALDIHAHRILILDFGSQYTQLIARRVREIGVYCELHPFDMDDEAIREFNPRGIILAGGPESVHEANSPRAPQAVFDLNVPVLGICYGMQTMAEQMGGKVEGSDLREFGYARVDVVGKSRLLDGIEDHVDDDGVLGLDVWMSHGDKVTQMPGNFNILASTPSCPIAGMYDDVRGYYGVQFHPEVTHTKQGGRILSRFVQDICGCEALWTASNIVEDAIAQVRAQVGSANVLLGLSGGVDSSVVAALLHRAIGDQLTCVFVDNGLLRLHEGDQVMAMFKENMGVKVIRADAEKQFLDNLEGEADPEKKRKIIGRTFIDVFDAEASKLENIQFLAQGTIYPDVIESAGAKSGKAHVIKSHHNVGGLPEEMNLKLVEPLRELFKDEVRKIGLELGLPYDMVYRHPFPGPGLGVRILGEVKKEYADILRRADHIFIEELRKADWYHKTSQAFVVFQPVKSVGVVGDGRRYAWVVALRAVETVDFMTARWAHLPYELLETVSGRIINEIDGISRVTYDVSSKPPATIEWE

SEQ ID NO: 29477 - protein, 431 aa, Vibrio parahaemolyticus RIMD 2210633
MTKSSELYQKAQQTIPGGVNSPVRAFNGVGGSPLFIERADGALIFDADGRAYIDYVGSWGPMILGHNHAVIREAVIDAAQRGLSFGAPTEMEIAMAELVSELVPSMEQIRMVSSGTEATMSAIRLARGFTGRDKIMKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYVAPTGPVYQAGTLSGNPVAMAAGFACLNLLKEEGNEKRLASKTKQLADGFKSLAEKHGIPLVVNQVGGMFGFFFTDQETVTCYEDVTKCDIERFKRFFHLMLDHGVYLAPSAFEASFTSLAHGSKEIDATLEAADRCFAIIAAEAK

SEQ ID NO: 29478 - protein, 250 aa, Zea mays
  misc_feature (139)..(140): Xaa can be any naturally occurring amino acid
  misc_feature (157)..(157): Xaa can be any naturally occurring amino acid
  misc_feature (170)..(170): Xaa can be any naturally occurring amino acid
  misc_feature (172)..(172): Xaa can be any naturally occurring amino acid
  misc_feature (202)..(202): Xaa can be any naturally occurring amino acid
  unsure (1)..(250): unsure at all Xaa locations
MCRQHQHLSSDHKTKRSLSFGIQKQLAMESSGIGRVAPLEAVLFDIDGTMAISDPFHHRATSEMLLKVGYNNGVPITPEFGMANMAGRSNEQIGRFLFPDWDQRRLDAFFAEKEALFARYAAEGLREIAGLTPLCRWGXXARLRRARVTNAPRANAXLMISILGLSDFFXLXVTGEECGRTKPYLDPYLRGLDLLGFSPDNXLRVQDSTPGGQPGFAQGIPGVLLPKKRKKKNFFPLGKTFFLGDSKNPR

SEQ ID NO: 29479 - protein, 415 aa, Zea mays
MPVTDHQSSSPSPFSFGRSLLSLRRDPTAMPSGEEADLEAFQRHVASTLAELLPAAEAGVGGSDATAGAGEEFLSAAWIRRLLEAFVLCQEEFRVFVAQARRRAGGAAPWRPEKTVAEFHERAVKALDVCNAARDGVDQVRRWERLADIAASALRAPGEVHEGQLRRARKALTDVAALLVDDTAASGAGGVASFLSSHRNRSFGRARASPSRSAGASASASASSSHFRSLSWSVSRTWSAARQLQAIGAGLAAPRAHEPGLAAPVYSMGCVLHLTAWALVVAVPCPDRGNALQAHHLPGAPPRATFPWAPPLLTLQERLTEEGKRKDRRHSCGLLKEIHSLERSTQRLAEAIDAAPIPLFGDREADVREAAAELAAVCEAMRDGLEPLERLLREVFHRIVRSRVDGLDSSMHNAD

SEQ ID NO: 29480 - protein, 484 aa, Synechococcus elongatus PCC 6301
MSAVHLTVTPPGPIRFGTDGWRGVIAADFTFERLFRAAGAAAKVLARTYGDNGSRRILVGYDRRFLSEEFASITAQAIQAVGLEAQLASNYATTPALSWAVHEQAALGALVITASHNPGQYSGLKIKGAFGGSVPGSVTAEVEALLDQGFTPDLPDSSSAIARFDPWQSYRQMLRQKVDLAAIQAAIAGGRLSVFVDVMHGAAAGALAQILEAPVTELRSDRDPLFGGGAPEPLAANVVGLCQRLSDGVTTPLAVGFVFDGDGDRIAAVDRSGEFLSSQVLIPVLIEHLAARRSCPGELVKTVSGSDLMPKVAALFNIPVTELPVGYKYIADRMLSQTVLLGGEESGGIGYGSHIPERDGLLSALYLLEAIVQSDRNLGDLYADLQARTQFQSTYDRIDLPLADMSARDRVLQALQTQTPQAIAGLEVISYQTIDGFKFRLSDGRWLMVRFSGTEPLLRLYCEASSPEAVQETLNWAKDWAQRC

SEQ ID NO: 29481 - protein, 340 aa, Myxococcus xanthus DK 1622
MTKFGSEGLMPPLDVVCFGETLVDFLPAAPGHRVRDVPAWHPCPGGSPANVAVGLARLGLRPAMLGVVGADEFGHFLRERLAAEGVDVSHLRQTAEARTGLVFISLDGKGERSFTFFRTRSAEFLLGQADVDAAFLSGAKAVHCGSNSLQWPEAQEAAVRMLGLARDAGLIVSCDPNLRLHAWEDTSLLKGLLARMLPLCTVVKLSEEEIGFVTGTEVPHEALTRLAAMGVPLPVVTLGERGALLQWKGECIHVAAPQARVVDTTGAGDGFVAGLLQGLVRWYGGAGGLRDATGEELVTLATFACEVGARVVEKLGAVDGLPRAEVLAHVMPSRPDSSRA

SEQ ID NO: 29482 - protein, 222 aa, Prochlorococcus marinus str. NATL2A
MLISVLTGFSAGAVHVVSGADHIVAMAPSSVRKPRVALINGLAWGIGHSAGVLILSILGILAKDLINIELMSSYAEFLVGISLLIVGGVAIRTSLKVNIHMHQHMHGEEATHKHFHFHSLGNKLHRSHTHAATGLGVLHGFAGASHLVAVIPALALPLFGALAYLFAYLLGSIFAMGCVVLGISFATSKVNKMFYPFLMRSIGALSIVTGIFWLQKTSILTF

SEQ ID NO: 29483 - protein, 334 aa, Myxococcus xanthus DK 1622
MATTRTVTIINGDGIGPEVMAATVRVLEALKVPLDFEYKDAGTEVVAKYGTNLPHETVEAVLRSGIALKGPTGTVVGGGLPSANVGLRKRLDLYSSLRPVKSVPNVKTRYEGVDLVVVRENTESLYAGLEHIIVPGVVESLKIITEKASTRIARFAFEYARKHGRKKVTAVHKANIMKLSDGLFLDCCRKVGREFPDVTYEEVIIDNLAMQLVKDPTRFDVLVAENFYGDVLSDLCAGLVGGLGVVPGANIGERTAVFEAVHGTAPDIAGKGIANPTALMMSAVMMLDHLELGEAARRMENAIWKVYGSGEVRTGDLGGKATTREFTDAIIGAL

SEQ ID NO: 29484 - protein, 95 aa, Quercus suber
VFDDPITLDNNLHSKPVGRAQGLYIYDTKNTFTSWLGFTFVLNSTDHQGTINFSGADPIMVKSRDISIVGGTGDFFMHRGIATIMTDSFEGDVYF

SEQ ID NO: 29485 - protein, 590 aa, Pseudomonas syringae pv. syringae B728a
MCGLAGELRFDHQPADLAAVERITHELAPRGPDAWGFHSQGPVALGHRRLKIMDLSDGSAQPMIDSNLGLSLAFNGAIYNFPELRAELESLGYQFHSGGDTEVLLKGYHAWGADMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHEDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQEREIIEQLPAAFRAMSEPMVSHDCIAFYLLSREVSKHCKVVQSGQGADELFAGYHWYPQVDGASDPVAAYRDAFVDRSYAEYAETVQPKWRTANDAAGDFVRDHFAQPGASAAVDKALRLDSTVMLVDDPVKRVDNMTMAWGLEARTPFLDYRLVELSARIPGKFKLPDGGKQVLKEAARMVIPSEVIDRKKGYFPVPGLKHLQGDTLNWVRELLTDSSQDRGLFNPAMVDKLLTNPEGQLTPLRGSKLWQLAALNLWLSEQGL

SEQ ID NO: 29486 - protein, 95 aa, Quercus suber
VFDDPITLDNNLHSTPVGRAQGFYVYDKKDIFTAWMGFSFVFNSTRHKGSINFAGADPLSNKTRDISVVGGTGDFFMARGIATLMTDAFEGDVYF

SEQ ID NO: 29487 - protein, 253 aa, Synechococcus elongatus PCC 6301
MNGLARSEQSAVRRIIIAGNWKMYKTQAEALEFLQAFLPQLSETPESRKVVLCAPFTTLSSLSKTLHGSRVRVGAQNIHWAKEGAFTGEISGAMLTEIGVRYVVVGHSERRQYFGETDETVNQRLLAAQSFGLLPILCVGESKQQRDAGETEAVISRQLERGLVGADQTNLVIAYEPIWAIGTGDTCAAEEANRVIGLIRSQLKDTDVPIQYGGSVKPENIDEIMAQPEIDGALVGGASLEAESFARIVNYQS

SEQ ID NO: 29488 - protein, 369 aa, Anabaena azollae
MQVKAAVAYSVVQPLTIETVELEGPQAGEVLVEIKASGVCHTDAYTVSGADPEGLFPAILGHEGAGVVVEVGADVKSVKPGDHVIPLYTPECRQCEYCLSFKTNLCQAIRVTQGRGLMPNATSRFSIVGKMIHHYMGTSTFANYTVLPEKAVAKIREDAPFDKVCYIGCGVTTGIGAVIYTAKVEAGANVVISGLGGIGLNIIQAAKMVGANMIVGVDINPKKRALAEKLGMTHFVNPHEIEGDLVSYLIDLTKGGADYPFECIGNINVMRQALECCHKGWGVSVIIGVAGAGQEISTRPFQLVTGRVWKGSAFGGARGRTDVPKIVDLYMNGQINIDDLITHVMPIEQINHAFDLMYRGESIRSVVTF

SEQ ID NO: 29489 - protein, 140 aa, Zea mays
MGSVSFSNSMPITRLPLLTYQSLLPTSSSLPPLSNRRRSNVSQTITASAVFSAPAGVNDSLPARNEGYTVGDFMTGRQHLHVVKPSTSVDDALELLVEKKVTGLPGIDDDWKLVGVVSDYDLLALDSFSGRSQNENKLGP

SEQ ID NO: 29490 - protein, 374 aa, Zea mays
MLGAARRQLGSGPMLGQVLRRLRPAVAAEVARGYSAAAKEMTVRDALNSALDEEMSADPSVFLMGEEVGEYQGAYKISKGLLDRYGPDRVLDTPITEAGFTGIGVGAAYHGLRPIIEFMTFNFSMQAIDHIINSAAKSNYMSAGQISVPIVFRGPNGAAAGVGAQHSQCYAAWFAHVPGLKVLTPYSSEDARGLLKAAIRDPDPVIFLENELLYGESFPVSAEVLDSSFCLPIGKAKIEREGKDVTITAFSKMVGYALQAAEILSKEGISAEVINLRSIRPLDRAAINASVRKTNRLVTVEEGFPQHGIGAEICMSVVEESFAYLDAPVERIAGADVPMPYAANLERMAVPQVDDIVRAAKRACYRAVPMAAAA

SEQ ID NO: 29491 - protein, 162 aa, Cryptococcus neoformans var. grubii
MSDVYFDIAINSQPAGRITFKLFDDVVPKTAQNFRELCTGQNGFGYAGSGFHRVIPQFMLQGGDFTNHNGTGGKSIYGNKFADENFKLRHDRPFLLSMANAGPNTNGSQFFITTVVTSWLDGKHVVFGEVSSGQDLVKKIESYGSGSGATKAKITIAASGTV

SEQ ID NO: 29492 - protein, 197 aa, Methylococcus capsulatus str. Bath
MNRRTAEVERYTLETQIRVQVDLDGTGKGKFRSGVHFLDHMLDQVARHGCMDLEVEAKGDLHIDAHHTVEDIGIALGQAFAKALGDKRGIHRYGHAYVPLDEALSRVVIDFSGRSGLFYEVEFPRDRIGDFEVDLFVEFFRGFVNHAQATLHIDNLKGLNAHHVAETIFKAFGRAVRAAVERDARTAGVLPSTKGLL

SEQ ID NO: 29493 - protein, 241 aa, Triticum aestivum
MKCPSDSSAGRDPWAPPPASGGGGSSEPAKKRQRTSSSSQAEASSSSSQPPPQQPGDAREVPDLGEDVMFEVLRRVEPRTLAAAACVSQGWRVLAQDERLWEAPCVREWTGLGFSEQLLRAVVLPFGGFRRLHAVSIQARRRFGVGCGNWHGVRTPERGRRRGVPWTEHEHRLFLLGLKKYGRGDWRNISRNFVQTRTPTQVASHAQKYFIRLSSGVARRSSIHDITTVHLTDDQPPAPSQ

SEQ ID NO: 29494 - protein, 275 aa, Erwinia carotovora subsp. atroseptica SCRI1043
MSEVTSFAVFGNPIAHSKSPRIHELFAAQTGITLTYQRVLAPLDNFEQMLRQYFHDGAGGANVTAPFKERAFAEADERSECAALAGAVNTLKRLSDGRLYGDNTDGIGLLSDLQRLALVKPLDRVLLVGAGGAARGVIQPLLASGCTVVLTNRTFFKAEALAKIFCDIGDIQATALDGLHGQSFDLIINATSSGMYDSIPNLPAELISPETSCYDMFYLPQLTPFLSWCVQQGAIHYADGLGMLVGQAAHAFKLWHGVMPDVEPVIDLLKQDLAK

SEQ ID NO: 29495 - protein, 162 aa, Cryptococcus neoformans var. grubii
MSQVYFDIAINNAPAGRITFKLFDDVVPKTARNFRELCTGQNGFGYAGSGFHRVIPQFMLQGGDFTNHNGTGGKSIYGNKFADEEFKLRHDRPFLLSMANAGPNTNGSQFFITTVVTSWLDGKHVVFGEVSSGQDLVKNIESYGSDSGKPKAKVTITGSGTV

SEQ ID NO: 29496 - protein, 463 aa, Ehrlichia chaffeensis str. Arkansas
MQNYDMVVIGGGPGGYKCAIRGAQLGLKVACIDKNEILGGTCLRVGCIPSKALLHFSHEYYHLKNNLSEVGITFDNLNFDLEKIMSFKDKNIAELGNGISYLFSSHKIDYLCGVGKIQSVGPNNFIIVISGNNGKQEIISRYVVIATGSDVANFPDIDEERVVSSTAALSFKEPPKRLIVIGAGAIGLEMSSVWSRFGSEVTVVEFSDKIAPSMDGDIGKALLTSLKKQGINFKLSTKVSSIDKKGSNLAVHLESVKDGKSEIIEADKVLVSIGRVPYTNGLIDNNSIECDARGFIKVNNKYETNIPGVFAIGDVIGGAMLAHKAEEEGIAVAELISGHVPHVDYEIIPSVIYTHPAVASIGKTEESLKKVNYSYNVGKSNFSANGRSKVTDNVSGFVKVLASKENDAILGVHIIGAYADTMINEAAVAMAYRASSEDIFRICHSHPDVNEAFKDACEAAFLK

SEQ ID NO: 29497 - protein, 416 aa, Ehrlichia chaffeensis str. Arkansas
MPIEVLMPALSPTMKSGTIRKWYKAEGDVVKSGDVIADIETDKAVMECEYTDEDGIMGKIFFAEGSKNIEVNQLIALIAVDEQDLAKVHSYEKGDNVVKNELVALQDSQPAQDESVVLQMNQQIVNASEVLVNSSNSSERVKVSPLAKKIASNLGVDVNLVKGTGPYGRIIKADILDVINQHGHIANSPEDASFTEISSMRRVIAERLVYSKQTIPHFYVSIDCLVDSLLKLRLEINAENPDTKVTVNDFIIKAVAMSIKKFPEINVSWSDDKIVVFPSIDISVAVSIDNGLITPIIFGADKKSLLEISREVKALASKAKSGKLKPEEFQGGGFTVSNLGMFGIKEFYAIVNPPQSCIMSVGCSEKRAMVVNEQICISNVVTVTLSVDHRVIDGVLAAKFLNCFKSYLEKPFLMLI

SEQ ID NO: 29498 - protein, 509 aa, Arabidopsis thaliana
MDAQSVSEKLRSSGLLRTQGLIGGKWLDSYDNKTIKVNNPATGEIIADVACMGTKETNDAIASSYEAFTSWSRLTAGERSKVLRRWYNLLSRSEPLHFTKHRYDLLIAHKEELGQLITLEQGKPLKEAIGEVAYGASFIEYYAEEAKRVYGDIIPPNLSDRRLLVLKQPVGVVGAITPWNFPLAMITRKVGPALASGCTVVVKPSELTPLTALAAAELALQAGVPPGALNVVMGNAPEIGDALLTSPQVRKITFTGSTAVGKKLMAAAAPTVKKVSLELGGNAPSIVFDDADLDVAVKGTLAAKFRNSGQTCVCANRVLVQDGIYDKFAEAFSEAVQKLEVGDGFRDGTTQGPLINDAAVQKVETFVQDAVSKGAKIIIGGKRHSLGMTFYEPTVIRDVSDNMIMSKEEIFGPVAPLIRFKTEEDAIRIANDTIAGLAAYIFTNSVQRSWRVFEALEYGLVGVNEGLISTEVAPFGGVKQSGLGREGSKYGMDEYLEIKYVCLGDMNRH

SEQ ID NO: 29499 - protein, 503 aa, Oryza sativa (japonica cultivar-group)
MDRTSAPPVRRNAYASSSTAMNGGFPRGKRGRNATATAGPDFLSALPEGILHHIMSFLNVRQVIQTCVLSWRWRDLWRSVPRINANYCELSMSPIAAFTPDNEAAFKRFVNRLLERRDPAAVIHTFNLRYTISNPNNRDNDSADANRWISHALQNQASFLKIIVDAHELHLDHTVFTSCYLGRITLKNVFLDQGFFEQLEIGCPLLQDLLLYDCIIGDDEISSETLNVLTMYGCQFPTLQESCISAPNLTSLIMHQPENFVPVLDDVASLVTATVDLFPLIEFCAYDMRQLLWSLSGVRNLDLDYYACKRHVGTMGGEVAWSQHTRAPSQWPALKHMVPCDQSVGPCRSNVTNPLDRPSISFMPSSYVDGAVAWPEPMENMTIKNNPQLCPKFINLVDLTLGQWCLDSDFYVLIIFLQSSPKLEKLTLKLEKYYPHPYEHIIGDELTERSFTCEHLKIVEIICMEDDEPLAKIVEGLFVDNGMNSVRLIFAKCIANKLEKVQR

SEQ ID NO: 29500 - protein, 438 aa, Prochlorococcus marinus str. NATL2A
MKGLDARKAAWDVIQAVGGGAFADVALERIFNLYSFKSIDKGLITELSYGAIRQRYYLDCWIDYLGKVPAKKQPPLLRWLLHLGLYQVLKMKRIPPAAAINTTVELAKTYHLKKLAPVVNGILRSALRSKERGLLLPKSNNPSLELAKNESLPLWLADELIKWKGLEDAKKIAKAFNCISPIDIRVNRLRADLKEVKEIFDSCGIHNQAIPNCPYGLEVRAGVGEPRKWPGYEEGKWSVQDRSSQLIAPSLGPLPGEKILDACAAPGGKSTHIAELINNEGNLWSVDRSSRRSKKILANSERLGTKCLQILVADSNELLLKNPDWKGFFDRILIDAPCSGLGTLARHPDARWRMNQDNIQQLVAVQSQLLNSLAPLLKNGGKLVYSTCTIHPEENSHQIKNFLQSKSEFLLEYEKQIWPGEGDNGDGFYISVLNKLKN

SEQ ID NO: 29501 - protein, 449 aa, Myxococcus xanthus DK 1622
MDTLRRWLDEKGVQKVKVGAVDVDGVWRGKYISLEKFLSAAKGGLGFCDVVFGWDLSDDLLDNTQVTGWHTGYPDAHAKVDPSTGRVIPWEPDTAAFLLDFENPDGTPFEASPRQLLQKVAARARSLGYLPRFGAEYEFFIFKEQPQSLRDKDFQGLTPLTPGMFGYSWLRTSLNAPLVHALIDGCNAFGLGIEGFHTETGPGVFEAAIRYDDIEKSADKAALFKTVVKEICARHGVTACFMAKVDAKLPGCSGHVHQSLWDLDGEQNLFHDAKAPHGMSKLLRHYIGGQVALMPELTALYWPTINSYKRSVENTWAPTTVTWGLENRTTAIRVIGESAKAMRLEYRQLGADMNAYIGMAVSLAAGLWGIENEVEPPAPCESNAYAKNDAPPLPRNLKDAVALLKGSERARELLGYGFVDHFVRTREWEVRQYERAVTNWELERYLELI

SEQ ID NO: 29502 - protein, 628 aa, Ustilago maydis 521
MPASAARGAVSRLSSLCTPSSSTAVSAIAPRRSITSAATSTSTIPASARSLVSWSRASNNAPHSCSSCGSQLSSFSTSKRSFSSSVVRSASTKDPYSVLGVKKDADAKDIKRAYYGLAKKYHPDTNKDKGSKERFVEIQNAYDLLSDDKKRAAYDQYGTTDGQPGFDPFGGGGSSPFGAGGFGGFQDFGGFSNAGNAGSIFESLFGAFGGGGRPGAQRGPGFGGAGFAGEARGEDLETTINLTFEEACKGTKRKVVINPIEPCGTCTGSGLKPGAKKSTCATCNGTGTRTFVIQSGFQMATTCPSCGGAGSTVAPGDNCNTCDGIGRVRGRKEVQIDLPAGVDDGFRIRKDGFGDVPLSGTGTPGSLYVRINVAPSRIWRRQGSTLFYPATIPFHTAILGGKVRVPTLDGPVEVRVPAGTQVGEEMILPGRGVPSPTRRGQKGDLMVQFEVSMPRSLTKRQREILQQYADEVEGRSPATSSPPPPPASDDSPSSSKPSKASSGTSSTSTKDNSQSRPSTSSSAASSSSAKTSSAPSDNAQAASTKASTKKTSAGRFSIHPSSRSDDTSNLDGISGATTNSSARRATPDPARPASSHPQASTPSAAESSTQEHQKGFLGRAWDWMTSRK

SEQ ID NO: 29503 - protein, 385 aa, Arabidopsis thaliana
MSDLPRDLLAEILSRVPLTSLRAVRLTCKKWNDLSKDRSFLKKQIVETKKKQLESKEIEVIMMRNFRVYLTSIDIHNNVDPSFTPKGTLISLSDDANHHQVDNVSRVFHCDGLLLCITKDLHYRLVVWNPYFGQTRWIQPRNSYHRKDNYALGYDEKKNHKILRLKDNYYAPRERICEFELYSFESNSWKVVLDVSPDWYIPSYNRGLSLKGNTYWYATEKHVNVDFLICFDFTTEKFGPRLPLPFNATESPTYEDVVTLSSVGEEQLAVLFQSEYTLMMEIWVTSKVESTEVLWNKLFLEVDLIAISSHFQFLAEAGSFFIDQKKNVVVVFDKDMDEATDRDMAYVVGKNGYFKKVDIGEEAYTSCFPLVCSYVPSSEQIRQLT

SEQ ID NO: 29504 - protein, 410 aa, Triticum aestivum
  misc_feature (195)..(195): Xaa can be any naturally occurring amino acid
  misc_feature (355)..(355): Xaa can be any naturally occurring amino acid
  unsure (1)..(410): unsure at all Xaa locations
MASPMLSTAMAPLQGGMLEFSGLRSSSSLPLRRNATSDDFMSAVSFRTYAVSTSGGSRKAPTEAKLKVAINGFGRIGRNFLRCWHGRGDSSPLEVIAINDTGGVKQASHLLKYDSTLGIFDADVKPVGDNAISVDGKVIKVVSDRNPSNLPWGEMGIDLVIEGTGVFVDRAGAGKHLEGPAPKKVLITRTPGKGXIPTYVCGVNADLYTHADTIISNASCTTNCLGPPCVKVLDQKFGIIKGTMTTTHSYTGDQRLLDASHRDLRRARAAALNIVPTSTGAAKAVALVLPNLKGKLNGIALRVPTPNVSVVDLVVQVSKKTLAEEVNQAFRDAAANELKGILDVCDEPLVSVDFXRCSDVSSTIDASLSMVMGDDMVKVIAWYLGRDHRAAARAGTRPLRCPDCPCSAFL

SEQ ID NO: 29505 - protein, 375 aa, Candida glabrata CBS 138
MSHEEVHDEFIAEDVTPNRPDETRGENGAPRRMLVREHRKIGRGAFGTVVQAYLTQDEQTWYGPFAIKKVPAQTEYKSRELQILRLTDHPNIVKLEYFFTHTSPKDNKVYQHLAMECLPETLQIEINRYTSNNLQLAIKHVKLYSYQIARGMLYLHALGICHRDIKPSNILVDPKTGVLKICDFGSAKRLEPNQPSISYICSRFYRAPELILGSTQYTTQVDIWGLGCVIGEMLIGRAIFQGQDPLLQLREIAKLLGPPDKKFIFFSNPRYTGPLYSTPLFNGTSLERFQKYFGHAGPDGIDLLMKVLKYEPELRFSPRRIMAHPFFDDLRNEKYFFPREQTQPVLLPELFNFNEFELQVIGELLQQIKPHSEEH

SEQ ID NO: 29506 - protein, 428 aa, Oryza sativa (indica cultivar-group)
MTPLHAAPHHAAAAAAVVSSPSSAPLLLRAKPYHPKAAACSFTVTATTPSRKGSWHRMDGRIKKGIAAQVTIPLAILTDRPVSFFAPAFLSCPDHGQAAAGAAPPRSAPASSPALISSVQDLYDFICSGPLVDRIGYTKEKIAGSIDRWLRCGVQVARLFRLNELHLSEAEKARIYHFYIPVFLWCEDQVTEHRAKYKDGDEIPPLVIGVSAPQGSGKTTLVFALDYLFRVAGRNAATLSIDDFYLTAAEQGKLRERNPGNALLELRGNAGSHDLPFSVETLESLLKLTKEGLKMKLPRYDKSAFGGRGDRADPSTWPEVEGPLELEVVNKNLEAYYDAWDRFIGSWMVIKIKEPSCVYQWRLQAEIAMRADGKPGMSDEEVMDFVSRYLPAYHAYLPTLYKEGPNGSNPDHLLVVDIDEKRNPMWGR

SEQ ID NO: 29507 - protein, 210 aa, marine gamma proteobacterium HTCC2207
MTDLSKISSTAPLRIGVGGPVGSGKTALLEALCKTMRDTYNLAVVTNDIYTQEDAIILTRAEALAADRIIGVETGGCPHTAIREDASMNLAAVEEMSQRHAGLDLIFIESGGDNLSATFSPELADLTIYVIDVAAGEKIPRKGGPGITKADLLVINKIDLAPYVGANLEIMDSDTKRMRPTSPYVFTNLHKHTGLDVIIDFIVDRGMLAA

SEQ ID NO: 29508 - protein, 497 aa, Staphylococcus aureus subsp. aureus N315
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 29509 - protein, 470 aa, Vibrio parahaemolyticus RIMD 2210633
MIKFGTGGWRAFIGEEFTKDNVRLVAQAVANITNRESVADRGFVIGYDRRFLSDKAGRWFAEVLAANGIVVSFIDKFVPTPIVMFKAKEMGCAYSACITASHNPADYNGIKVFIEGGRDADEIITEKIETQISTLTAQDVKSVDFDQAVEDKLIEIINPMNEFVDSIIDFIDIEAIKKANLRVLIDPMFGVAKNALQTVLINGRCEVDVINDGKNPDFGGLMPSPSAATLYRLMHLVEQEGYDIGIGTDGDADRLGIIDEKGNFIHPNEVLILLYYYLLKYKGWKGSVVRNIATTHLLDKIAEDHGEKCFEVPVGFKHISSQMEADDSLIGGESSGGLTIRGHIKGKDGVFASSLLVEMISVTGKKLSELLDEIYGKYGYAYMAEGDCKFKPAQKAVLFNKIYVEKQLPEFEFDIEKVSYEDGAKVYFKNGGWIIARFSGTEPLLRIFAEMQDKDTAERVLQQFKDFLSL

SEQ ID NO: 29510 - protein, 236 aa, Oceanobacillus iheyensis HTE831
MIKDWLQESNYTVIFTGAGMSTESGLPDFRSANTGLWKQHDPSKIASIDTLNNNVETFIDFYRERVLKVKEYGPHQGHYILAEWEKQGLVHSIVTQNVDGFHQASGSKIVHELHGTLQKLHCQSCGKEYSSKEYVENEYHCDCGGVLRPSIILFGEMLPQEAFQTAFNDAEKADLFVVLGSSLTVSPANQIPLIAKENGAKLVIVNQDPTPYDQYADMTISDQKIGEFLRSISNEG

SEQ ID NO: 29511 - protein, 168 aa, Hordeum vulgare subsp. vulgare
LGVLLLEIVSGRSNTSSRLPYEDQILLEKFPEVTNGVLLLQTWMYYEQGDLAKIIDSSVGDDLDVEQACRFLKIGLLCTQDVTRHRPTMSTVVSMLTGEKDVESEKISKPATISDFMDLKIRSMRRENNIAFASSSTLLSTIMAHSSPLLSQETTQASITFTTISEHE

SEQ ID NO: 29512 - protein, 128 aa, Methylococcus capsulatus str. Bath
MSAWLDEIRWTADGLVPVVAQEAGTGQVLMVAWMNREALALTAAEGYAVYWSRSRGRLWRKGEESGHRQKVLEIRIDCDEDVVLLKVEQAGGIACHTGRHHCFYRVLQDGRWVTVEPVLKPPDSIYGA

SEQ ID NO: 29513 - protein, 105 aa, Methylococcus capsulatus str. Bath
MDVLHRLAEILEQRKTEAPDKSYAASLYAKGLDTILKKIGEEATETVIAAKDGEPGKIVYEMADLWFHCCVLLAQQGLGPDDVLRELGRRFGMSGLEEKASRKLG

SEQ ID NO: 29514 - protein, 437 aa, Oryza sativa (indica cultivar-group)
MDDDAGDASPPPAAAGVGATAAQSRDMAASPTSSRSVTETVNGSHRFVIQGYSLAKGMGVGKHIASETFSVGGYQWAVYFYPDGKNPEDNSAYVSVFIALASEGTDVRALFELTLLDQSGKGKHKVHSHFDRSLESGPYTLKFVHLNLTEVTDTILLKYGRGYKRFFRRTALETSDFLKDDCLKINCTVGVVVSTIDYSRPHSILVPDSDIGYHFGTLLDNHEGVDVVLSVGGERFHAHKLVLAARSTVFRSKFFDDEDGEKNEPGENDDVQEIVIDDMEPKVFKAMLHFIYRDTLVDDNELGGSSSEGSIFDTLAAKLLAAADKYDLARLRLLCESYLCKAISVATVASTLALADRHHAMELKAVCLKFAAENLSAVIRTEGFDYLKDNCPSLQSEILRTLAGCEEECSSGGKSQSVWGQLSDGGDTSGRRVRPRT

SEQ ID NO: 29515 - protein, 1102 aa, Cryptococcus neoformans var. neoformans B-3501A
MSGRPFKRESWRPTKRPPTFAAAAQQPPLSSANALPARTWGGTPVPTAPKRFERDPSSNVKEEAHLSRWDDKGSNDGKWDQRDWDQRDDRSRYGNSGNGKRRQSPSRQPDSTRDERFSSARRSYSPPVPAPSPANPSNYPATRRPLPPAQPPASHHHTRARRPSPDYGTSGPAAKKRKGGARKRDSPDYGVGSREDAASSYRRSPSPLSNRSRSRTRSRSRSPAPSHHSQSNSYSLPKTQTHTYTPSQSHRKRSPSPSMSDRQSSSGRWSKRDRYNNHQYGKYDKDDRNGKFDSRDNGWENEGNRNWRDRDTDRDGHRRDRGMGDRGGRRDKDWRQDKGYVYDRRDRERDRDRERDRDRDRDRGSGWQASRRDRDYPPIGPRGYTSSASQLRHDYQTAPSPPHSAHVQAPPPPSDFYDRRRDSPDSYGHQNHSHGQRQGRSPIQDREYPSRSNFVTNANANSILGTSTTRKWGESGRYLYEQSYQPPSTVSRATSVSRDYSPSPQHSYALPAATSDTVPLPVHPPAPLESSFQSLPDTAGPTAELQTRTSPVKISFGQPSGGAVKKGWKSISPKKKARVSLFDEDEEEIQGAKGEKEDKKEVMPEKEQDIMGEALPHPDTLIHRLTLASTRYTTLLTSLSAPLRAAFDSFSTLPSSPPPPPIDLFLDEYLGRKARDDEVKRVEEVWDAKKEWEREEEMGRRYLEEVGKGGRVEGVNVAPAEPGGARVSPAAVVVAPKPEPELAPIPVSGTELQAPAPGAEPHPQTQKVPIPLPPAATLVYQKLAAVGEGTYGKVYKALSLITHQPVALKRIRMENEKDGFPVTAMREIKLLQMLQHENVLRLVEMVVERGGVYMVLEYMEFDLTGLLAHPEIKFSPANIKSLSHQMLSGLSYLHRQSILHRDMKGSNILVNSRGELKLADFGLARVYAKKRREDYTNRVITLWYRSPELLMGETIYGPEVDMWSAGCIILELYTTKPIFQGSDELNQLEVIYALLGTPTEAEWPSVKELPWYELVKPKEEIGSKFRTSFAKWLSPAALDLVEGLLFYDPSQRLLADSALQTDYFLMEEPKMEKPTQLEGMGEHHEMSAKAERKRRRMEEGGE

SEQ ID NO: 29516 - protein, 311 aa, Oryza sativa (japonica cultivar-group)
MAASSAAFAACLLACALLFQMCVASRKLTALVQDQPITMTYHKGALLSGRIAVNLIWYGNFSAPQRAVITDFVSSLSTPPSPQPQPEPSVASWFKTAQKYYANSKARFPALSLGQHVLDQSYSLGKRLGEKDLVRLAARGSPSRAINVVLTADDVAVDGFCMSRCGTHGASPRSRAGRFAYVWVGNPATQCPGQCAWPYHQPVYGPQAAPLTPPNGDVGVDGMVISLASMIVGTVTNPFGNGFFQGDADAPLEAATACAGVYGKGAYPGYAGSLLVDPASGASYNANGAHGRKYLVPALVDPDTSACSTVG

SEQ ID NO: 29517 - protein, 544 aa, Fusobacterium nucleatum subsp. vincentii ATCC 49256
MTDIQIAQAAKKENIVEIAKKLGLTEDDIEQYGKYKAKVNLDVLQKNKRPNGKLILVTAITPTPAGEGKSTVTIGLTQALNKIGKLSAAAIREPSLGPVFGMKGGAAGGGYAQVVPMEDINLHFTGDMHAIGVAHNLISACIDNHINSGNALKIDVTKITWKRVVDMNDRALRNIVIGLGGKANGYPRQDSFQITVGSEIMAILCLSNSITELKEKIKNIVFATSLEGKLLKVGDLHIEGAVTALLKDAIKPNLVQTLENTPVFIHGGPFANIAHGCNSILATKMALKLTDYAVTEAGFAADLGAEKFIDIKCRLGGIKPDCAVIVATVRALEHHGKGDLKAGLENLDKHIDNIKNKYKLPLVVAINKFITDTDEQIDMIEKFCNERGAEVSLCEVWEKGGEGGIDLAEKVLKAIDNNKIEFDYFYDENLTIKEKIEKICKEIYGADGVIFAPATKKVFDVIEAEGLNKLPVCMSKTQKSISDNPALLGKPTGFKVTINDLRLAVGAGFVIAMAGDIIDMPGLPKKPSAEVIDIDENGIISGLF

SEQ ID NO: 29518 - protein, 490 aa, Bordetella parapertussis 12822
MTISPLQLLNDPSLLRTDALVDGRWIAASQRFAVHDPATGRKLADVANLDAAHAREAIAAAQAAWPAWRARTVKERSAILRKWFDLLLANQDDLARLLTAEQGKPFGEARGEIAYAASFVEWFAEEAKRINGETLPAFDNNRRLLVLREPIGVCAAITPWNFPLAMITRKVAPALAAGCPVIVKPAEHTPLTALAAAQLAVRAGVPAGVLGVLPADGANSIAIGKELCANDAVRHLSFTGSTEVGRILMAQSAATVKKLSLELGGNAPFIVFDDADLDSAVEGAMQSKYRNAGQTCVCANRIYVQDGVYDAFVEKLADAVRALKVGPGFDEGVTQGPLIEPEAVDKIERHIEDAVSKGGRVVAGGRRLGGLFFEPTVLVDATSQMLCAREETFGPLAPVFRFHADEDAIAAANATEFGLASYLYSRDVGRIFRAAEALESGMVGVNVGILATEHVPFGGVKQSGLGREGGRHGIDDYVEIKYMCVGDILK

SEQ ID NO: 29519 - protein, 309 aa, Glycine max
MSPSLFQIKIMNRKQEAQNTYSQHIKFRPAASLFSPSSLYCFLTQAYTCLFCYVKMIALKSIHPFFTPTNIKYGINRSRCLNTKGSVLCLCKSNESESQAPQPGDIRKQELLAQIAMLQTQKVCLTDYFDERSEYLTQFGEEAKAEFDKIGKDALQGLDEASAIITANIESQMVEFEESAELNRQEIQEHEKELGEFEVQMEDGRNEGLFFKNLRRRTPVDKSKAKEEAEKIKDVAREKAGSRTRKGFYLLFIGLLTFAIVDSIASSSTDWKKIAVLGATLVALVSQFIYEQNVIRNWRKKKDRHRRGK

SEQ ID NO: 29520 - protein, 440 aa, Glycine max
  misc_feature (183)..(183): Xaa can be any naturally occurring amino acid
  unsure (1)..(440): unsure at all Xaa locations
MAIAPFGNTSATQWGIHPQIFAGSTGLGKIASSRNNVTSRIRFMVAPCSSFFSCHSLHALFDKGSSQTLQHRRGSRLIVRADADYYSVLGVSRNSSKSEIKNAYRKLARSYHPDVNKEPDAEQKFKELSNAYEVLSDDEKRSIYDTYGEAGLKGSGMGMGDFSNPFDLFETLFEGMGGMGGSXGSWNGAVEGEDEYYSLVLNFKEAIFGVEKEIEIRRLESCGTCNGLGAKPGTKSSKCSTCGGQGRVVTSTRTPLGIFQQSMTCSSCSGTGETSTPCSTCSGEGRVRKTKRISLKVPAGVDSGSRLRVRNEGNAGRRGGSPGDLFVILEVIPDPVLKRDDTNILYTCKVSYIDAILGTTIKVPTVDGMVDLKIPAGTQPSSTLVMAKKGVPLLNKKNMRGDQLVRVQVEIPKKLSKEERKLIEELADLSKGKTAATSRR

SEQ ID NO: 29521 - protein, 472 aa, Pseudomonas putida KT2440
MPVGNHSAHGQATEGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAIYMGIWFPDVPRWIWALAALGSMGAVNLVAVKAFGEFEFWFALIKIVTIIAMVLGGIGIIAFGFGNDGVAVGISNLWSNGGFMPNGVTGVLMSLQMVMFAYLGVEMIGLTAGEARNPQKTIPQAIGSVFWRILLFYVGALFVILSIYPWNEIGSQGSPFVMTFERLGIKTAAGIINFVVITAALSSCNGGIFSTGRMLYSLAQNGQAPAAFARTSKNGVPRNALLLSIGALLLGVLANYLVPEKVFVWVTSIATFGAIWTWVMILLAQLKFRAGLTTAERKALKYRMWLWPLSSYLALAFLVLVVGLMAYFEDTRVALYIGPAFLVLLTVLYYTFRLAPKDAQGVTSTAS

SEQ ID NO: 29522 - protein, 132 aa, Brassica napus
  misc_feature (119)..(119): Xaa can be any naturally occurring amino acid
  misc_feature (121)..(121): Xaa can be any naturally occurring amino acid
  misc_feature (124)..(124): Xaa can be any naturally occurring amino acid
  misc_feature (127)..(127): Xaa can be any naturally occurring amino acid
  unsure (1)..(132): unsure at all Xaa locations
MAANFWESSQYKQLLDQEEVDVVQPLDKERGISVEDFKLIKFHMSNHIMKLAQHIKVRQRVVATAITYMRRVYTKKSMVEFEPRLVAIACLYLASKAEESIVQARNLVFYSKRLYPDEXKXELXDIXGMEMR

SEQ ID NO: 29523 - protein, 145 aa, Aspergillus nidulans FGSC A4
MTEEQVSEYKEAFSLFDKDGDGQITTKELGTVMRSLGQNPSESELQDMINEVDADNNGTIDFPEFLTMMARKMKDTDSEEEIREAFKVFDRDNNGFISAAELRHVMTSIGEKLTDDEVDEMIREADQDGDGRIDYNEFVQLMMQK

SEQ ID NO: 29524 - protein, 561 aa, Triticum aestivum
MAAAAVASNGGAAPVPGRLASVYSEVQTSRIAHALPLPSVLRSHFTLADGPASTAAGSPDEIAKLFPCLYGQPSAAVVPSAEPVETKPLKIGVVLSGGQAPGGHNVICGIFDYLQERAKGSTMYGFKGGPAGVMKGKYVELTTDFVYPYRNQGGFDMICSGRDKIETPEQFQQAEDTVNRLDLDGLVVIGGDDSNTNACLLGEYFRGRNLKTRVIGCPKTIDGDLKCKEEVPTSFGFDTACKIYSEMIGNVMTDARSTGKYYHFVRLMGRAASHITLECALQTHPNVALIGEEVAEKKETLKNVTDYITDVVCKRAELGYNYGVVLIPEGLIDFIPEIQKLIAELNEILAHDVVDEAGAWKSKLEPASRELFDFLPKTIQEQLLLERDPHGNVQVAKIETEKMLIAMVETELEKRRAAGKYSAHFRGQSHFFGYEGRCGLPTNFDSSYCYALGYGAGALLQFGKTGLISSVGNLAAPVEEWTVGGTALTALMDVERRHGKNKPVIKKAMVELDAAPFKKFASLRDEWASKNRYISPGPIQFSGPGSDASNHTLMLELGAEI

SEQ ID NO: 29525 - protein, 310 aa, Clostridium perfringens ATCC 13124
MKKVICPGEALIDFISMDVSKSLKETSGFLKKAGGAPANVAAAISKLGAEAYFCGTVGNDAFGNFLEDTLKRNNINTELMFKLNNRNTTLAFVSLMEDGERDFSFARDADACLELDMIKNKLKKFDLYHFGSATAFLDGSLKKTYYQLKEYALKNNKLISFDANYRDNLFKDNKEEFIKCCKDFIKDSDVVKLSDEEALLISNKTSIKEAADYIKSLGCKNLIITLGKKGAMLTTGDYQLIVPTKELEMKDATGAGDAFMGAVLAQMLNNTNRNMIEIVRLANLVGGITTTKLGALESIPTWDEVLLLSK

SEQ ID NO: 29526 - protein, 341 aa, Oryza sativa (indica cultivar-group)
MAAKSLREIRRAAAAGIGSRRCFSGDAAAAAAAAAGVAEGKVGGGAGKEVNLFTAINQALHIALDTDPRSYVFGEDVGFGGVFRCTTGLADRFGRNRVFNTPLCEQGIAGFAVGLAAMGNRAIAEIQFADYIFPAFDQACLRLDQCFVPTYLYIQLLVQIVNEAAKFRYRSGNEFNCGGLTIRSPYGAVGHGGHYHSQSPEAFFCHVPGLKCSPLLDLISGPTSLFGLGSSNGLHRNLWLFSCKLMKDKFQHLRTLIPWDKETVEASVSKTGKLLVSHEAPITGGFGAEIAASITERCFQRLEAPVARVCGLDTPFPLVYETFYMPTKNKVLDAIKATVNY

SEQ ID NO: 29527 - protein, 333 aa, Mycobacterium leprae
MSRAKLVYRPPLELIETNQFKGEKSLVDSAAQSNQAQSVFGQTGTARVKRGMAEMLKGGVIMDVVIPEQARIAEGSGAVAVMALERVPSDIRAQGGVSRMSDPDMIESIIAAVTIPVMAKARIGHFVEAQILQSLGVDYIDESEVLTPADYTHHIDKWKFTVPFVCGATNLGEALRRINEGAAMIRSKGEAGTGDVSNATTHMRAIAGDIRRLTSLSEDELYVAAKELHAPYELVIEVARTNKLPVTLFTAGGIATPADAAMMMQLGAEGIFVGSGIFKSSDPAQRAAAIVKATTFYDDPDVLAKVSRGLGEAMAGIDVEQIAQPDRLAQRGW

SEQ ID NO: 29528 - protein, 182 aa, Pseudomonas syringae pv. tomato str. DC3000; identical to SEQ ID NO: 1096

SEQ ID NO: 29529 - protein, 465 aa, Salmonella typhimurium LT2
MTDSIMQNYNQLREQVINGDRRFQHKDGHLCFEGVDLDALARQYPTPFYVFSEPEIIRNIHEIQQAFAAHKNTKTFFASKTCSVMGVLKAIRDAGICAEANSQYEVRKCLEIGFRGDQIVFNGVVKKPADLEYAIANDLYLINVDSLYELEHIDAISRKLKKVANVCVRVEPNVPSATHAELVTAFHAKSGLDLEQAEETCRRILAMPYVHLRGLHMHVGDQVPESEPFAKATKVLVDESRRLEEVLGIKFDLINVGGGIPVPYKYDDENGDPLKDNMYAGITAQDFADAVIREVHKWRTDVEICIEPGRKVTGSAAVLLTEVSCEKRKTNYDLNGNVECHVEWKFVDAGYSVLSDSQHFDWFFYVYNASRMTAAHDAWIKLAGPLCDGGDYFHMGVKGEEFLLPKETHVGDIVAFLDAGAYTIESQTVYNNRPRTGVVMIDKNGDTRLIRREDSYEDMVKYDIY

SEQ ID NO: 29530 - protein, 582 aa, Zea mays
ALTTNSTTPDHGGHWCSNSSRVQVQEMSSRGPDPAPPGDEQETAEELLERVRGMVPAAAAAARAAGGFPGRWKAIAAKLDALPACLSDLSSHPCFARNSLCRELLQSVAATLADAAELAARCREPPADGKLRAQSAVDALSGRLDLGLRDCALLVKTGVLSDAAGPSPPPEEAPDVRELLARLQIGHAEARGRAVDALLDALRRDERGVLAALGRASVAALVQLLTASAPAVREKAATAVCQVAGSGAASEALLVSEGVLPPLVRLAESGSAVGREKAAATLHRLSASPDVARAVVGHGGAGPLVEICRTGDSVSQPAAAGALRNLSAVPEVRQALADEGVVRVMVGLLDRGAVVAGATKEHAAECLQNLTSGSDGLRRAVVSEGGLRSLLLYLDGPVPKEPAVGALRNLVGAVSPDSLVALGVLPRLVHVLKIGSVGAQQAAAAAVCRISSSAEMKRAVGEHGCVAPLVRMLEAKSNGAREVAAQALAALASCPANAREMKKDDKCVPSLVQLLDPSPANTAKKYAIACLLTLSGTKRCRKVMVSHGAIGYLKKLSDMDVAGAKKLHERLERGSLRSMFSR

SEQ ID NO: 29531 - protein, 400 aa, Streptomyces clavuligerus
MSNQEFAQRWQGVMIDSYGTPGLSFVRGEGSTLWDADGTAYTDFVSGLAVNALGHAHPAVVGAVSRQIASLGHISNFYSAEPTITLAERLIELFGRPGRVFFCNSGAEANETAFKIGRLTGRSRIVAAQSGFHGRTMGSLALTGQPAKREPFLPLPGDVTHVPYGDAEALRAAVTEDTAMVILEPIQGESGVVVPPKGYLRAAREITEATGTLLVLDEVQTGIGRTGHWFAAQAEGVEADVVTLAKGLGGGLPLGAAVAFGRAAELMTPGHHASTFGGNPVSCARTRVLDTIAADGLLDRVKQLGSAPDEWSVRDAAAIRWSPMSGAGLMLGIVLNEPLAPQVQLAAQKAGFLVNVPAPDVVRLIPPLVIEETEVDAFLQALPGLLDAVHERDREGQTGE

SEQ ID NO: 29532 - protein, 613 aa, Oryza sativa (japonica cultivar-group)
MILCRCPFLASARSHTCSLSTVAVAAAVRRGDLTGAEEAFASTPRKTTATYNCLLAGYARALGRLADARHLFDRIPTPDAVSYNTLLSCHFASGDADGARRLFASMPVRDVVSWNTMVSGLSKSGAVEEAKAVFLAMPVRNSVSWNAMVSGFACSRDMSAAEEWFRNAPEKGDAVLWTAMVSGYMDIGNVVKAIEYFEAMPVRNLVSWNAVVAGYVKNSHADDALRLFRTMVREANVQPNASTLSSVLLGCSNLSALGFGKQIHQWCMKLPLSRNLTVGTSLVSMYCKCGDLSSACKLFGEMHTRDVVAWNAMISGYAQHGDGKEAINLFERMKDEGVEPNWITFVAVLTACIHTGLCDFGIRCFEGMQELYGIEPRVDHYSCMVDLLCRAGKLERAVDLIRSMPFEPHPSAYGTLLAACRVYKNLEFAELAAGKLIEKDPQSAGAYVQLANIYAGANQWDDVSRVRRWMKDNAVVKTPGYSWIEIKGVMHEFRSNDRLHPQLYLIHEKLGQLAERMKAMGYVPDLDFVLHDVDETLKVQMLMRHSEKLAISFGLISTAPGMTLRIFKNLRVCGDCHNAAKVISKIEDREIILRDTTRFHHFRGGHCSCGDYW

SEQ ID NO: 29533 - protein, 114 aa, Desulfovibrio desulfuricans G20
MNIYVGNLSYQMSEDDLRGAFEEFGAVDKVRIITDHDTGRSKGFGFVEMAEDSEANAAIEALNGREMGGRSITVNEARPRPERSGGGGGGFRRSGGGGGYGNRGGQGGGYGRRY

SEQ ID NO: 29534 - protein, 452 aa, Candida glabrata CBS 138
MSSDEEDFNDIYDTKDESKVDAKDDVKAEEKVPEAATSALDQLAALQASSANPDSNKDDAAKMPWETLQNTLNQLQTVTKEESPDKSKEEKSSNASVDSGTNVQSGNTGDRTVKADLSKDSCKMFIGGLNWETTEDGLRDYFSKYGKVEELKIMKDPATGRSRGFGFLTFESASSVDEVVKTQHILDGKVIDPKRAIPREEQDKTGKIFVGGIGPDVRPKEFEEFFAQWGTIIDAQLMLDKDTGRSRGFGFITYDTPDAVDKVCQNKFIDFKGRKIEIKRAAPRHLQKTGGARQPAQQSSNSQYGMGTGSNSSGQYPGYGFQDPMMFSNPMMSGYNPMFANNNPQMQEYFQKMQDYYKQVQQQGGMDYNQMYQQQMQQMAMMMPGFNPSTMGQQSQGSPDANSTKSQSNEASTPTPDDQDRGNKDSSRRSGGPGGFRGRPNDSRRGYHPYNR

SEQ ID NO: 29535 - protein, 839 aa, Desulfovibrio desulfuricans G20
MVGLVIVSHSAVLAEGVRELALQMTQGRVRIALAGGVDDAEHPIGTDPTRVMAALEEVQDGDGVLVLMDLGSALMSAETALDLLPPEVTANVRLSAAPLIEGCIAAAVQAAAGASLDDVQAEAESALAAKSAQLGSAVPDMAASSAGAAGAVPDAAAEHVRTLAVTVPNRLGLHARPASRIVGALAGLDADVRLAHGGHVVNARSLNQIATLAVRLGDSIEFRAAGADAQQALDALQALHAANFGDPREPEEGQADSHGAAPVRPAGAVAASAGYAAGPAVRFRAALPEVAEIQVDDQAAEKRVLQDALKQAADEIALVEKQTAGNVGGAESEIFGMHRMMLQDPELRDAALHELEERRCNAAAAWRRVIVSTAERYRGLDDDFMRARAADVLDVGARVLRIITGEAPQGPDIAEPSVLLAADLGPSDMARLDVTKVLGIVTEQGGATSHAAILARSMGIPAVAGAAAQIAGVTDGTPVGLDGNTGEVWAPADEHTVQRLRGLRRQWEESLRSEREKAAAPAVTRDGRAVRVHANIGSPADAHAAVRNGAEGVGLFRTEFLFLDRPSAPTEDEQTAAYTEAAQALDGRPVIIRTLDIGGDKPVPYLQQGQAAEANPFLGVRGIRFCLVHEDLFVTQLRALLRAAADHPVQIMFPMVAHPGELRAARTLLEKARAQLLAEGRPCGHDVPVGIMIEVPAAVALADQLAAEADFFSIGTNDLAQYVMAADRGNSAVAALSDALHPAVLRQIQQTVEAGHAAGIHVGMCGELAGAPLAVPLLAAMNLDSLSMSGPAVPRAKEIIRSIDAAALQPLVEQVLELPDAAAVRNLLQQAAGESADRA

SEQ ID NO: 29536 - protein, 222 aa, Vibrio parahaemolyticus RIMD 2210633
MPEIKQLFENNSKWSEEIKSDRPEYFAKLAEGQKPDFLWIGCSDSRVPAERLTGLYSGELFVHRNVANQVIHTDLNCLSVVQYAVDVLKVKHIIVCGHYGCGGVNAAIDNPQLGLINNWLLHIRDLYFKHRSYLDQMPVEDRADKLGEINVAEQVYNLGNSTIMQNAWERGQDVEIHGVVYGIEDGRLEYLGIRSNSKETVEASYQKALSTILNPDNKLLCR

SEQ ID NO: 29537 - protein, 387 aa, Triticum aestivum
  misc_feature (294)..(294): Xaa can be any naturally occurring amino acid
  misc_feature (306)..(306): Xaa can be any naturally occurring amino acid
  misc_feature (321)..(321): Xaa can be any naturally occurring amino acid
  misc_feature (345)..(345): Xaa can be any naturally occurring amino acid
  misc_feature (352)..(352): Xaa can be any naturally occurring amino acid
  misc_feature (357)..(357): Xaa can be any naturally occurring amino acid
  misc_feature (359)..(359): Xaa can be any naturally occurring amino acid
  misc_feature (362)..(363): Xaa can be any naturally occurring amino acid
  unsure (1)..(387): unsure at all Xaa locations
GPGFPGYRRPTRPGAARLGAATTTANPFYTPHEIHRQADAAGAMLIVTEACAVDKVLEYAAGKGLPVVTVDGARDGCVDFAELIAGEELPRDEEAGIHPDDVVALPYSSGTTGLPKGVMLTHRSLITSVAQQVDGENPNLYFSKEDVLLCLLPLFHIYSLNSVLLAGLRAGSAMVIMRKFDIGALVELVRAHGITIAPFVPPIVVEIAKSPQVTAGDLASIRMVMSGAAPMGKDLQDAFMAKIPNAVLGQGYGMTEAGPVLAMCLAFAKEPFKVKSGSCGTVVRNAGLKIVDPXTGASLGRNQPGXEICIRAQQIMKGYLXNDPEVHQRPTSTRTGWLHPGEIGXLVDDNEXDFHRXTXSKXXIKYKGLPSGRPPGGGPGTQISPMS

SEQ ID NO: 29538 - protein, 267 aa, Arabidopsis thaliana [sequence omitted]

SEQ ID NO: 29539 - protein, 369 aa, Arabidopsis thaliana
MSYSGAGLGKPGSGKRRIRDLLTQSDNRVCADCGAPDPKWALIECYDLVSLLVHFLVCFVFRKPIKLLVAYYRSANIGVFICLKCCGVHRSLGSHISKVLSVTLDEWSDEEVDSMIEIGGNASANSIYEAFIPEGSSKPGPDASHDQRMRFIRSKYEHQEFLKPSLRITSVRGSSTKTPAFLSSSLSKKIVDSFRTNSSSQQPQLEGMVEFIGLLKVTIKKGTNMAIRDMMSSDPYVVLTLGQQKAQSTVVKSNLNPVWNEELMLSVPHNYGSVKLQVFDYDTFSADDIMGEAEIDIQPLITSAMAFGDPEMFGDMQIGKWLKSHDNALIEDSIINIADGKVKQEVQIKLQNVESGELELEMEWLPLEQ

SEQ ID NO: 29540 - protein, 376 aa, Bdellovibrio bacteriovorus HD100
MKEPTLGTFEIISKHGDHEQVVFCNDPHVGLKAIIAIHNTSLGPALGGTRMWNYKNEDEALVDVLRLSKGMTYKAAASGLNLGGGKAVIIGDPKTQKSEGLFRAFGQFVNSLNGKYITAEDVGTSVQDMEHIYMETPWVTGIPKDFGGSGDPSPYTAHGVLMGIKASAKEKFGTDSLKGIHIAVQGLGNVGSNLVKYLVEEGAVITVADIDMNRTKSVADKFGAKAVSSDDILFTECDILAPCALGAIVNDQTITKLKTKVIAGGANNVLAEARHGDQLKELGILYAPDYVINAGGLMNVFVELEGYSPERAFEKTKRVYDNILKVYEIAKRDGIGTHTAADRLAEERINTIGRLKQRHPGKSSRAFTTLREVHNR

SEQ ID NO: 29541 - protein, 546 aa, Candida glabrata CBS 138
MSTSGAENGVGASRARKSTCTEANDTDKVGVKTISEVTDLQTIESSPSTCEEPMSNKDVIKAAFKKYIKFIGPGLLVSVAYIDPGNYSTATSAGAANQFSLLCVVLLSNFIAIFLQCLCIKLGSVTGMDLSRACRKHLPRWANWTVYFFAECAIIATDVAEVIGTAIALNILIKVPLPAGVCITLVDVLAIMATYRPGASSMKVVRMFELFVALLVVGVCICFAVELAYIPKSTSAAKVFRGFVPSRQMLEHNGVYTAISILGATVMPHSLFLGSALVQPRLLEYDVNHGNYSMLKDDEDEKNKETAVDERYQNYRPTRSAIKYCMKFSMIELGLTLFTLALFVNCAILIVAGSTLYGYPDAADADLYTIHDLLSKTLAPIAGTIFMLALLLSGQSAGIVCTMAGQIVCEGHIHWKLKPWQRRLVTRAISLIPCLAISISIGKEALSKALNASQVVLSIVLPFLVAPLIYFTCNKKIMETEITVKDAEEDPSDNDDMQLENGQTRKTVSMANNWVVSIIAFVVWVFLSALNIYAIVQLGITHGEIS

SEQ ID NO: 29542 - protein, 130 aa, Agrobacterium tumefaciens str. C58
MNCEKLIRYAVADAQAGGQRRPFAKAVRAGDFVYVSGQVPTFDGEIIVGNIVAQTERVIANIIEVLALAECTLADVVKVNAWLDDARDFSSFNAVFQKHFIDHPPARSTVQSPMMVDVKVEMDVIAYKPI

SEQ ID NO: 29543 - protein, 399 aa, Oryza sativa (japonica cultivar-group)
MALSISTPPTSSSLLPASLQVGRWSSSAAMSARPVAFSLRRPVLAARVAAGGNAPSSSVDEVVTELDAVASFSEIVPDTVVFDDFEKFAPTAATVSSSLLLGIAGLPDTKFKSAIDTALADGECNTMEKPEDRMSCFLTKALANVGAEMAHLVPGRVSTEIDARLAYDTQGIIQRVHELLKLYSDHDVLSERLLFKIPATWQGIEASRLLESEGIQTHLTFVYSFAQAAAAAQAGASVVQIFVGRVRDWARTHSGDPEIDEALKKGEDAGLALAKKVYAYIHKNGYKTKLMAAAIRNKQDVFSLLGIDYIIAPLKILQSLEESVTDTDVKYGYVPRLTPALGKTYNFTEEELVKWDQLSLAAAMGPAAEELLASGLEGYVNQARRVEELFGKIWPPPNV

SEQ ID NO: 29544 - protein, 630 aa, Oryza sativa (japonica cultivar-group)
MPPGARARRIAALDLIFLVFLRLASAYQRPSDAHINCIDSFCLGGYTCSETTATTSCTAYLTFRSDPPLSVAYLLNATPSAVAAANSVPLAVSPVDGTQLLLVPVPCSCNRATGYYQHNTTYAIQELDTFFLIANNTFQGLTTYQSIIANNPASEAMSPVINGPLAVPLRCACPSATTGRINNLLTYVVQEGDNVTSIARRFNSTHGDVLAANTLLVPLVHPPHSRVVLANTTITSTTPPESQKFYVSSPCSNGLLAGLGIGVGCGVSAWAAVLAVFLLWRRRRRRPVGDSSGMARETPLVAAVRGAVETLAAYSYADIETATAGFAEERRVAAGSSVYRAVINGEAFAVKRVAAGGDDVRGEVDVLGRVNHSGLVRLRGLCANGDDTYLVLEFAENGALSEWLHPGSAAACLRRVLGWKQRVLVALDVAGGLNYLHHFTNPPYVHKNLNSGNVLLDANLRAKVSSLGFARAVAVAVAAGDDSIALMTHHVVGTHGYLAPEYLEHGLISPKLDVFSFGVIQLELLSGKTAAFVTDDDGQNMLLWQAADGLVDGDGAWFKLRAFMDPQLQGHYPIGVASAVAALAVRCVAREPRARPSMEEVFVTLSAVYNLTVDWDPQNYSASASMVLGR

SEQ ID NO: 29545 - protein, 475 aa, Vibrio parahaemolyticus RIMD 2210633
MSKEIKAQVVVLGSGPAGYSAAFRCADLGLETVLVERYSTLGGVCLNVGCIPSKALLHVSKVIEEAKAMADHGVVFGEPQTDINKIRIWKEKVVNQLTGGLSGMAKMRNVTVVNGYGKFTGPNSILVEGEGESTVVNFDNAIVAAGSRPIKLPFIPHEDPRIWDSTDALELKEVPEKLLIMGGGIIGLEMGTVYHSLGSKVEVVEMFDQVIPAADKDIVKVYTKRIKDKFKLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGIKYEVATFPWAASGRAIASDCSDGMTKLIFDKETHRVIGGAIVGTNGGELLGEIGLAIEMGCDAEDIALTIHAHPTLHESVGLAAEVFEGSITDLPNKKAVKKK

SEQ ID NO: 29546 - protein, 516 aa, Triticum aestivum
  misc_feature (143)..(143): Xaa can be any naturally occurring amino acid
  misc_feature (276)..(276): Xaa can be any naturally occurring amino acid
  misc_feature (298)..(298): Xaa can be any naturally occurring amino acid
  unsure (1)..(516): unsure at all Xaa locations
MATAVHQLSFSAPSAGARRRQSRASASASTTDRHEVLSPNRRLPLRKVPGEHGPPLLGALKDRLEYFYGPGGRDGFFAARVRAHRSTVVRLNMPPGPFVAKDPRVVALLDAASFPVLFDTSLVDKTDLFTGTFMPSTDLTGGXYRVLSYVDPAEPNHAPLKSLLFHLLTHRRQHVIPTFREVYGGLFGRMENDLARVGKADFGNYNDDAAFGFLCQALLGRDPVDSPLRDEGPKLVAKWLLFQISPLLSLGLAGLPTLVEDGLLHRFRLRPALIKXKDYGRLADFFRDAGKAVIDEGXERLGIAREEAVHNILFAMCFNSFGGIKILFPSLVKWLGRAGGRVHGRLATEVRAAVRANGGEVTMRALAEMPLVKSAVYEALRIEPPVAMQYGRAKRDMVVESHDYGYEVREGELLFGYQPMATKDPRVFPRAEDYVPDRFLGEDGERLLRYVVWSNGPESATPTLQDKQCAGKDFVVLIARLLVAELFLRYDSFDVQVGSSPLGSSVTITSLKKATF

SEQ ID NO: 29547 - protein, 118 aa, Triticum aestivum
MGCAGSTPKGAAAAGGEATKKVRKPKPWKHPQPITIAQLRQMRDEFWDTAPHYGGRKEIWDALRAASEADVALAQAIVESAGVIVSNADLTLCYDERGAKYELPKYVLSEPTNLVQDS

SEQ ID NO: 29548 - protein, 541 aa, Triticum aestivum
  misc_feature (278)..(278): Xaa can be any naturally occurring amino acid
  misc_feature (295)..(295): Xaa can be any naturally occurring amino acid
  misc_feature (308)..(308): Xaa can be any naturally occurring amino acid
  unsure (1)..(541): unsure at all Xaa locations
MGSLPEQQQVVFRSTLPDIAIPDHLPLHDYVFERLAERRDRACLIDGATGETLTVGDVHRLSRRVAAGLYSLGVRHGSTVMLLLPNCVEFALAFLAASRLGAATTTANPLHTPPEIAKQAAASRATLVVTEPAFVAKVRGLAGVTVVATGDGAEGCASFADLAAADDSALPEAPIDVANDVVALPYSSGTTGLPKGVMLSHRGLVTSVAQLVDGDNPNLHLREDDVVLCVLPMFHVYSLHSILLCGLRAGAALVVMKRFDTVKMMELVERHGITIAPXVPPIVVEMAKGDALDRXDLSSVRMVISGAXAPMGKELQDIIHAKLPNAVLGQGYGMTEAGPVLSMCMAFAKEPSPVKSGACGTVVRNAELKIVDPETGLCLGRNQPGEICIRGRQIMKGYLDNPEATAETVDKDGWLHTGDVGFVDADDEIFIVDRLKELIKYKGFQVAPAELEAMLIAHPGIADAAVVPMKDDASGEVPVAFVVPSPDGADMTEDEIKQYVAKQVVFYKRLQKVFFVSSIPKAPSGKILRKDLRAKLAAGSC

SEQ ID NO: 29549 - protein, 887 aa, Vibrio parahaemolyticus RIMD 2210633
MSDMKHDVDALETQEWLQALESVVREEGVERAQYLLEQVLDKARLDGVDMPTGITTNYINTIPADQEPAYPGDTTLERRIRSIIRWNAIMIVLRASKKDLELGGHMASFQSSAAFYETCFNHFFRAPNEKDGGDLVYYQGHISPGIYARAFVEGRLTEEQLDNFRQEVDGKGIPSYPHPKLMPEFWQFPTVSMGLGPISAIYQARFLKYLEGRGMKDTSEQRVYAFLGDGEMDEPESRGAISFAAREKLDNLCFLINCNLQRLDGPVMGNGKIIQELEGLFKGAGWNVVKVIWGNNWDSLLAKDTTGKLLQLMNETIDGDYQTFKAKDGAYVREHFFGKYPETAALVADMTDDEIFALKRGGHESSKLYAAYKNAAETKGRPTVILAKTVKGYGMGEAAEGKNIAHQVKKMDMTHVLHLRDRLGLQDILTDEAVKELPYLKLEEGSKEYEYLHARRKALHGYTPQRLPNFTQELIVPELEEFKPLLEEQKRDISSTMAFVRALNVLLKNKNIGKNIVPIIADEARTFGMEGLFRQIGIYNPHGQNYTPQDRDIVSYYKEATSGQVLQEGINELGAMSSWVAAATSYSTNDLPMIPFYIYYSMFGFQRVGDMAWMAGDQQARGFLLGATAGRTTLNGEGLQHEDGHSHIMAGTVPNCISYDPTFAYEVAVIMQDGIRRMYGPDQENVFYYLTLMNENYAMPAMPEGAEEGIRKGIYKLETYTGDKAKVQLMSSGTIMNEVRKAAQILSEEYGVASDVYSVTSFNELTRDGQDAERFNMLHPEAEAKVPYIQTVMGTEPAIAATDYMKNYAEQVRAFIPAESFKVLGTDGFGRSDSRENLRRHFEVNAGYVVVAALTELAKRGEVEKSVIAEAIKKFDIDTEKTNPLYA

SEQ ID NO: 29550 - protein, 459 aa, Triticum aestivum
  misc_feature (151)..(151): Xaa can be any naturally occurring amino acid
  misc_feature (277)..(277): Xaa can be any naturally occurring amino acid
  misc_feature (295)..(295): Xaa can be any naturally occurring amino acid
  misc_feature (315)..(315): Xaa can be any naturally occurring amino acid
  misc_feature (337)..(337): Xaa can be any naturally occurring amino acid
  unsure (1)..(459): unsure at all Xaa locations
MEIFYYVVFGGLAAVVAGLELGKSGKDRVATPTAFNAFKNNYVLVYSLMMSGDWLQGPYVYYLYSQYGFDKGDIGRLFIAGFGSSMLFGTIVGSLADRQGRKRACITYCITYILSCITKHSPQYRVLLLGRILGGVATSLLFSAFESWLVXAEHNKRGYDPQWLSITFSKAIFLGNGLIAILAGLFANLLADNLGFGPVAPFDAAACFLAIGMAIIMSSWSENYGDQSEGKDLMSQFKVAAKAIASDEKIALLGAIQSLFEGSMYTFVFLWTPALSXPNDEDIPHGFIFATFMLXSILGSSIASRLLARKMKVEXYMQIVFAVSAFTLFLPVATSLXVPTSSVKGSGISFGGSLQLLGFCTFESCVGIFWPSIMKMRSQYIPEEARSTIMNFFRIPLNLFVCVVLYNVNAFPITVMFGMCSIFLFMAAILQRRLMVVADLHKLSTKSQEMTAEDEPLNP

SEQ ID NO: 29551 - protein, 377 aa, Pereskia zinniiflora
TDVPAAAAGAFKSYKLAAKAISRLQSLPSRNMSLLCDVLVKEVSELTGYDRVMVYRFHEDEHGEVISEYCRPDLGPYLGLHYPATDIPQASRFLFLKNRVRMIFDCLATPVKVIQYKKLTQPLSLGGSILRAPHGCHAQYMANMGSIASLVMAVTVNEDEDEVRSDPSTGKRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGTTPTEEQIKNITQWLVEYHGSTKGLSTDSLMEAGYPGASELGDAVCGMAAVRISSKDVLFWFRSHTAKEIKWGGAKHDPVDSDERRKMHPRSSFKAFLEVVKWRSQPWE

SEQ ID NO: 29552 - protein, 377 aa, Pereskia guamacho
TDVPVAAAGAFKSYKLAAKAISRLQSLPSRNMSLLCDVLVKEVSELTGYDRVMVYRFHEDEHGEVISEYRRPDLGPYLGLHYPATDIPQASRFLFLKNRVRMIYDCLAIPVKVIQYKKLTQPLSLGGSILRAPHGCHAQYMANMGSIASLVMAVTINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGVTPTEEQIKNITQWLLEYHGNTKGLSTDSLMEAGYPGASELGDAVCGTAAVRISSKDILFWFRSHTAKEIKWGGAKHDPVDSDDRRKMHPRSSFKAFLEVVKWRSQPWE

SEQ ID NO: 29553 - protein, 459 aa, Oryza sativa (japonica cultivar-group)
MGIGNGSPSDSRHVSHKEIRDETTPLLPIKEEEEGIHEFNGASFSGAVFNLSTTIVGAGIMALPASIKMLGIIPGILMIILVALLTEASIDMLVRCSHEGKITSYGWLMGETFGQWGRIALQASVVINNIGMMIVYMIIVGDVLSGTSTSGVHHRGIFEGWFGPHLWNSRPVVLLATTLFVFGPLVSFKRLDSLRYTSALSVALAVVFVVITAGIAIVRLIEGTVEIPKLFPELDGTNSIWELFTAVPVVVTAYICHYNVHSIDNELEDRTQTKPIVQTSLALCSSVYIATSFFAYLLFGEGTLADVLANFDSNLHIPFSSVFNDVVRVSYVVHIMLVFPIVFFALRLNLDGLLFPTARHISRDNRRFAIITGSLLAVIYLAAIFIPSIWDAFQFTGATAAVLIGFIFPAMIILRDPYGIATKRDKILALTMIVLAVLSNSVALYSDALNIIFHRKVEA

SEQ ID NO: 29554 - protein, 1168 aa, Oryza sativa
MALSGRLARQLQQELFHQARQTAPRIARRTFGSQAPRCIRQQRQTKATPNNIRSFTRSARQSANQTETAPNAKAYLESGAIAGAQNLVDVKKVLVIGSGGLSIGQAGEFDYSGSQALKALKEAGVQSVLINPNIATIQTAHVLADEVYYLPVTPEYVTYVIEKERPDGIFLSFGGQTALNLGVQMNKMGIFDRYNVKVLGTSIRTLEVSEDRDLFAQALKEIDIPIAESIAVNTVDEALAAAESVGYPIIVRAAYALGGLGSGFADNAEELRNLSARSLTLSPQILVEKSLKGWKEAEYEVVRDAADNCITVCNMENFDPLGVHTGDSIVVSPSQTFSDEEYHMLRTAAIKIIRHLGVVGECNVQYALAPDGLDYRVIEVNARLSRSSALASKATGYPLAYTAAKIGLGHTLPELPNAVTRTTTANFEPSLDYIVTKMPRWDLSKFQNVDRHIGSAMKSIGEVMAIGRTFEESFQKAIRMVDPKFAGLQGDHFEDIDDVLQNPTDRRWLAVGQAMLHEGYSVDKVHDLSKIDKWFLYKIQNIVDCTHELEKIGSLYGVKKELMLKAKKLGFSDKQISNAVNSTEDEVRARRKNFGIKPWVKRIDTLAAEFPADTNYLYTTYNASSHDVEFDDHGIIVLGSGVYRIGSSVEFDWCAVNATLSLKELGKKTVVINYNPETTSTDHDFPDRLYFEELSYERVMDIYELENSSGVVVSVGGQLPQNIALKLQETGKAKVLGTDPLDIDKAEDRHKFSSILDSIGVDQPAWKELTSYEDAKKFADSVEYPVLVRPSYVLSGAAMTVIWSEAELKDKLLAASSVSPDHPVVITKFIEGAREIDVDAVAHNGKLLLHAVSEHIENAGVHSGDASLVLPPANLPTATVERVKVIAEKVAEAWNITGPFNMQIINADNPEGGESLLKVIECNLRASRSFPFSSKVLGTNFIDVATRAITDTNVPEPVDLMKVDRDYLAVKVPQFAWTRLAGADPYLGVEMSSTGEMATFGKDLIEAYWVGVQSQMNFRLPQPGEGLLFGGDTTTGDLAKIVDFLNPLGYKLYAANPEVKRHLEESSKDSTVNVEVIEFPKQDKRALREVFEKYDIRGAFNLAKRRASSMVDEDYVMRRNAVDFGVPLFMEPKTAVLFAQCMNVKLPKVEGVPAEVRRWSDFIGGKPL

SEQ ID NO: 29555 - protein, 369 aa, Glycine max
MEFRVSVIWSLLLIVSFFSPQIKGEASGSVFFVDSSSNQFIRARSSNYEQPSLLLEEAGAVVSVLLGFAPPSTLPAASSSKLNDVLIPNPFKRPRAVFLLEVNGINGLGNIVQDNPMFSNSFWSTNSDKVDIQLPDENDVSVVSLDEQLEDWTDKEISDFSSSIGGSYAPDALEPLNGVLTIPLANGASVNLHMSKKAERKFIIGLMSLTRNVQRAIQMHDNLSQSAKSPAELLTGCFNGIKVLQEQYETGSIAQHGVELLYATLTKIFSSLQEAYKGQIVGIIYCHVATTQESGKKFDVIFTPHHPYARWLAETNAVNATLPEVVLVRRTLAWVTGIILLISTFMGICYLMNMPLTRDTLLYSNVKLD

SEQ ID NO: 29556 - protein, 356 aa, Triticum aestivum
MSLSMGACPHAWQQHHLHHRGRMWAASPAFRRQLFLLRSLAPTCADGGRASSSSLRPHLMYAAAGPVYEADAEAVVRRITPPLDRARHKGQAGKIAIIGGCREYTGAPYFAAISALKVGADLSHVFCTKDAATVIKSYSPELIVHPILEESYSVRDDERESVSSSILAEVIKWMERFDCIVVGPGLGRDSFLMDCVSNIMRHARQANIPTVVDGDGLFLITNNIGLVEDNSLAILTPNVYEYKRLVQKVLNCEVNEENASEQLTALCQKIGGVTIMRKGKADVISDGKKVTQVSTFGSPRRCGGQGDILSGSVAVLSSWARHFLLSSEQPKETTVNPMVLGVHSWLPIAKLLERQG

SEQ ID NO: 29557 - protein, 530 aa, Bordetella parapertussis 12822
MRPPRDGKQSSRRHNDIRRQTMDLSDLKKLGLDVAYPFKEQYENYIGGQWVPPVGAEYFDNLSPITGQPFCRVPRSGAADIELALDAAHRARAAWARTSPAERANILLRIADRIEGQLPMLAVAESIDNGKPLRETTAADLPLAIDHFRYFAGCIRAQEGAISEIDANTVAYHFHEPIGVVGQIIPWNFPLLMAAWKLAPALAAGCVVVLKPAEQTPASILVLAELIGDLLPPGVLNVVNGYGKEAGQALATSKRIAKIAFTGSTPVGKHILHAAADNLIPATVELGGKNPNIFFDDVMDHDDEFLDKALEGLAMFALNQGEVCTCPSRILIQESIYERFIEKAIARVQSIKTGHPLDAGTMVGAQVSQVQMDKILSYIDIGRQEGAQCLTGGARNDMLPGGLDQGFYVQPTMLLGKNSMRIFQEEIFGPVAAVATFKDEEEAIAMANDTFYGLGAGVWSRDGARAYRVGRGIEAGRVWTNCYHLYPAHAAFGGYKQSGIGRETHKAALSNYQQTKCLLVSYSAKALGFF

SEQ ID NO: 29558 - protein, 173 aa, Citrus sinensis
MAARMLEPLAVGGVIGDVIESFTPSIKMSVTYDNKQVCNGHELFPSTVVSKPRVEIQGGDMRSFFTLVMTDPDVPGPSDPYLREHLHWIVTDIPGTTDATFGRELVSYEIPRPNIGIHRFVFVLFKQTRRQTVNPPSSRDHFNTRAFAAENDLGLPVAAVYFNAQRETAARRR

SEQ ID NO: 29559 - protein, 418 aa, Xanthomonas campestris pv. vesicatoria str. 85-10
MQPSSFADLTRAAQRQQPGAINALAQALVRAGQPEEALVWYLRSAAAGDALAQVEAGRMRAYGVGCEVDVGQARAYWELAERQGAAAARYLLATLAVGEQPLTLAGTAQDRLQSAANADYPPALRAIAIQHGRVAHPERQRQCVALLERAAAGGDAVSAALLAERLLRGEGVPPQPDAAAQLLQQLQPLGMTALPPVDVAPPDPADDTAGHRIAFAPRVGPVRRHTAPRIEEYAAVLSADECRLLMLLARPHLRASKVIDPNDASTGRAPVRTSHGATLDPIIEDFAARAAQSRLAACAQLPLAHAEPLSVLCYAPGEQYRAHRDYLPPGTIAADRPTAGNRQRTVCVYLNDVGAGGETEFPVAGVRVRPRPGTLVCFDNLHADGRPDADSLHAGLPVTAGSKWLGTLWFRQQRYRDW

SEQ ID NO: 29560 - protein, 525 aa, Oryza sativa (japonica cultivar-group)
VVTNFMGTSFMLCLLGGFVADSFLGRYLTIAIFTAVQASGVTILTISTAAPGLRPAACAAGSAACERATGAQMGVLYLALYLTALGTGGLKSSVSGFGSDQFDESDSGEKSQMMRFFNWFFFFISLGSLLAVTVLVYVQDNLGRPWGYGACAAAIAAGLVVFLAGTRRYRFKKLVGSPLTQIAAVVVAAWRKRRLELPSDPAMLYDIDVGKLAAAEVELAASSKKSKLKQRLPHTKQFRFLDHAAINDAPDGEQSKWTLATLTDVEEVKTVARMLPIWATTIMFWTVYAQMTTFSVSQATTMDRHIGASFQIPAGSLTVFFVGSILLTVPIYDRLVVPVARRATGNPHGLTPLQRIGVGLVLSIVAMVCAALTEVRRLRVARDARVGGGEAVPMTVFWLIPQFLFVGAGEAFTYIGQLDFFLRECPKGMKTMSTGLFLSTLSLGFFVSSALVAAVHKLTGDRHPWLADDLNKGQLHKFYWLLAGVCLANLLVYLVAARWYKYKAGRAAAAGDGGVEMADAEPCLH

SEQ ID NO: 29561 - protein, 377 aa, Echinocactus platyacanthus
TDVPAAAAGAFKSYKLAAKAISRLQSLPSRNMALLCDVLVKEMSELTGYDRVMVYKFHEDEHGEVISEYRRPDMEPYLGLHYPATDIPQASRFLFLKNRVRMICDCLATPVKVIQGKKWAQPLSLGGSILRAPHGCHALYMANMGSIASLVMAVTINEDEDEVKSDPSTGKRLWGLVVCHHTSSRFIPFPLRYACELLLQVFGIQINKEVELAAQIRESHILRIQTVLCDMLLRDSPVAIVTQSPNVMDLVKCDGAALHYKGQVWLLGITPTEEQIKNITQWLLKYHGSTKGLSTDSLMEAGYPGASELGDAVCGMAAVRISSKDVLFWFRSHTAKVIKWGGAKHDPVDSDDGRKMHPRSSFKAFLEVVKWRSQPWE

SEQ ID NO: 29562 - protein, 329 aa, Clostridium perfringens ATCC 13124
MCKTLNRKYIYKYGEKKEDVEIVENMLNRMRNSGTFKGENFANIYYEKYIVEESDKAIVICHGFSECIEKYHEIIYYFLNEGFSVYIMEHRGHGRSGCLSKSCNTQVEVESFDYYVKDLKTFLNEVVLKDKRFNNNLYLFAHSMGGAIGTIFLENNHGYFKKVILNSPMFRINTREYSHIKCKLIAKFLILMGKGESFIFGQKPFEEEENLEASGTSDKLRHGLYHKFLLENPILRRGGGSIHWYKEAARATDYLMKKRNIERIDTPILLFKSEFDSYVDTKFHDEFKKLAKDCELIEVKGSKHEGFFEKDEILYDYLDKIFKFLEENN

SEQ ID NO: 29563 - protein, 377 aa, Pereskia stenantha
TDVPAAAAGAFKSYKLAAKAISRLQSLPSRNMSLLCDVLVKEVSELTGYDRVMVYKFHEDEHGEVISEYRRPDLEPYLGLHYPATDIPQASRFLFLKNRVRMICDRLATPVKVIQDKKLAQPLSLGGSILRAPHGCHAQYMANMGSIASLVMAVTINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGTALYYKGQVWLLGITPTEEQIKNITRWLLEYHGSTKGLSTDSLMEAGYPGASELGDAVCGMAAVRISSKDVLFWFRSHTAKEIKWGGAKHDPVDSDDGRKMHPRSSFKAFLEVVKWRSQPWE

SEQ ID NO: 29564 - protein, 547 aa, Cryptococcus neoformans var. neoformans JEC21
MPPRITSRALSTLSTAQSSAGSSSTLPPSTFSLRQHKRSPSSHSFTFRHFGPLLAHPRNPSTASLGWRRSFHSSTVHPASAKDPYNVLGVNKDASSSDIKKAYYSLAKKWHPDSSKEKDAKEKFHEIQAAYDILSDDKKRQAYDRYGSASTQEGFDPNFAHGAGGFGGFQGFGPGFGDGASDLFESLFGGAFGGGSSAFGGRQRPVRGDDLEVGVNLSFLEACNGVTRKVTVTPVIDCKTCTGSGLKPGEKKSQCPACRGSGQRTFQVQGMVMASTCQTCGGTGSTIPKNARCGECDGVGKVKEKKVLDVEIPAGVEDGMMIRVPGAGDKPLSASGPAGDLLVRVLVKPSSVFRRQGVNLYHDAKVPLHIALLGGVIRIPTLEGDVDVKVKNGTQNGEEAVLKGRGVKSVYGGRRNDRGDLIVGWKVQIPRSLTPFQRKILQAYADDIEGRNPQVHFGPLPSDPPVTNPSSPPKEPTNGEGSYPSYRSQNQPQAEHAPHRPSRPPAEPYKPYNPLSSSEEPISLANKIASAIGGAIGWVERFMRGRR

SEQ ID NO: 29565 - protein, 272 aa, Erwinia carotovora subsp. atroseptica SCRI1043
MKSLFKVTLLATTMALALNAGQALAADKAQASESTTAAKFKNDEQAAAYALGASLGRYMDNSLKEQEKLGIKLDKDQLIAGVQDAFADKSKLTDEEIEKTLQGFEGKVKAAAEAKMKQDAKDNADKGAKYLESFAKEKGVKKTESGLLYQVEKEGSGNAPKDSDTVVVNYKGTLVDGSEFDNSYKRGEPLSFRLDGVIPGWTEGLKHVKKGGKIKLAIPPAQAYGENGVPGIPANSTLVFDVELLDIKSEADLKAADDAKAEKPAAAEKTAK

SEQ ID NO: 29566 - protein, 503 aa, Cryptococcus neoformans var. neoformans JEC21
MPPRITSRALSTLSTAQSSAGSSSTLPPSTFSLRQHKRSPSSHSFTFRHFGPLLAHPRNPSTASLGWRRSFHSSTVHPASAKDPYNVLGVNKDASSSDIKKAYYSLAKKWHPDSSKEKDAKEKFHEIQAAYDILSDDKKRQAYDRYGSASTQEGFDPNFAHGAGGFGGFQGFGPGFGDGASDLFESLFGGAFGGGSSAFGGRQRPVRGDDLEVGVNLSFLEACNGVTRKVTVTPVIDCKTCTGSGLKPGEKKSQCPACRGSGQRTFQVQGMVMASTCQTCGGTGSTIPKNARCGECDGVGKVKEKKVLDVEIPAGVEDGMMIRVPGAGDKPLSASGPAGDLLVRVLVKPSSVFRRQGVNLYHDAKVPLHIALLGGVIRIPTLEGDVDVKVKNGTQNGEEAVLKGRGVKSVYGGRRNDRGDLIVGWKVQIPRSLTPFQRKILQAYADDIEGRNPQVHFGPLPSDPPVTNPSSPPKEPTNGETKKEIGEEGRQTKSEEDEVGGKI

SEQ ID NO: 29567 - protein, 270 aa, Nocardia farcinica IFM 10152
MKGIPHVNIQKYGPWAVIAGGSEGVGAEFARQLAENGMNLVLLARKEGPLAATAETCRAHGVEVRTLSVDLLAPDALERIRQLTDDLVVGLFIYNAGANTYGHEFVTGDLDRFQAVIDLNITVQLALVHHFGALMRERRRGGILLVGSLSGYLGSAQISIYSAVKSFCRTFAEGLWLEMRDHDVDVLELVLGLTRTPAMARAGLKMDTPGLLVSEPRDVAAQGLANLANGPVVVVKQFEDVAEKNSGHNRAELLLASRAAAKKLLPPPSR

SEQ ID NO: 29568 - protein, 332 aa, Ehrlichia chaffeensis str. Arkansas
MRTLTVREALCEAIREEMERDHTVLIMGEEVGEYQGAYKVTQGLLEQFGPDRVIDTPITEHGFAGIGVGAAFAGLKPIVEFMTFNFAMQAIDQIINSAAKTSYMSGGQLNCPIVFRGPNGAAARVGAQHSQCYASWYAHIPGLKVVSPYFAADCKGLLKAAIRDLNPVVFLENEIAYGHKHEIPNEVSTSDYITEIGKAAIVKEGTDITITAFSLQVKFALEAAELLAKEGINAEVIDLRTLRPLDTETILRSIKKTNKIISIEEGWPYSGIGSEIAALIMEYAFDDLDAPMIRITGKDVPLPYATNLEKLALPQIEDILEAARALCIRNYR

SEQ ID NO: 29569 - protein, 585 aa, Magnaporthe grisea 70-15
MRRMDATHSFSVADKLSGKEKEPLEYSDKTEGYDAQYRTSTYLGGSLKSRVFGAKNLKSPPAQVYALALETCKWSAILKEVVDSSQLLNHERKLTPPLALLLAHDLLLAKGGVALPASHGLRVTIERHKARLSSELTRARIRRKAPTLDALKAQVDEATSSEAGHPRWVRVNTLRSTLAEQLEITFSRYSKVDSVLDVVTKGSGNGGPSCNRIYLDEHVPNLVAISPGSDITKTEAYKSGAVILQDKASCFPAYLLDPRPEDGDVIDACAAPGNKTTHAAAVLEEYRTAVNVKESKGSRSTVHAFEKDSRRAEILAKMVKIAGSDSFTVVNKGKDFMKADPNSPLYKDVAALLLDPSCSGSGIVGRDDAPELHLPDAPGSAKKSQSNSKGGKRKRQDEQDRKSKKNKPNEQEGEQEEAGRTFVDDEGQTTMASSAADLAARLAALSSFQATLLEHAMKFPSAKRITYSTCSIHAEENEGVVLRTLKRNPGWRIMKREEQVDGMQRWPVRGEVQFCEGDKEIAEGCIRAYKGDGHGVMGFFVAAFVRNEDGQATPAPAPVPTPDTHSGAVDEENDRDDDEWGGCSD

SEQ ID NO: 29570 - protein, 540 aa, Bacillus cereus E33L
MSYEKVWANNEKLNQTEKNKLKKDGLEIFNDIPYYAENGFESIPKEEWDAFKWAGLYLQRPKEAGYFMMRVNIPSGIITNAQAEVLASIAEDYGRDVIDITTRQAIQFHWLEIHQIPDIFKRLARVGLSSAGACGDITRNITGNPLAGIDANELFDTTHIVKEVYDYFQHNEEFSNLPRKFKMSISSNIYNAANAEINCVAFTPATKEIDGEKKVGFHIKVGGGLSARPYLADELDVFVLPEEVKAVAIAIATIFRDFGYREKRHLARLKFLVADWGAEKFKEKIIEYTGPLQSKGESAVKGWNAGYFYGVQDQKQEGLKYVGFNVPVGRLHAEEMFEIARIAKQYGNGQIRTCNSQNFIIPNVPPENVTGLLNEPLFEAISANPKSFIGHAVSCTGIEYCNLALVETKERLRKIAEYLDTQIALDVPVRIHMVGCPNSCGQRQIADIGLQGVKMKTKEKGIVEAFEIYVGGTLLDGGAYNQKLKGKIDGEDLPDVLASFISYFKENKLPAETFYDFVGRVGVETLQIALNNVLEEVIAS

SEQ ID NO: 29571 - protein, 135 aa, Brassica napus
  misc_feature (127)..(127): Xaa can be any naturally occurring amino acid
  unsure (1)..(135): unsure at all Xaa locations
NIIAGSLTYYTRKHLPGLKRRRGGPEASGRFSSSGNVLSEEEQKHLLEEIQDLLSMQKGLVPTKVFVDMLRVAKILKASPTCIANLEKRIGMQLDQAGVEDLVMPSFTHTMETLYDVDSVQRIFDHXLGTDQIMT

SEQ ID NO: 29572 - protein, 438 aa, Bacillus cereus E33L
MYLHGTSRINGQGHLEIGGCDTTQLAKQYGTPLYVYDEESIRGKCRAFHRAFKESGFSYQVAYASKAFLCMEMCRVAREENMSLDVVSGGELYTALQAGFPASRIHFHGNNKTEEEIVMALQANIGCFVVDNFLELEILHDLAVQHGKFVNILIRVTPGVEAHTHEYITTGQDDSKFGFGVSNGQAMQAIELALQKSNYNVLGIHSHIGSQIFETAGFVRAIEVLHQFLEELRERTNYVVKVLNVGGGFGIRYTESDTPLTLETYVRAVTSAVREQFTVCNYPLPEIWVEPGRSIVGDAGTTLYTVGSVKDIPGIRKYVSVDGGMTDNLRPALYNARYEAMLANRGNDENEETVSIAGKCCESGDMLIWDITLPKVASADLLAISCTGAYGYSMANNYNRIRRPAVVFVKGGTSQIVVERETYENIIGNDRIRIKELV

SEQ ID NO: 29573 - protein, 309 aa, Bordetella parapertussis 12822
MNQPSSLAADLRGAWHAQAQSHPLITLGLAASAAGVVLLLVAGIVNALTGENRVHVGYAVLGGTAGFAATALGALMALGLRAISARTQDAMLGFAAGMMLAASAFSLILPGLDAAGTIVGPGPAAAAVVALGLGLGVLLMLGLDYFTPHEHERTGHQGPEAARVNRVWLFVLTIILHNLPEGMAIGVSFATGDLRIGLPLTSAIAIQDVPEGLAVALALRAVGLPIGRAVLVAVASGLMEPLGALVGVGISSGFALAYPISMGLAAGAMIFVVSHEVIPETHRNGHETTATVGLMAGFALMMFLDTALG

SEQ ID NO: 29574 - protein, 628 aa, Campylobacter upsaliensis RM3195
MLKKQANTLRFLSADMIQKANSGHPGAPLGLADIMVVLSRHLSHNPKNPQWLNRDRLVFSGGHASALLYSFLHLSGYDISLEDLKHFRQLHSKTPGHPEITTPGVEIATGPLGQGVANAVGFAMAAKKAQNLLGKDLINHQIYCLCGDGDLQEGISYEACSLAGLHRLDNLILIYDSNEISIEGDVKIAFNEDIMKRFEAQGFEVEQINGHDFEEIDAAFCRAKKSSKPYLIIAKTTIAKGALELEGSHHSHGTPLGEDLIKRAKAKLGFDENANFIIDEDVKIRFLSAVELGDLAEAKWNKTLENSGKKELLNKLLNPDFSKIEFPNFKGKDLATRDSNGEILNVLAKNLEGFLGGSADLAPSNKTELKAMGDFVEGKNIHFGIREHAMAAINNAFARYGLFLPFSATFFIFSEYLKPAARIAALMKLKHFFIFTHDSIGVGEDGPTHQPIEQLSTFRAMPNFLSFRPANGVENAKAWQVALKNECPSAFILSRQKLKALDGAIFGDVENGAYLLKEHQNPTYTLLASGSEVSLCLDVALELEKEGILCNVISMPCYELFERQDKAYKERLLKGKVIGVEAANSKELYQFCDVLYIIESFGESGKDKAVFEHFGFSVPKLCAFVRQI

SEQ ID NO: 29575 - protein, 491 aa, Triticum aestivum
  misc_feature (94)..(94): Xaa can be any naturally occurring amino acid
  misc_feature (110)..(110): Xaa can be any naturally occurring amino acid
  misc_feature (150)..(150): Xaa can be any naturally occurring amino acid
  unsure (1)..(491): unsure at all Xaa locations
MAAAPAGPQNRCVFVGNIPYDATEEQLVQICEEVGPVVSFRLVVDKETGKPKGYGFCEYKDEETALSARRNLQGHDVNGRQLRVDFAENGRNTXDRNREKGREPQVISVXVGGENQPATRAAVGDTSLRRPPGLPQEIHAAGVMVGGLRXAQTANVQNGLPVQFGLGNDPLTHYLARMSRHQLYQIMSELKTLTTQNNDLAKKLLQGIPQLPKALFQAQIMLGLVTPQMMQMAKSQQPSSSLAQSSHLNESFPQPDAVLPIVHRPPPNPNAMQEQTAPLHNFPQYQHSSQPPVKMFPHGHQPGVLAHPPMLSQPFGTSSSVPTQPLVNSGGLISQVQPSFLTQHPRPPVMPTNVQQLPLTNPHLSQVAAEPEILPNEIRLPDRASHQAELDHPSKLRKLEDGTSTPGIVNNSPAVYSAPSQVVVPSGPSGSYSSGAVHFQQPENEAPQLTQDDESALLQQVLQLTPEQLSSLPVEQQQQVIQLQKMLSAGK

SEQ ID NO: 29576 - protein, 380 aa, Methylococcus capsulatus str. Bath
MTADAAIRGIREIDAQGSIGLIGSEPHLPYKRPLLSKGLWLGKSFDQIWYGTETCGISAFLGRTVTRLDLAEKSVTDDEGTIYRFEKLLLATGGRPRRFPFGGDDILYFRTVDDYFRLRTLTETRRKFAIIGGGFIGSEIAAALASIGKDVVMIFPEACIGARVFPGNLCRFLDGYYRDQGVELLSGRTVTGLVREGDGLRLALGETGEEVLVVDGVVAGIGIEPETRLAEAAGLPVEGGIVVNDFLQAGHPDVYAAGDAASFFSPVLGRRMHVEHEDNARTMGRLAGRNMAGEASPYRHLPYFYSDLFDLGYEAVGELDSRLETVEDWSEPYHKGVVYYLDQGRVRGVLLWNVWDRVEAARALIGEPGPWGAGDLAGRL

SEQ ID NO: 29577 - protein, 432 aa, Phaseolus vulgaris
FVRKTNKNRDMPLDSDVFRVPPGYNAPQQVHITQGDLVGRAMIISWVTMDEPGSSAVRYWSEKNGRKRIAKGKMSTYRFFNYSSGFIHHTTIRKLKYNTKYYYEVGLRNTTRRFSFITPPQTGLDVPYTFGLIGDLGQSFDSNTTLSHYELSPKKGQTVLFVGDLSYADRYPNHDNVRWDTWGRFTERSVAYQPWIWTAGNHEIEFAPEINETEPFKPFSYRYHVPYEASQSTSPFWYSIKRASAHIIVLSSHIAYGRGTPQYTWLKKELRKVKRSETPWLIVLMHSPLYNSYNHHFMEGEAMRTKFEAWFVKYKVDVVFAGHVHAYERSERVSNIAYKITDGLCTPVKDQSAPVYITIGDAGNYGVIDSNMIQPQPEYSAFREASFGHGMFDIKNRTHAHFSWNRNQDGVAVEADSVWFFNRHWYPVDDST

SEQ ID NO: 29578 - protein, 431 aa, Methylococcus capsulatus str. Bath
MTAKSRTLAAAALHDVVVDRHSLTWALGKRLPSLPDARDRAFVQSLCYGVLRAFETLDFLLGRLATKPIRDPEIRLLALIGLHQLRSMNVKPHAAVSETVEAAGRKSWAKPLLNAILRNYLRRKEELESRALQDPESRDAHPAWLRDRLAADWPEQWETLVQQNNLPPPMTLRVNPLMNDRAGYLARLTEAGIAARPCRHSPWGLTLGSPVPVDALPGFAEGRVSVQDEAAQLAAPLVGAEPGERVLDLCAAPGGKTLHMLELSRGDIEAVAVDSDAERCARIRENLERERLSAAVVTGDARSPESWWDGRPFDRILLDAPCSATGVIRRHPDIKLLRQAVDLDTLNELQAAILTAAWPLLKPGGILVYATCSVIRAENEAQMSRFLEAHDDAAELPLPAAWGIPLRHGRQILTGESGMDGFYYALLRKTG

SEQ ID NO: 29579 - protein, 377 aa, Blossfeldia liliputana
TDVPAAAAGAFKSYKLAAKAISRLQSLPSRNMALLCDVLVKEVSELTGYDRVMVYKFHEDEHGEVISEYLRPDMEPYLGLHYPATDIPQASRFLFLKNRVRLICDCLATPVKVIQGTKWAQPLSLGGSILRAPHGCHALYMANMGSIASLVMAVTVNDDEDEVKSDPSTGRRLWGLVVCHHTSSRFIPFPLRYACELLVQVFGIQINKEVELAAQIRESHILRIQTVLCDMLLRDSPVAIVTQSPNVMDLVKCDGAALFYEGQVWLLGITPTEEQIKNITQWLLKYHGSTKGLSTDSLMEAGYPGASELGDAVCGMAAVRISSKDVLFWFRSHTAKEIKWGGAKHDPVDGDDGRKMRPRSSFKAFLEVVKWRSQPWE

SEQ ID NO: 29580 - protein, 689 aa, Oryza sativa (japonica cultivar-group)
MAETPRRIRRGGAGLSLVVVALLLAVAARAQQEYEANQQNACYATNASSTLGYTCNATSASAAAAAPCDAYLVFRSSPPLYASAVSISYLLNVAAAAVADSNAVDPVAPVAADRLVLAPVPCGCSPGGYYQHNASHTIRDTGVETYFIIANLTYQGLSTCQALIAQNPLHDSRGLVAGDNLTVPLRCACPSPPQAAAGVKHMVTYLVTWGDTVSAIAARFRVDAQEVLDANTLTESSIIYPFTTLLVPLKNAPTPDMLAPPAQAPPPPAPAPPRAQPPPGGSGSGKGVAVGVGVGCGVLALAGVFGLLFFCLRRRRGVGEESVRPGKVVGDVSSSAEYGALASGKQTTTATSMSSLSAARSLMASEVREALESLTVYKYSELEKATAGFSEERRVPGTAVYRGVFNGDAAAVKRVSGDVSGEVGILKRVNHCSLIRLSGLCVHRGDTYLVFEYAENGALSDWLHGGDAATGVLGWRQRVQVAFDVADGLNYLHHYTNPPCVHKNIKSSNILLDADLHGKMSSFGLARALPAGDGAAAAAAQLTRHVVGTQGYLSPEYLEHGLITPKLDVFAFGVVLLELLSGKEAASSGDGENGEALLLWESAAEALVDGGGEDAGSNVRAFMDPRLGGDYPLDLAMAVASLAARCVARQPAARPAMDEVFVSLAAVYGSTVDWNPSDHGNSGSSLIGR

SEQ ID NO: 29581 - protein, 107 aa, Bacillus cereus E33L
MRNAFTLLFETIEERKNNPLPQSYTNYLFSKGEDKILKKIGEECSEVIIASKNNDNEELVKEMVDVLYHCFVLLAEKNIPLKDIMEEVTERNGKLSRVGDRREIDTL

SEQ ID NO: 29582 - protein, 418 aa, Glycine max
MAASSLLRSALLAPSSCDRPKVYTNASSSNLKSKGLHSSIFGTSIQCDSLVLQNCNGRGIQPIKATATEIPLPTQQSRSTGKTRVGINGFGRIGRLVLRVATFRDDVDVVAINDPFIDAKYMAYMFKYDSTHGPFKGSINILDDSTLEINGKHVKVVSKRDPAEIPWSDFGADYVIESSGVFTTVEKASSHLKAGAKKVVISAPSADAPMFVVGVNEKTYNPKMDIVSNASCTTNCLAPLAKVVNEEFGIVEGLMTTVHATTATQKTVDGPSMKDWRGGRGAAQNIIPSSTGAAKAVGKVLPELNGKLTGMAFRVPTPNVSVVDLTCRLKKNASYEDVKAAIKYASEGPLKGILGYTDEDVVSNDFVGDSRSSIFDAKAGIALSASFVKLVSWYDNEWGYSNRVLDLIEHMALVGAQN

SEQ ID NO: 29583 - protein, 644 aa, Burkholderia thailandensis E264
MRENPRPENHHAIRSASVATAARQRIARPLRRDAVARSRRQAGIRLVLAAPENPDFLNLDALSHTQARPPRRGACACRTSAPTQAIPVGKSSMSTPTDVSPPIAIERSAVLDHAHVGDIKGALGTIALHDTAPRNTWWARVRTLLAILGPGLIVMVGDNDAGAFGTYTQVGQNYGTTLLWTLLLLVPVLFVNQEMVLRLGAVTGVGHARLIFERFGKFWGAFSVVDLFVLNALTIVTEFIGITFVLDFFGVSKVAGVCIAAALTMAAVSTGDLRRFERFAVALCLLSLLLVPVLVSIHPPVHQMTRDLFVPGWPAHAKLSDVMLLVIGIVGTTIAPWQLFFQQSYVIDKRITPRFMKYEKADLWIGIVLVMIGAIAMIAFCAALFEGRPEAGNFTDAGGVIAGLAKYAGHTSATLFAIALLDASIIGAAAVSLATAYAIGDVFKIRHSLHRSVSDAKGFYLVYFGIVAAAAALVLIPGSPLGLLTEAVQTLAGVLLPSATVFLLLLCNDKAVLGPWVNSRKLNLFTGAVIWVLVMLSIILTASVMYPDMTGETMIEVLAGGTLLAALGCVATLALRKRGGEPPEPAESAVERSLRDTWRMPPLDALPAPRITLSTRIWMGVLRGYLVLAVGLVIVKVVQMAFFR

SEQ ID NO: 29584 - protein, 422 aa, Staphylococcus aureus subsp. aureus MRSA252
MKNLILSVQHLLAMYAGAILVPIIVGTSLKFTPEQIAYLVTVDIFMCGVATFLQANKVTGTGLPIVLGCTFTAVAPMILIGQTKGIDVLYGSLFLSGILVIIIAPFFSHLVKFFPPVVTGSVVTIIGINLMPVAMNYLAGGQGAKDYGDVKNILLGLMTLIIILVLQRFTTGFIKSIAILIGLVLGTIGAGLLGMVDINQVNHAGWLGIPVPFKFSGFSFDVTSTLVFFIVAIVSLIESTGVYHALSEITGKKLERKDFRKGYTAEGLAIVLGSIFNSFPYTAYSQNVGLVSLSGAKKNNVIYGMVVLLLICGCIPKLGALANIIPLPVLGGAMIAMFGMVMAYGVSILGHIDFKNQNNLLIIAVSVGLGTGISAVPQAFKGLGEQFAWLTQNGIVLGAISAIILNFFFNGIKYKQTEENVK

SEQ ID NO: 29585 - protein, 489 aa, Mycobacterium tuberculosis H37Rv
MSAASQRVGAFGEEAGYHKGLKPRQLQMIGIGGAIGTGLFLGAGGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 29586 - protein, 202 aa, Triticum aestivum
  misc_feature (64)..(64): Xaa can be any naturally occurring amino acid
  misc_feature (79)..(79): Xaa can be any naturally occurring amino acid
  unsure (1)..(202): unsure at all Xaa locations
MEKAAGNQAGKVLKKGKKKQAAKDELDRQKQAEKKRRRLEKALANSAAIISELEKKKQQKKEEXQERLDEEGASIARSXSLLHVLIGEDSDESRHLALNKHRRCNDWDPSAGLDFALDTQGAADIYSPGGLMCANQAYASRGHRWIDWGNAHPLPTWGEVRDLKASYHQGTFHQSTVTCPGGRSKSRGHGGREHATSGQFAL

SEQ ID NO: 29587 - protein, 444 aa, Brassica napus
MANATSIKDLPSLTGLHQRRNPLEENPFFHPSHGFYITPSDVVLSQVVYDLSDASQPHVAYHRAGPRREILYEPSSVKAAIVTCGGLCPGMNTVIRELVVGLWELYGVREIYGIPAGYRGFYSMEAVELNPKLVHNWHKRGGTVLATSRGGFDLCKIVDAIQQNGYNQVYIIGGDGTMRGAVKIFDEVSRRKLEVGITGIPKTVDNDVGIIDRSFGFQTAVEMAQEAISAAHVEAESAVNGIGLVKLMGRSTGHIALHATLSSRDVDCCLIPEMGFYLEGKGGLFEFLEQRLKDHGHAVLVVAEGAGQEIIPRNEAQKQERDESGNLVFLDVGVWLKSALKEWWEREHPKELFTVKYIDPTYMIRAVPANATDNLYCTLLAHSSIHGVMAGYTGFVSGPINGNYAYIPLEEVAQTKNEVNTSDPKWAWVRSVTNQPDFETNFKG

SEQ ID NO: 29588 - protein, 634 aa, Lactobacillus plantarum WCFS1
MVKQTTEMNDASYLFNTGAGFNSQDYLGCHLAASGRAVFRVWAPHAKAVGVVGDFNDWQPSALKLLGATGIWQGQVPNVHAGQLYKFQITTPTGQVQLKIDPFAQQFERKPGDAAVVVEPMTMRWHDSLWLARRKKSRAANRPINIYEVHLGSWRRHLDGSYYTYAELAAELIPYVKQRGYTHIELMPVMEHLLDASWGYQQLGYFAPTSRFGKRDSFLSFVDQCHQANIGVFVDWVPGHFIRNYDALYQYDGTPTFEYADPERANNRRWGAWNFDLGKTQVQSFLISSAEYWLDQCHLDGLRVDAVSNMLYCDYDEGREGQVNQYGDNRNLEGIAFLQKLNTTVLTHHPDILMIAEESSAYPQVTGSVANGGLGFNYKWNMGWMHDTLDFFMMDPLYRHDHFNLLTFAFVYMFDERFILPFSHDEVVHGKKSLMHKMSGDRYNQFANLRTMLTYMAAFPGKQLNFMGSEWGQFLEWRDWSALEWVDLKDDLNHRMQQFTTQLNAVYRHNRPLWEQDHDPAGIIYTHTDDPDSSTMGFIRQAKRKYSFVVAAFNFVPVERQDYRIGVPYRGRYELLLNTEAQAFGGTWTKLETTFTAVDKPYRGQPASFTVTLPAMGALLIRPVKVIGGVKHAR

SEQ ID NO: 29589 - protein, 392 aa, Oryza sativa (japonica cultivar-group)
MEGGGGGGHGHHGGGGGGHGHHGGIGGGEAQIKGTLTHGGRYVQYNVYGNLFEVSSKYVPPIRPVGRGACGIICAVVNAQTRQEVAIKKIGNAFDNQIDAKRTLREIKLLRHMDHDNVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 29590 - protein, 194 aa, Bacillus cereus E33L
MREFSQIRETTETKIKLSLQLDEGKNVSVQTGVGFFDHMLTLFARHGRFGLQVEAEGDVFVDAHHTVEDVGIVLGNCLKEALQNKEGINRYGSAYVPMDESLGFVAIDISGRSYIVFQGELTNPKLGDFDTELTEEFFRAVAHAANITLHARILYGSNTHHKIEALFKAFGRALREAVERNAHITGVNSTKGML

SEQ ID NO: 29591 - protein, 286 aa, Geobacter metallireducens GS-15
MDITGKTRVLGIIGWPVAHSLSPLMQNAALEAMGLDWIYVPFAVRPEDLASAVAGLRTLGVSGFNVTIPHKTAIIPLLDRITPEARLMGAVNTVKREGDDLVGYNTDGEGFIRSLAEDLGFVPAGRRILVLGAGGAARAAVASLARGGAATVMIANRSVARGEELVEAFQGVFGGTQFAAMPLDIPLINAEVQNFDLLVNTTSVGMGETAFEGLDISRMNPAASVYDMVYAPWETPLLAEASRGGRRCANGIGMLVAQGECALAIWTGMEPPPGIMRRRVLAALKR

SEQ ID NO: 29592 - protein, 379 aa, Lactobacillus plantarum WCFS1
MQDEMLGIILAGGQGTRLGKLTKDTAKPAVPFGGRYRIIDFTLSNCANSGVNTVGVITQYQPLELNAHIGSGASWGFDSLNGGVTVLQPYSSSEGEKFFQGTAHAIYQNIEYIDQQDPKYLLVLSGDHIYKMDYDAMLKYHQEKKASLTVGVIHVTNEEAKRFGMMNTDATDRIIEFEEKPEHPKSDKASMGIYIFNWPTLRDYLVKSYATDKSLEDFGKNVIPSYLANNESVYAYAFKGYWRDVGTIKSLWQANMEFLSPHNRLNIGDRYWRIYSKAEVLPPMFLTETSQVNNAMVVDSCYVAGEIDHSILSQRVSVGMGSRVVDSMIMPGATIGKNVVIDHALIGEDAVIGDDAQIIGTTDKIAVVGYHETMGVEQP

SEQ ID NO: 29593 - protein, 390 aa, Lactobacillus plantarum WCFS1
MRREQVSAIINLLEPSDALQPLTAVRPVGMLPFGGRYRLVDFQLSSVINAGIQNVMVTVPRSGRSVADHLRSGRDWSLNTIRGGLFLSPYNDLKLVAPEKKAALLHHYYDNSIQFLKCSQSEYSVVMSTRNVGNIDLKALLRYHEERNSPVTAVYKRVDPASLIPENTILQLTAKGEATAVVPMSKAKISPKTKQVAKSMAIYLMSTVDLIELLQSANQRGDMISLEELMRQAVIQHNANAFEYTGFQANIHDINSYFAANMAVLDEANFRALFYSSRRIYTKVKNEIPTFFATGSQCRDSLCGTGGYIEGQLDHSVIFRDVLINRDSQVKNAIIMQGARIGAGCKLENVIIDKDAVIGPNLVLKGTSTTPLVISKGQHVFQQAEVAVHD

SEQ ID NO: 29594 - protein, 388 aa, Mycobacterium tuberculosis H37Rv
MTDRVALRAGVPPFYVMDVWLAAAERQRTHGDLVNLSAGQPSAGAPEPVRAAAAAALHLNQLGYSVALGIPELRDAIAADYQRRHGITVEPDAVVITTGSSGGFLLAFLACFDAGDRVAMASPGYPCYRNILSALGCEVVEIPCGPQTRFQPTAQMLAEIDPPLRGVVVASPANPTGTVIPPEELAAIASWCDASDVRLISDEVYHGLVYQGAPQTSCAWQTSRNAVVVNSFSKYYAMTGWRLGWLLVPTVLRRAVDCLTGNFTICPPVLSQIAAVSAFTPEATAEADGNLASYAINRSLLLDGLRRIGIDRLAPTDGAFYVYADVSDFTSDSLAFCSKLLADTGVAIAPGIDFDTARGGSFVRISFAGPSGDIEEALRRIGSWLPSQ

SEQ ID NO: 29595 - protein, 541 aa, Oryza sativa
MAAGVLGRCGRTWRAAGWMNSDDGVTDLQVSATTSPYKEVLATARRQSACKFLQLQLCKTATARGSTSRKYESASPSLARQKEKQVVDLEEGSDSSEEGRRGIRINWTEDDNIRLMSSWLNNSVDPIKGNDKKSEHYWKAVAAEFNTNMPSNGNKRTAKQCRTHWDNVKRDVTKFCGFYAKARNTFTSGYSDEMIMEKAREWYKSRNNDKPFTLEYMWKDLKDQPKWRRVLEQSSKNKRNKISESGAYTSSSNQDTEKESVSKEKRPEGQKAAKQRQKGKWLMWEEINDPMEAEIEAEMEAQIEAELQAQMQAQEAGTSNRRRGYNWSAAGSNNDINVLDQSSLFTEVLQGRAPSVQFTVNGSEYNTGYYLADGIYPEWAVFVKSIIRPQADKAKLYAQHQESTRKDVERAFGVLQKSWAIVRHPARIWEREELADIMYACVILHNMIVEDERDTYEIPDDNTYEQSQRSAQLTGYDHDAEEHGNVDLVQQGDHRQTIRLHEHDAICRQGHGGTRSELRHGEVLPPVADLGDRIRHGQEQL

SEQ ID NO: 29596 - protein, 193 aa, Magnaporthe grisea 70-15
MAEIRRKLVIVGDGACGKTCLLIVFSKGTFPEVYVPTVFENYVADVEVDGKHVELALWDTAGQEDYDRLRPLSYPDSHVILICFAIDSPDSLDNVQEKWISEVLHFCSGLPIILVGCKKDLRYDQKTIEELRKTSQKPVSPEDGEEIKKKIGAYKYLECSAKTNEGVREVFEHATRAALLSRHKTKKKKCLIL

SEQ ID NO: 29597 - protein, 396 aa, Oceanobacillus iheyensis HTE831
MVYKNLKDEAIELHYKHKGKLEITGKMEINTEDDLSLVYTPGVADVCKQIADDPNKINTLTSRGNMVGIVTDGTAVLGLGNIGPKAAMPVMEGKALLFKKFANIDGFPICLDTTDVDEIVNIVKAMGPTFAGINLEDIAAPRCFEIEKRLKEELDIPVFHDDQHGTAIVVLAALTNALKVVNKQNRPIKIVINGAGAAGIAIAKLLYHAGLTNITLVSLEGVVAKGEDWLNPMQVEMAEVTNKDNVRGTLKDAITEADVFIGVSGPGALKKEHIQTMAKDPIIFALANPIPEIYPEEALEAGAAVVATGRSDYPNQVNNLLAFPGIFRGAIDAGARDITTEMKVAAAYGIADVLSDEEISKDKVIPNALDERAGERVAQAVMSSAIQQKKETSSVS

SEQ ID NO: 29598 - protein, 377 aa, Maihuenia patagonica
TDVPVVAAGAFKSYKLAAKAISRLQSLPSRNMSLLCDVLVKEVSELTGYDRVMVYKFHEDEHGEVISEYRRPDLEPYLGLHYPATDIPQASRFLFLKNRVRMICDCLATPVKVIQGKKWAQPLGLGGSILRAPHGCHALYMANMGSIASLVMAVTINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGITPTEEQIKNITQWLLEYHGSTKGLSTDSLMEAGYPGASELGDAVCGIAAVRISSKDVLFWFRSHTAKEIKWGGAKHDPVDGDDRRKMHPRSSFKAFLEVVKWRSQPWE

SEQ ID NO: 29599 - protein, 128 aa, Oceanospirillum sp. MED92
MNKSIISTENAPSAIGTYSQAVRVGSTVYMSGQIPLVPETMEMVTESFEAQAEQVFKNLQAVADAAGGSLADVVKVTILLSDMGHFATVNEVMARYFSEPYPARAAYAVKQLPKDADIEVEAIMVTAE

SEQ ID NO: 29600 - protein, 408 aa, Erwinia carotovora subsp. atroseptica SCRI1043
MAAEQKAVTRDTHDKVILPVYAPAKFVPVKGKGSRVWDQDGREYIDFSGGIAVTALGHCHPALVNALRQQGETLWHTSNIFTNEPALRLASKLIDATFADRVFFVNSGAEANEAAFKLARHYAVKRHSPYKTKIIAFYNAFHGRTLFTVSVGGQPKYADGFGPKPADIVHVPFNDLAAVKAVMDDHTCAVVLEPIQGEGGITPATPEFLQGVRDLCDQHKALLVFDEVQSGMGRTGKLFSYMHYGITPDILTTAKALGGGFPISAMLTTEEIASVMTVGVHGTTYGGNPLACAVAEAALDIINTPEVLSGVADRHDRFVSELDKINQQYGVFDQVRGMGLLLGAELKPQWHGRAGEFLAAAAAQGLMVLMAGPNVIRFVPSLIIDEDDIAQGMEKFAKAVAQVVNTAN

SEQ ID NO: 29601 - protein, 377 aa, Austrocylindropuntia subulata
TDVPAAAAGAFKSYKLAAKAISRLQSLPSRNMSLLCDVLVKEVSELTGYDRVMVYKFHEDEHGEVISEYRTPFLESYLGLHYPATDIPQASRFLFLKNRVRMICDCLAAPVKVIQDKKLAQPLSLGGSILRAPHGCHAQYMENMGSIASLVMAVMINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGVALYYKGQVWLLGITPTEEQIKNITQWLLEYHGTTKGLSTDSLMEAGYPGASELGDAVCGMAAVRISSIDVLFWFRSHSAREIKWGGAKHDPVDSDDRRKLHPRSSFKAFLEVVKWRSQPWE

SEQ ID NO: 29602 - protein, 375 aa, Pereskiopsis porteri
TDVPAAAAGAFKSYKLAAKAISRLRSLPSRNMSLLCDVLVKEVSELTGYDRVMVYKFHEDEHGEVISEYRTPDLEPYLGLHYPATDIPQASRFLFLKNRVRMICDCLAAPVKVIQDKKLAQPLSLGGSILRAPHGCHAQYMANMGTIASLVMAVTINEDEVKSDPSTGKRLWGLVVCHHTSSKFIPFPLQYACELLVQVFGIQINKEVELAAQIRESHILRIQTVLCDMLLRDSPVAIVTQSPNVMDLVKCDGAALYYKGQVWLLGITPTDEQIKNITQWLLEYHGSTKGLSTDSLMEAGYPGASELGDAVCGMAAVRISSKDVLFWFRSHSAREIKWGGAKHDPVDSDDRSKMHPRSSFKAFLEVVKWRSQPWE

SEQ ID NO: 29603 - protein, 400 aa, Rhizobium leguminosarum bv. phaseoli
MAFLADALSRVKPSATIAVSQKARELKAKGRDVIGLGAGEPDFDTPDNIKKAAIDAINRGETKYTPVSGIPELRKAIAAKFKRENGLDYSWEQTIVGTGGKQILFNAFMATLNPGDEVSIPAPYWVSYPEMVALCGGTRFFVSATQEHNFKLQAADLEKAITPKTKWFIFNSPSNPTGAAYTHDELKALTDVLMKNPQVWVLTDDMYEHLTYGDFKFVTPVEVEPQLYDRTLTMNGVSKAYAMTGWRIGYAAGPIQLIKAMDMIQGQQTSGATSIAQWAAVEALNGTQDFIPENKKIFEGRRDLVVSMLNQAKGIVCPVPEGAFYVYPSCKGLIGKTAPSGKVIETDEDFVSELLESEGVAVVHGSAFGLGPNFRISYATSEEQLEEACRRIQRFCGACK

SEQ ID NO: 29604 - protein, 195 aa, Amylomyces rouxii
MAEIRRKLVIVGDGACGKTCLLIVFSKGTFPEFYVPTVFENYVADVEVDGKHVELALWDTAGQEDYDRLRPLSYPDSHVILICFAVDSPDSLENVQEKWISEVLHFCQGLPIVLVGCKKDLRNDPGTIEELRRNSQKPVSSEEGASIAQRISAYKYLECSAKTGEGVREVFEHATRAALMVSKKKKSKSGVCNLL

SEQ ID NO: 29605 - protein, 397 aa, Streptomyces virginiae
MSARIGAISESATLAVDAKAKALKAAGRPVIGFGAGEPDFPTPDYIVEAAVEACRNPKYHRYTPAGGLPELKAAIAAKTLRDSGYEVEASQVLVTNGGKQAIYEAFAAILDPGDEVIVPAPYWTTYPESIRLAGGVPVDVVADETTGYRVSVEQLEAARTERTKVVLFVSPSNPTGSVYSEADAKAIGEWAAEHGLWVLTDEIYEHLVYGEAKFTSLPVLVPALRDKCIIVNGVAKTYAMTGWRVGWVIAPQDVIKAATNLQSHATSNVSNVAQVAALAAVSGNLDAVAEMRKAFDRRRQTMVKMLNEIDGVFCPTPEGAFYAYPSVKELLGKEIRGKRPQSSVELAALILDEVEVAVVPGEAFGTPGYLRLSYALGDEDLVEGVSRIQKLLAEAKA

SEQ ID NO: 29606 - protein, 128 aa, Brassica napus
KQVVQNDVQEEILAKPQGKRYLISVGEIYRVVKILRASTRQYKPWILLSPTSSTVLAVLDECVELWLSSGLEEALRNNIIRLQGVESNHSADQLLESIRCIDEVDAFTLHACITSDTSPTCCISVLNT

SEQ ID NO: 29607 - protein, 455 aa, Legionella pneumophila str. Paris
MALLSFLKPAPYLDEIQDKNVVKQQYRYWRIRTFYAMYIGYALFYFTRKSFTFVMPALQSTLGMTKTELGLIASILSLSYGISKFLSGILGDKSNPRYLMAIGLILTGVFNILFGLSSTWWLFAIFWGLNGWFQGWGWPGCTKLLTHWYSQSERGRWWSLWNTSHNVGGALIPLIVAVCAQYFGWRSAMFVPGIICILGGIFLINRLRDTPQSLGLPAIEQYHEDFSGSANHHQEKTELSVKEILWNYVLCNQYIWILSISYLFIYIVRTAINDWSMLYLTEVKEYSLITAGSCVIWFEVGGFFGNLVAGWSSDKIFQGKRNPINVLFTAGVFATLLLFTLTRAYTPFLDSLFLFFFGFFIFGPQMMIGMACAELAHKKAAATATGFAGFFAYCLGAVLAGAPLGAIIKNYGWDNFFLTLFICCLIPLFLMLPLWHVKVNPKYRQSEFSGKSEFA

SEQ ID NO: 29608 - protein, 593 aa, Medicago truncatula
MSSKPKKQTYSVCFCCRRRFKLGVSEAPPEIKELYHRYSDEGGIMTASHLRSFLIEVQKEEKITEEETQAIIDGHKHLSIFHRKGLNLESFFKFLFGDTNPPLLPSTGVHQDMSLPLSHYYIFTGHNSYLTGNQLSSDCSDAPIIKALQRGVRVIELDIWPNDSKDDVDVLHGMTLTTPVALIKCLMSIKEYAFVASEYPVVITLEDHLTPDLQAKVAQMVTQTFGDILFCPTSETLKEFPSPDSLKKRIIISTKPPKEYLEAKEEKEKEESQKGKPLGDEEAWGKEVPSLRGGTIADYKQNSGIDEDDLKEEEDSDEASRQNTSDDYRRLIAIHAGKPKGGIVECLKVEPDKVRRLSLSESQLEKAAETYGKEIVRFTQQNILRVYPKGTRITSSNYNPLIGWMHGAQMVAFNMQGYGRSLWLMQGMFKANGGCGFVKKPDFLLKTGPNNEIFDPKANLPSKTTLKVTVYMGEGWYYDFKHTHFDQFSPPDFYARVGIAGVPFDTVMKKTKSIEDSWLPSWNEVFEFPLSVPELALLRIEVHEYDMSEKDDFGGQTCLPVWELRSGIRAIPLHSRKGDKYNNVKLLMRFEFI

SEQ ID NO: 29609 - protein, 354 aa, Bacillus cereus E33L
MEKRIVCLAGDGVGPEVMESAKEVLHMVERLYGHHFHLQDEHFGGVAIDLTGQPLPQRTLAACLASDAVLLGAVGGPRWDGAKERPEKGLLALRKGLGVFANVRPVTVESETAHLSPLKKADEIDFVVVRELTGGIYFSYPKERTDEVATDTLTYHRHEIERIVSYAFQLASKRKKKVTSIDKANVLESSKLWRTVTEEVALRYPDVELEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGCAIEEAISAVLKSGKCTEDIGGTETTTSFTKAVMQEMEEQALVGRGR

SEQ ID NO: 29610 - protein, 377 aa, Xanthomonas campestris pv. vesicatoria str. 85-10
MCAQLRDSFATPSEPHPCVRRSSGLVHLFAGSVRTGSRLLYGESRVPSTGLDPHAAAPQPATAPPRGGLAARVGSLRRWVDSQTDEPLDEARADRIDWLRAVPFIALHLACLAVFWVGASWFAVGMAVALYALRMFALTGFYHRYFSHRAFKTSRVLQFVFAAIGATCVQRGPLWWAAHHRNHHRHTDTGRDPHSPAQHGFWWSHTGWFLTPRNFRTDWEVIPDLRRFAELRFLDRFDIVMPVLLALGLYLLGDWLAVAAPALKTSGAQLLVWGFVISTVALFHATFTINSLAHRFGSRRFDTRDDSRNNWLLALLTFGEGWHNNHHFFPGSARQGLRWWEYDMTWYGLTAMSWVGLVWDLKPMPKLLTQRAERVKR

SEQ ID NO: 29611 - protein, 222 aa, Saccharomyces cerevisiae
MSNEDYGYDYDYLFKIVLIGDSGVGKSNLLSRFTTDEFNIESKSTIGVEFATRTIEVENKKIKAQIWDTAGQERYRAITSAYYRGAVGALIVYDISKSSSYENCNHWLTELRENADDNVAVGLIGNKSDLAHLRAVPTDEAKNFAMENQMLFTETSALNSDNVDKAFRELIVAIFQMVSKHQVDLSGSGTNNMGSNGAPKGPTISLTPAPKEDKKKKSSNCC

SEQ ID NO: 29612 - protein, 383 aa, Arabidopsis thaliana
MTTLKTSSFSSLPWDLVEDILARVPATSLKRLRSTCKQWNFLFNDQIFTKMHFDKAEKQFLVLILRLYTVCSMSLDLRGLHDNIDPSIEVKGELSLIDPHCSSRKTFVSKVFHCNGLLLCTTMTGLVVWNPCTDQTRWIKTEVPHNRNDKYALGYGNYKSCYNYKIMKFLDLESFDLEIYEVNSNSWRVLGTVTPDFTIPLDAEGVSLRGNSYWIASHKREEIEEEEEEENEYFINDFLISFDFTTERFGPRVSLPFKCESSWDTISLSCVREERLSLFFQDDGTLKMEIWMTNNITETKTTTMSWSPFLKIDLYTYGHRFGNEVSFLVDEENKVIVCCDEEEDDINDTVYIIGENEYWRKEDIVQRSYRPRMFSYVPSLVQI

SEQ ID NO: 29613 - protein, 390 aa, Petunia x hybrida
MALSTTRTTVSKFLKPLTTAVSTTRHLSTTNTLTIETSLPFTGHNIDPPSRTVETNPNELLTFFKDMAEMRRMEIAADSLYKAKLIRGFCHLYDGQEAVAIGMESAITKKDCIITAYRDHCIFLSRGGTLFECFSELMGRKDGCSKGKGGSMHFYKKDSGFYGGHGIVGAQVPLGIGLAFAQKYSKEDHVTFAMYGDGAANQGQLFEALNMAALWDLPAILVCENNHYGMGTAEWRAAKSPSYYKRGDYVPGLKVDGMDALAVKQACKFAKEHALKNGPIILEMDTYRYHGHSMSDPGSTYRTRDEISGVRQERDPIERIRKLILAHDIATEKELKDIEKEKRKIVDEAIAKAKESAMPDPSELFTNVYVKGFGVEACGADRKEVRATLP

SEQ ID NO: 29614 - protein, 284 aa, Zea mays
MRAPRGGGGCRGGQEHVELIPGIPDDVAVDCLARVPHASHRAMRRVCRGWRSAAAAPAFASARAAAGANEDLVYLMQFGNPSGDDGPKDGDDGPGSTPAYGVAVYNVTTGEWRRERGAPPVVPVFAQCAAVGTRVAVLGGWDPRTFEPVADVHVLDAATGRWRRAAPMRSARSFFACAEAGGKIYVAGGHDKHKNALKTAEAYDAGADAWDPLPDMSEERDECDGMATVAGDRFLAVSGYRTARQGGFERDAEWFDPAARAWRRLDRVRAPPSAAHVVVPDEHY

SEQ ID NO: 29615 - protein, 377 aa, Grahamia bracteata
TDVPVAAAGAFKSYKLAAKAISRLQSLPSRNMLLLCDVLVKEVGELTGYDRVMVYKFHEDEHGEVISEYRRPNLEPYLGLHYPATDIPQASRFLFLKNRVRMICDCLATPVKVIQDKKLTQALSLGGSILRAPHGCHAQYMANMGSIASLVMAVTINEDEDEVKSDPSSGKRLWGLVVCHHASSRFISFPLRYACELLVQVFGIQINKEVELAAQIRESHILRIQTVLCDMLLRDSPVAIVTQSPNVMDLVKCDGAALYYKGQVWLLGSTPTQEQIKNITQWLLEYHGSTKGLSTDSLMEAGYPRASELGDPVCGMAAVRISSKDFLFWFRSHTAKEVKWGGAKHDPIDNDDERKMHPRSSFKAFLEVVKWRSQPWE

SEQ ID NO: 29616 - protein, 377 aa, Maihuenia poeppigii
TDVPVAAAGAFKSYKLAAKAISRLQSLPSRNMSLLCDVLVKEVRELTGYDRVMVYKFHEDEHGEVISEYRRPDLEPYLGLHYPATDIPQASRFLFLKNRVRMICDCLATPVKVIQGKKWAQPLSLGGSILRAPHGCHALYMANMGSIASLVMAVTINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGITPTEEQIKNITQWLLEYHGSTKGLSTDSLMEAGYPGASELGDAVCGIAAVRISSKDVLFWFRSHTAKEIKWAGAKHDPVDGDDRRKMHPRSSFKAFLEVVKWRSQPWE

SEQ ID NO: 29617 - protein, 166 aa, Brassica napus
MASRNSSSVALFFALNILFFTLTVATDCGCSPSPKPKPVPSPKPPKHVPSPSVPSPSVPSPSVPHPNPRPATPPRTPGSSGNCPIDALKLGVCGNVLSGLLNIQLGQPSAQRCCSVIQGLVDLEAAVCLCTALRANVLGINLNVPISLSVLLNKCNKKVPSGFECT

SEQ ID NO: 29618 - protein, 309 aa, Oryza sativa
MAEAKQQQQQPQAATAAAASGVWKTVKPFANGGASGMLATCVIQPIDMVKVRIQLGEGSAASVTKKMLANEGISAFYKGLSAGLLRQATYTTARLGSFRVLTNKAVEANDGKPLPLFQKAGIGLTAGAIGACVGIPADLALIRMQADSTLPPAQSRNYKNAFHALYRIAADEGVLPLWKGAGPTVVRAMSLNMGMLASYDQSVELFRDTLGAGEFTTVLGASAVSGLCASACILPFDYVKTQIPKMQPDASGKYPYTGSLDCAMKTLKSGRPFKFNTGFPVYCVRIAPHAMMTWIFLNEIQKLEKRLGL

SEQ ID NO: 29619 - protein, 472 aa, Oryza sativa (japonica cultivar-group)
MAFFRGLTAVSRLRSRVAQEATTLGGVRWLQMQSASDLDLKSQLQELIPEQQDRLKKLKSEHGKVQLGNITVDMVLGGMRGMTGMLWETSLLDPDEGIRFRGLSIPECQKVLPTAVKDGEPLPEGLLWLLLTGKVPTKEQVDALSKELASRSSVPGHVYEAIDALPVTAHPMTQFTTGVMALQVESEFQKAYDKGMSKSKFWEPTYEDCLNLIARLPAVASYVYRRIFKGGKTIAADNALDYAANFSHMLGFDDPKMLELMRLYITIHTDHEGGNVSAHTGHLVGSALSDPYLSFAAALNGLAGPLHGLANQEVLLWIKSVIGETGSDVTTDQLKEYVWKTLKSGKVVPGFGHGVLRKTDPRYTCQREFALKYLPEDPLFQLVSKLYEVVPPILTELGKVKNPWPNVDAHSGVLLNHFGLSEARYYTVLFGVSRSIGIGSQLIWDRALGLPLERPKSVTMEWLENHCKKVAA

SEQ ID NO: 29620 - protein, 141 aa, Brassica napus
MLGGNNENPLPLDSQFQYQTNSSLNQLHLLGTMRAGCTIDPINYFANDNLATMSRNNSKRARETETNHSIQRQQKLQSSLNYNYNNNSVAQDEAPKQNLVSTGLRLSYDNDERNSCANGSITTPMFQSLGDTIRLNLDRQK

SEQ ID NO: 29621 - protein, 321 aa, Nocardia farcinica IFM 10152
MSVPPLDPDVAARVAALGTVPSMRSRGIEAVRSGVEAMAPPTSMPAVAQIENHTVPGPYGPLDLRIYRSTTGPAAPVVIHLHGGGLAMGSNASFEPLARHLARASGATVVGVDYRLAPEWPAPVQVEESYAATVWVAEHARELRVDPERLVVLGDSAGGGLAAGVALMARDRGGPALFAQVLLYPGLDRDLGAASVVAMPDAPMLSREDILYLHELADAGSSRPADCYRVPAYATDLSGLPQAIVVTAAGDPIRDWGERYAARLRDAHVQTTLTRYPGVLHGFLMRPENSARALLAIAETGALLRAKFDNALPWPTRAAGS

SEQ ID NO: 29622 - protein, 174 aa, Zea mays
MAKQGAKKMKDENKKRLDLLLRIILISNVIYIVVRMAIMHSSFTWKHWIGLMVTSAGYFFPYKQLASMAKPVYFDNGELLDGGFDLSTGGVCEYLYDVIYITVFVQLMFIIFEKFWWTYLVIPAFAGYKISGLLRGAFFSGGSEGEVEDEKTRKKREKMEKKASRGKMIKTRTR

SEQ ID NO: 29623 - protein, 501 aa, Arabidopsis thaliana
  misc_feature (322)..(322): Xaa can be any naturally occurring amino acid
  misc_feature (368)..(368): Xaa can be any naturally occurring amino acid
  unsure (1)..(501): unsure at all Xaa locations
MSNNWKSVRLRLQNRTLVFLLVILSFGSCYSLKSQGDGFLESVTKDLWSDIDAEDLRAVGFHRKLLGRFRNPYTHLNAFRDRPVARATPPSSSVSTRPDAKRSSTLPPPQKSPPAQHVSAPPPFVHHVTLPSLTSSSKTSSNSTIPIVAGCIAGAVFILLLATGVFFFKSKAGKSVNPWRTGLSGQLQKVFITGVPKLKRSEIEAACEDFSNVIGSCPIGTLFKGTLSSGVEIAVASVATASAKEWTNNIEMQFRKKIEMLSKINHKNFVNLLGYCEEEEPFTRILVFEYASNGTVFEHLHYKESEHLDWVMRLRIAMGHSXYALDHMHGLKPPIVHSNLLSSSVQLTEDYAVKIADFNFGYLKGPSXETESSTNALIDTNISETTQEDNVHSFGLLLFELMTGKLPESVQKGDSIDTGLAVFLRGKTLREMVDPTIESFDEKIENIGEVIKSCIRADAKQRPIMKEVTGRLREITGLSPDDTIPKLSPLWWAELEVLSTA

SEQ ID NO: 29624 - protein, 592 aa, Bacillus anthracis str. Ames
MAETLAKRGPDDNKVWIKGNVAFGHKRLIVVDPEGGKQPMTCLKDEANYAICYNGELYNTEDIRKELLRRGYTFKGHSDTEVLLASYIEWKEECVDHLNGIYAFAVWDEQKEQVFIARDRLGVKPLFYKYDSGRLLFGSELKAILAHPDVKAEVTLEGLSEIFGLGPSRTPGHGIYTGIKELRPGHAMTFSKNGLCIWRYWNVESKKHEDSFEETVEKTRFLLQDAITRQLVSDVPLCTFLSGGVDSSAITAIAAKEYEKSGKGQLHTYSVDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQQRYEESIQEVPILDGESPLEAKRRQLFYLNMVWFMTTLLDRKDRMSMGASLEVRVPFADHRLVEYAWNIPWEMKMYKNREKGLLRKALEGLLPNDILYRKKSPYPKTHNPHYTKAVTVWIQDLLTDKGSILHELFDKEQLSGLIESGGSAFQTPWYGQLMTGPQLLAHLAQIHVWFKEYGVNIKE

SEQ ID NO: 29625 - protein, 506 aa, Bdellovibrio bacteriovorus HD100
MRGFVILDFGSQFTQLIARRLREMGFYSEIHSFEYPTEEIRKKNPYGIILSGGPNSVYEAGSPQRNVAELRNISPVMGVCYGMQLLTHQLGGKVTRAEHREYGLNYVTWSSPVQGVPERQKVWMSHGDVVEKAPEGFKIIANSDGHHPAAMQGPGVLAVQFHPEVAHTDHGMDLLKYFAQGMCKAPADWDAPHIKDILIKEAQDKVGPTDHVLVGLSGGVDSTVVATLLTKALGAERVHCVFVDNGLLRKNEYEAVLESYHRIGLNVRGVDASEEFLSALQGKSDPEDKRKTIGRVFIEVFDKSYDHKLPIKWLAQGTLYPDVIESVSSVGGSVTIKSHHNVGGLPEKMKLGLVEPVRELFKDEVRALGAQLGLPKEMLWRHPFPGPGLAIRVLGEVTKEKLQILKEADDVYISELRRRGLYEKIWQAFCVLLPVKTVGVQGDSRTYDHVLALRAVTSSDGMTADWYPFEFQFLREVSNLITNKVKGVNRVVYDVTSKPPGTIEWE

SEQ ID NO: 29626 - protein, 180 aa, Arabidopsis thaliana
  misc_feature (34)..(34): Xaa can be any naturally occurring amino acid
  misc_feature (87)..(87): Xaa can be any naturally occurring amino acid
  misc_feature (96)..(96): Xaa can be any naturally occurring amino acid
  misc_feature (101)..(101): Xaa can be any naturally occurring amino acid
  misc_feature (144)..(144): Xaa can be any naturally occurring amino acid
  unsure (1)..(180): unsure at all Xaa locations
MASSMLSSATMTASPDQATMNTPFDGLKSSDAFXGTRKANNDITSITSNDERVNCMQVWPPIGKKKFETLSYLPDLTDSELPKECDXLIRNKWIPXDEFEXEHGFVYRGHAKSPGYYEGRYWTMRKLHLFGSTDSARVLEEVQXCNNEYHNACIMIIGLDNTRQVQCIMIIAYKPPSFTG

SEQ ID NO: 29627 - protein, 300 aa, Rhodococcus sp. RHA1
MTESNDLAGRTMVVTGATSGLGLETCRQLARRGATVVLVGRDQDKIDAVIAELSENTDRDRLNSALADLSSLDRARRLSEELLHRFPRIDVLVNNAGIDVGHRQLTVDGVEEMFAVNYLAPFVLATSLAPAMAQASTADAAGYRHPARIVDVSSSGHRGGHLDFDDLDGTKDTFHGQRAYNNSKLALTLFTRELARRSDPARLVVNCADPGFVRGTSLGRGLFGYQVVGTLLTPFASDVAKAADTVVWTATATESGKFTGEYVKGCKVVQPSKDARDAELAARLWDATEALLADRGAARR

SEQ ID NO: 29628 - protein, 327 aa, Bacteroides thetaiotaomicron VPI-5482
MDNKYIGILTSGGDASGMNAAIRAVTRAAIFNGFKVKGIYRGYEGLIAGEVKELTTEDVSSIIQRGGTILKTARSETFTTPEGRKKAYKVIQKENINALIIIGGDGSLTGARIFAEEYDVTCIGLPGTIDNDLYGTDFTIGYDTALNTIVECVDKIRDTATSHDRIFFVEVMGRDAGFLAQNSAIASGAEAAIIPEDRTDVDQLETFIGRGFRKTKNSSIVIVTESPENKNGGAIYYADRVKKEYPGYDVRVSILGHLQRGGAPSANDRILASRLGEAAIQALMEGQRNVMIGIRNNEIVYVPFVQAIKKDKPIDKSLIRVLNELSI

SEQ ID NO: 29629 - protein, 745 aa, Legionella pneumophila str. Paris
MLDRASVVDEQFLKRVLQGDFPQLRSSMSPDTAELDKKTAIEFFDSQIKSRLLDIIARQLKEKGLSFYTIGSSGHEGNAVLGQVFRASDMAFLHYRSGAFFLQRAKQLPGIDGVKDILLSLVAAANDPISGGRHKVFGSVPLNIPPQTSTIASHLPKALGAALSITRARELGLPSKLAPDSVILCSFGDASTNHATSQATLNACSWITQQNYPLPIVFICEDNGIGISVPTPSSWIKSSVSSRPGIHYIECDGLNIADVFAKAQEADYLARVKKQPVFLHMRCVRLLGHAGSDIESQYNTQEEIEQREANDPLLHTAGILYREGWMSLQAMVELYQDNRALIEAKALEAIREPRMSSAEEIMASIVPRVEKKPKYPLPDDNRREQVFAGAYNQLTLKRNLCQQINFALTDLMMQYPNMLIFGEDVGKKGGVYRVTADLQARFGQRRVFDTLLDETTIIGTAIGLAHNGFIPVPEIQFLAYLHNAEDQLRGEASTLSFFSSGQYQNPMVLRIASLAYQKGFGGHFHNDNSIAVLRDLPGVIVACPSNGPDAAKMLRTCMRLAYEEGRVVVFLEPIALYMTKDLYSPGDNGWLFEYPSPDEMISQGEVGVYGEGDTVILTYANGYYLSRQAEKVLREVHNISVKIIDLRWLSPLPKDAILKEIAKAKRILIVDEGRQSGSISEGLMTLLMEEASPRLKIKRITGKDCFIPLGTAWQYLLPSQESIIDAVIALQSDKREKESGRLVVS

SEQ ID NO: 29630 - protein, 249 aa, Bacteroides thetaiotaomicron VPI-5482
MKRIVLLRHGESLWNKENRFTGWTDVDLSEKGVEEACKAGDALREAGFSFEAAYTSYLKRAVKTLNCVLDRLDKDWIPVEKTWRLNEKHYGMLQGLNKSETAVQYGEEQVHIWRRSYDVAPAPVGKDDPRNPGMDIRYAGVPDSELPRTESLKDTIGRVMPYWKCIIFPALMYKDSLLVVAHGNSLRGIIKHLKGISDTDISNLNLPTAVPYVFEFDDRLVLVKDYYLGNPEEIRKRAEAVAKQGMAKK

SEQ ID NO: 29631 - protein, 417 aa, Alkaliphilus metalliredigenes QYMF
MSEKTLNPFEIAQQQVKGACDKLGVEDAVYEILKNPMRVMEVAIPVKMDDGSLKSFVGYRSQHNDAVGPFKGGVRFHQDVNRDEVKALSTWMTFKCGVVGVPYGGGKGGITVDPRDLSQGELQRLSRGYARAIAPIIGEKVDIPAPDVGTNGQVMSWFIDEYQKTTGEFAPGVFTGKPVDFYGSLARNEATGFGVAIMARDAAKKIGLSLNGATVAIQGFGNVGSFAAIYMVGMGAKVTAISDHTACIFDENGLDIDALIEYVKGNKQVQGFPGAQKELHRDELFGMDVDILMPCALENQITLKNVNDIKAKIVSEGANGPTTPEADKIMYDKGIIVVPDILANAGGVTVSYFEWVQNLMRYSWSFEEVQEKQEKLMVKSFDDIWTLMHEHNVDMRTAGYMMSIKRIATAMKYRGWY

SEQ ID NO: 29632 - protein, 453 aa, Arabidopsis thaliana
MDEDGERRVRTKRSCSPESSDNGSGDEVDWISDLPEALIVLVLLNLPTKDVIKTSVLSTKWRNIWRYVPRLDLDNRHFTEFDSLASFIDRFMRSNRKVNKFKLRCGSDLDGDVDLATCSWKWIYMAIKRKVQHIDVTWPGVRIYPEIYNCESLVSLKLSEVTLTKPEFVSLPSLKVLVLDWVEFYNEFAFDMLMSGCPVLESFTLCRRYLDNVRVLRVISQSLLSFNYYGSSSKSFRDDLVVILDAPKLEKLKLSHQLTASFIIENLSSLVEADIDIEFNFCRGKKFDPDDLPKREMIRNFLVGLSRVKTMTIAACTLEVIYDYSRCEPLPLFPNLSFFSVEFYQKRWEILPFFFKSCSNLKSLVLESDYFPRKRTSIISEPRCLLSSLEYVKIEFALDKGKMELVRYLLENSPILKKLTLSLDHSSRKKSCVILRELITIPRCSTSCRVIVL

SEQ ID NO: 29633 - protein, 801 aa, Geobacter metallireducens GS-15
MIVTYNWLKEFVDFDLSPQELSDLLTMLGLEVEGVRHVGGGLDEVVVAVVEERSQHPNADKLSLCRVNNGKETLAIVCGAQNFKAGDKVALAQIGAVLPGDFKIKRSKIRGEESCGMLCSEKELGLAAESEGIIILPTDLPLGVPVFDALGLKDTIFEIGLTPNRADCLSVVGIAREIAAKLGTTVKYARPSVKESVVPISERAQVIVEDSDLCPRYTARYIAGCSIGPSPAWLVRRLEAVGMRSINNVVDVTNYVLMEYGHPLHAFDADLLAGGKIVVRRAAAGERFTTLDGQERVLTESDLTIRDGEKGVALAGIMGGENSEIRQETSNILLESAYFNPSAIRRTSKRLGLHTESSHRFERGADVDILVTALDRAASLIAELAGGRVATGTIDVYPRPLPRRTVRFRVDQCNRLLGIQLTADEMAAIFNRLEFKVNVVEPELFDIDVPSCRVDIEREIDLVEEVARLNGYNNIPVTMPKARVFSDRPTRHQRLEKQLRNVMVGQGFSEVITFSFMAPGILDKLLLAHDDPRRSVVRLRNPLVEEQSVMRTTLLPGLLDVAARNINYRMLTLRLFELRRVYLPAEGQELPREPLHLAGIMTGVRYREGWNQERHQVDFYDVKGVIEHILDEFAIGSVVFVQDRLDPYFHPGKACSILCGNELLGSFGELHPDIHDNFGIDQSVYYLDLDFEKLAMVSSDNVAIKPPSRFPDTFRDIAMLIKDETPASTIVECISGLRIREVECAEIFDHYKGSHVPEGFKSIAVRIRYRSHERTLVDNEVTPLHQRIVDTLVKKLAVTIR

SEQ ID NO: 29634 - protein, 380 aa, Cryptomeria japonica
FSIKGNGIGNGNGHCNGYSNGHGHCINGYSNGISASVSSNGVSHLPYSNGNTVHHSNSNGHIHTSPSFGDGRRRCFWYEEEIEDDLRWCFALNRILHTGVSEYQDIALIDTRPFGKALVIDGKMQSTEVDEFIYHESLVHPALVYHSQPKSAFIMGGGEGSTAREILRHKCVKKVVMCDIDKEVVDFCKKYLVVNREAFSNSRLELVINDARTELQSRQERFDVIIGDLADPVEGGPCYQLYTKSFYELVIKPKLNHQGIFVTQAGPAGVLTHTQVFSSIYNTLRQVFKHVMPYSAHVPSFADTWGWVMASDHPLTLEAGEIDDRIKQRIKGELQFLDGQTFLVAATLNKSVRKSLSKETHVYTEETARFIHGHGKASYQ

SEQ ID NO: 29635 - protein, 679 aa, Cenarchaeum symbiosum
MAGEEILPIGAGIASFVVAAGLAAWITRHPPGTKEQMEISEAVRVGASAFLKREMKVIVPVAVGLAVIIGAFLQPSNGIAFAVGATLSAVAGLISLKITVKAAVRAANLSSKGLGKTFAMAFRGGATVGLAVPAMALLAITGLYMIYPDPISIAGVGIGASLIALFIRIGGGIFTKAADMGADLVGKVEANIPEDDPRNPATIADNVGDNVGDAAGMGSDVYESYIVTILAALLIAALIGAPELLMFPVMVGAAGMLASIVGVVIVGSGETKDVMRPLNRSFYVSAGIAVGLNLAFTIIFLGESASAYSLFGSTLIGVALVPVIQRITDRYTNHKYGPVNEIAESAKWGYASLTLMGIIKGLQSTGPFMIALVTAIIASYALGSSFAPEGADPVLYGIFGTAMTAMAMLSLAGIVLSIDAFGPIADNAGGIVEMTGMGEESRKVTDEIDAVGNTTKAVTKGFAIASAALAALAMIQAFQFEAAHIFEGVLELDYSLTNPAVITGLLVGGLLPFIITGQLISGVSRAAMKMVDEVRRQFKAEPGILTGETKPDYARCVDIATVASIKELWKSAVIAITAPIILGILLGPTAVAGLLMGSVVTGIFLAYHLANTGGAWDNAKKLVEMRGEKGSEIHKVTVVGDIIGDPYKDTAGPALNTVIKLLNTIAIVFVSAFVSVLVL

SEQ ID NO: 29636 - protein, 225 aa, Oryza sativa
  misc_feature (166)..(166): Xaa can be any naturally occurring amino acid
  unsure (1)..(225): unsure at all Xaa locations
PPNRISSEAAAAAADDDDARDAMDMGAMSDPERMFFFDLACQNAKVTYEQNPHDADNLTRWGGALLELSQMRNGPESLKCLEDAESKLEEALKIDPMKADALWCLGNAQTSHGFFTSDTVKANEFFEKATQCFQKAVDVEPANDLYRKSLDLSSKAPELHMEIHRXQMASQASQAASSTSNTRQSRKKKKDSDFWYDVFGWVVLGVGMVVWVGLAKSNAPPQAPR

SEQ ID NO: 29637 - protein, 207 aa, Mycobacterium tuberculosis H37Rv
MPNTNPVAAWKALKEGNERFVAGRPQHPSQSVDHRAGLAAGQKPTAVIFGCADSRVAAEIIFDQGLGDMFVVRTAGHVIDSAVLGSIEYAVTVLNVPLIVVLGHDSCGAVNAALAAINDGTLPGGYVRDVVERVAPSVLLGRRDGLSRVDEFEQRHVHETVAILMARSSAISERIAGGSLAIVGVTYQLDDGRAVLRDHIGNIGEEV

SEQ ID NO: 29638 - protein, 238 aa, Medicago truncatula
MMTSHDMDPDVVRWGLHLLDVCTFPHGRSPGVVTRCDRDYSQVQYVREGFFEYSNVEHDEAVARAYQEELSHLDSMESSGRMNFENDQARVSIDAQDWLSSSNRSYNFGDESYQNPVDESCHMKRAEDCGPSERENDEHEVGVFGSSSRSGEMPIITDEMWRSLEISDESSLDGEVGKRLNQMVPIPHVPKTNKNIPSDDEEVSDHQRLLDRSRIGNCWEQLGLPQKRVEAVKSAASP

SEQ ID NO: 29639 - protein, 203 aa, Medicago truncatula
MYIETKFSTPKPHLLKLYELIESKVDGDGNCQFRALSDQLYRSPNLHKFVREQVVQQLKSDPDLYAGYVPMAYSEYLKKMSRSGEWGDHVTLQAAADWYGVKIFVITSFKDTCYIEILPQIQKSTRIIFLSFWAEVHYNSIYPEGGNKFILYTNHRNAFILFKEKEEMVELWRLGSAHKWMQLFHASVADNLTKFLALKPLVH

SEQ ID NO: 29640 - protein, 127 aa, Zea mays
LIKLLSWFMAVIQSLLIIASRKHYTVDVVVAWYTVNFFFFFVDNKLPEMADRTNGLSLLPVSTKDKDGRMKEELHKLEKDGRMMDEFHKLLNGNSIDATDWRQRVQMNGKHGEDTSHTVADATSAGT

SEQ ID NO: 29641 - protein, 252 aa, Oceanobacillus iheyensis HTE831
MTADLFTNKNIPYICTPITGKSKEEIITELHSLILEEPDLIEWRLDYFDSISDTTEVLSTLKQLTSASSIPLLVTIRSEKEGGENIPLSEKEKVQLLLEVCENSSVEMVDYEVGNDCVYVKQLREASRKYNKKLILSYHNFDYTPNRQVILKRLYQMEFYGADIAKVAVMPQTKDDVLRLLELTKEANESMDIPVVTMSMGALGSLSRIVGWAYGSIITFGLGVQSSAPGQVPIANLKRMIQMMKDTIGEWK

SEQ ID NO: 29642 - protein, 323 aa, Nocardia farcinica IFM 10152
MTVPTGHPPYRFAWDPDVAVLVAAIESHRAGTLRDGGVAAARRSLESIVRPPGPAMASVRDASIEGPHGDIPVRVYRPHTAPESDASALVWFHGGGMIMGSLHSFDRLARDIADATGAVVVNVEYRLAPEHRYPVANDEAYAALCWLHENAAAWGVARSRIGVGGDSAGGSLAAATALRSRDEAGPGIAQQVLFYPGIERRTDRPSMREFGDSPFLTAADIDWMKSLYLGEDPATDDAYGVPALADSLAGLPPAIIAVGYADPLRDAVEAYGDRLRAAGVPTAQLRYPGMGHGFAMQTANVARARAAMAEVGALVAARFRHEP

SEQ ID NO: 29643 - protein, 426 aa, Nocardia farcinica IFM 10152
MSLSENTSGSSVPRSVVVVGASHAGVHLADRLRALGYRGEITLISHEPHLPYQRPPLSKAWLKGTATAESVLLRDPAHYPDQRIELLTGTRVVRVERTTDGVAVTLRADGREWSRRFDRLVLATGARARRPALPGADHPDALVLRDLDHARALAERVPAGPIAVIGGGFIGLEVAATARALGVEVTVVEAGERLLGRAVGAGTAETLLAAHRAMATEVVLAAMPTAIVHDDTGIRAVRLADGREIAAGTVLIGIGAQPRVELAEQLGLDCAGGVVVDERCLASDGWTLAIGDCTTQVSPAGRHYRLESVDNAVEQANTAAAVLLGEPLPPRPTPWFWSDQGDHKLQIVGLTGGHDAVLVRVDPDRPRKRVALYFAEEVLIAAECLNAPADFVALRTALSRGHRPGPDELSDPAIPLKKLLLSPVAH

SEQ ID NO: 29644 - protein, 454 aa, Rhodococcus sp. RHA1
MTTAQESSSLGLQRSRPRVVIVGGGFGGIHAARRLRDVDVDVTLLDRGTSHLFQPLLYQCATGLLSEGEISSPLRHLLRGNRNVHVALGEAHAIDAVSRVLTASRFDGSTFDLPYDYLIVAAGMRQTYHGHDEYIQWAPGMKTLDDALAIRRKLICAFEMAESLPTAEERRPWLTFAVAGGGPTGVELAGQIRELAVHALAHEFQSIDPCEARVLLFHGGDRVLPSFNRKLSAAAQRTLDKIGVETHLGVHVTDVCETSIETTAKNAARTKKRYGARTILWTAGVEAVPFAEALANALGVKQIQGGRIAVEPDLTVPGHPNVWVIGDLMSLNDLPGVAEVAMQGGRHVGGCIARTVAGGTPDRKPFKYRDLGSAAYIARRHALLQAGPIRMSGFLGWVSWGAIHIAFLAGYRNRLGTLLNWAVTLASRTRRERAITYGDPQSARLPYAEPASES

SEQ ID NO: 29645 - protein, 243 aa, Shewanella oneidensis MR-1
MYQHIVVLTGAGISAESGLRTFRDQDGLWEEHHIEDVATPEGYAKDAELVERFYNSRWEQLHCGTVMPNAAHLALAKLEAEFSGQLLVVTQNIDDLHERAGSRRLLHMHGELSKGRCPRSRQTFLLREPFGVNNGCTCCIPAQRLRPHVVWFGEMPLGMDRIHDALDNCDLFIAIGTSGTVYPAAGFVDTANHHGAQTVEVNLQSPDRHSQFQYHLTGRAGELVPKLVDTILAGRVIGSDLAE

SEQ ID NO: 29646 - protein, 550 aa, Rhodococcus sp. RHA1
MSSDITGTAAWQKLRDHHAQIQSVHLRELFEKDPARGQELTVTAGDLYIDYSKHRIDRDTLGLLLELARSADLEARRDAMFAGEHINTSEDRAVLHTALRLPADASLVVDGQDVVADVHEVLDRMGDFTDRVRSGEWRGATGERIKTVVNIGIGGSDLGPVMVYRALRHYADAGISVRFISNVDPADLVRSLQGLDPATTLFIVASKTFSTLETLTNATAARRWLLGGLGLGNEAVAKHFVAVSTHADRVAEFGIDTANMFGFWDWVGGRYSVDSAIGLSVMAAIGKERFAEFLAGFHAVDEHFRTAPLEENAPVLLGLIGLWYSNFFGAESRAVLPYSNDLVRFAAYLQQLTMESNGKSVRADGTPVPTSTGEIFWGEPGTNGQHAFYQLLHQGTRLVPSDFIGFGEPTDDLPTADGTGSMHDLLMSNFFAQTKVLAFGKTAEEIAAEGTPEHLVPHKVMPGNRPSTTILAPKLTPSVIGQLIALYEHQVFVEGVVWGIDSFDQWGVELGKTQAVELQPVLTAAEEPAAQSDSSTDSLVRWYRRQRGRA

SEQ ID NO: 29647 - protein, 488 aa, Rhodococcus sp. RHA1
MMDVMDAVELMRTVPTTLFLGGEKRDAENGATFTVFDPATGDALTEVADASPADAMKALDAAVAVQREWAATPARERGELLRAVFEKITARADDFALLMTLEMGKALPESAAEVKYGAEFFRWFSEEAVRIAGRYTPAPAGNGRILVTKQPVGPCLAITPWNFPLAMGTRKIGPALAAGCTMIVKPASETPLTMLLLAEVMADAGLPKGVLSVLPTSKSGEVTGPLLDDPRLRKLTFTGSTGVGRMLVEKSAKGLLRTSMELGGNAPFVVFDDADVDKAVAGAVLAKMRNGGEACTAANRFHVANSVREEFTAKLVDKLSSYTLGPGTDPGTTLGPLINADQLEKVGELVQDAVGAGARVRLGGVAPEGPGYFYPATVLDEIPAQARILKEEVFGPVVAIAGFDTEEEGIAAANDTEFGLASYIFTRDLDRALRVADALESGMVGINRGVISDTAAPFGGVKASGFGREGGSEGIEEYLETKYVALEP

SEQ ID NO: 29648 - protein, 184 aa, Oryza sativa (japonica cultivar-group)
MHLSAGFLSCRERKGDFSCLTAARICEASTSDAVVQAAGTAMPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGTDQKPSS

SEQ ID NO: 29649 - protein, 171 aa, Geobacter metallireducens GS-15
MDELKNIIRDIPDFPKKGIVFKDITTLLADAKSFQRMVDLLAHRYVGEKIDKVVGVEARGFILGAALAYKLGAGVVLVRKPGKLPSETFSKTYQLEYGTDSLEIHTDAIRKGEKVLIADDVLATGGTMSAVVEMVRDLGGEIVECCFLAELDFLGGRKKLPDGKVFSLLTF

SEQ ID NO: 29650 - protein, 420 aa, Yarrowia lipolytica CLIB122
MRPSLGKRSSFSHFSTAQQQPISPQQQRYPPGWNPYDEEATAGSSGPHTAAKTSRYSASAAPGEPYMWEQSAQASSYAPSTGMKYAPSDYQLPRRSAYFESTMPLYSVSWSTPAADGMSCLAVGTCNDESKNKIQVVHTEGNSFNLAAEASVPYPCTKLAWDSRLDAQGKRQFATSGDCLRIWSYDSSKGFLQQRCSLSNSKSGSISPITSFDWNKVAPHLIITSSIDTTCTLWDLNTSSARTQLIAHDQEVYDVQFTAGSTDVFASVGADGSVRVFDLRALDHSTIIYDPPKPPPLVRIAGCPYDGNILATFAGNSSKVLILDIRQPGMPIDVLQQHQAPVNAIQWCPQSVVVGGQRKRLLASSSDDSQIILWNTAVPGDYHLDSAFTDSAEVNNICWSASGDWIASVTNKGVQGVRLN

SEQ ID NO: 29651 - protein, 138 aa, Glycine max
  misc_feature (14)..(14): Xaa can be any naturally occurring amino acid
  misc_feature (103)..(103): Xaa can be any naturally occurring amino acid
  misc_feature (114)..(114): Xaa can be any naturally occurring amino acid
  unsure (1)..(138): unsure at all Xaa locations
PAPDPNLYYKPVIXIVSHPGDGASRRLNKPTGASYIADYYVKFVEAESAHVDTLIYTEPPEKLLKKLELENEVLYTGGWANKWLYKETVTNSLKIIIENNDGXKAYNIISHLLXIALLTMIISQDKTILEQSNASHIA

SEQ ID NO: 29652 - protein, 298 aa, Zea mays
MHSQHLYPLPHRRLSNTMIGYLNLVTLVASIPIIGAGLWLAHGSAAVTCESALQTPLLAIGFIVLLISLAGFIGACYHVTWALWLYLLAMLLLVLALLGITVFGLAVTAAGGGGGRQVPGRPYREFRITDYSAWLQRHVEVDRYWRAALACVVGSRACPRIAAWTPLDYLQHNLTPIQSGCCKPPTSCTYNEQGIPIAAPAQDEEDCYRWNNAPSVLSYQCDSCKAGVLEQVRRDWHTITILNVIVLVLFIAIYSCGCCAFRNARRADYTYGGMSSKTNPRWDYFWSRWWNGHREQLY

SEQ ID NO: 29653 - protein, 205 aa, Zea mays
MVGWFSHCGVTRSIQAPDAAWQHDMYPAVAAGGGGGGRVSALETGTKLYISNLDFGVSNDDIKELFSELGDLKRFSIIYDRSGRSKGTAEVVFARRSDAVAAVKKYNNVQLDGKPMKIEIVGTNTPTASAALPVSNGGHARNAVRSAPRGAAPAGVPQRRPHQRGGRRSGGSGGGRRGKERSKPKSAEELDADLEKYHADAMQTN

SEQ ID NO: 29654 - protein, 570 aa, Marinobacter sp. ELB17
MPGDPSAGHFAKDAIMQGHASTPAATKAWQALLHHQQRLTTKPMAQLFAEDSQRASRYLLEAAGLTLDFSKNRLDDGALADLMALAEECQLASRRQALYAGEPVNNTENRPALHTALRASAGQTIQVNGKNVIEEVHATLEQMQQFVNAVTGGERRGCTGERFTDVVSIGIGGSFLGPKLATEALTPYHHGGIRCHYAANIDGTEICEILRQISPHTTLFLVQSKSFKTPETLENAKVAREWLVQHCPQTDAVARHFAAVSANVDAAQAFGIEADSLFPMWEWVGGRYSLWSAIGLPVALSIGMDNFRQLLAGAEAMDEHFMQAPLAQNMPVVMAMLGVWYNNLWGACSHAILPYDQYLRSLPDHLQQLDMESNGKRVTRAGVAVTYHTGPIIWGGLGANGQHAYHQLIHQGTRLIPADFIIPLVSHNPIANHHADLFANCLSQSQAMMAGKTLEQARRELIAEGRSAQDVDRLASHKVVPGNQPSNTLVMQQLTPCTLGAMMALYEHRTFVQGVIWDLDSFDQWGVELGKQLGQNILPRLLGQPAPANEGNSDSSTDALIARFRAANGA

SEQ ID NO: 29655 - protein, 687 aa, Glycine max
MTTSFGPATTSAPLKDHKVQIPSFHGLRSSSASALPRNALSLPSSTRSLSLIRAVSTPAQSETATVKRSKVEIFKEQSNFIRYPLNEDILTDAPNISEAATQLIKFHGSYQQYNREERGSRSYSFMIRTKNPCGKVSNQLYLTMDDLADQFGIGTLRLTTRQTFQLHGVLKKDLKTVMGTIIRNMGSTLGACGDLNRNVLAPAAPLARKDYLFAQQTAENIAALLAPQSGFYYDIWVDGEKILTSEPPEVVQARNDNSHGTNFPDSPEPIYGTQFLPRKFKIAVTVPTDNSVDILTNDIGVVVVTDDDGEPQGFNIYVGGGMGRTHRLETTFPRLAEPIGYVPKEDILYAVKAIVVTQRENGRRDDRKYSRLKYLISSWGIEKFRSVVEQYYGKKFEPFRALPEWEFKSYLGWHEQGDGKLFYGLHVDNGRIGGNMKKTLREVIEKYNLNVRITPNQNIILTDVRAAWKRPITTTLAQAGLLQPRFVDPLNITAMACPAFPLCPLAITEAERGIPNILKRIRDVFDKVGLKYSESVVVRITGCPNGCARPYMAELGLVGDGPNSYQIWLGGNHKQTSLARSFMDRVKILDLEKVLEPLFYYWKQKRQSKESFGDFTNRMGFEKLKEYIEKWEGPVVAPSRHNLKLFADKETYESMDALAKLQNKTAHQLAMEVIRNYVASNQNGKGE

SEQ ID NO: 29656 - protein, 77 aa, Zea mays
VSLQTLKPVIDRANPKIGIGMLAFSPDIYFLATRNDNILNAVWVWDIQKLRLFAVLVQLSPVSAFQWDPQHRRMAIC

SEQ ID NO: 29657 - protein, 412 aa, Oryza sativa (indica cultivar-group)
MDHDPKERLLLPPRAAAAAAANGPHRRAAPAAGGGGGGVAIDVHGLKRRGGGRRSWVRVDAATGASEAVEVAKPALMRRLDLPARDLRLLDPLFVYPSAILGRERAVVCNLERIRCIITADEALILRDPDVAGGGAETEEAVRRYVAELQRRLVDRADDLPFEFIALEVALEAACSFLDAQAVELEADAYPLLDELTTKISTLNLERVRRLKSKLVALTRRVQKVRDEIEQLMDDDGDMAEMYLTEKKRRMEASLLEEQAFQGMGNSGFGSSFSAPVSPVSSPPASRRLEKELSFARSRHDSFKSADSSQYSIEELEMLLEAYFVVIDYTLSKLTSDNVRNQLIQFELLLTTATFVVAIFGVVSGVFGMNFEVDLFNVPHAFEWTLVITGVCGLVIFCCFIWYFKKRRFFPL

SEQ ID NO: 29658 - protein, 439 aa, Cenarchaeum symbiosum
MEQAGEQALSSVVWHPNTQMGEWDEFGEIVQGRGMHLIDKKGRKLLDGVASMWCNVWGHSRPELVRAITRQAARLQHSPLFNLTNGPAEELARMLIETIPGMHRVFYSDNGSTAMEVAFKMAIQYWSNEGDSGRNRIAALSNGYHGDTFGAMSVGYMPGFFGAFKGQLFPAVRFDAPGGREAPGGPTDKEIEEECLGNMEERFADGTIAALAMESGAQVAGGVRIYPRGFQRRVSRICKRHGVLLILDEVATGLGRLGSMAEYEAQGGRPDIAAYGKMLTGGYLTMSATLATKKVYDSFLGGYDENRHLFHGHTYTGNPLAAAAAIENLRMYKRRNLLDKVAKGARVLGGYTEEISGMGRVSDVRHAGMLMGIELSRGAPKGGPSTNKIIFEAGRRNGVYLRTLGDVVMLVPPLAMGPADLRRLVEGTVRAVREAPLDG

SEQ ID NO: 29659 - protein, 498 aa, Acinetobacter sp. SE19
MGGIPHIPFCLTSVICQGCLIMNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 29660 - protein, 452 aa, Clostridium perfringens ATCC 13124
MEKQNLKNTEVNLIYGVDDDLDLPKKVLFGLQHIFAAFGGIIVVPLVIATSLGFDSKVTTALISASILGSGLATIIQAKGVGKVGARVACIMGTDFTFVSPAISVGSVLGLPGIIGATILGSLFEVILSFFIKPLMKFFPPLVTGTVVALIGLTLLPVSIDWAAGGAGSANYASLENLAVAMFVLVITLLLNNYGKGMISSASILIGIVVGYIVCIPLGLVDFTPVKEASWLSFPKILEFGVTFDAKAVMAFIPAYFVATIGTVGCLKAIGETSNIDIGDKRVAAGVLSDGVGSALGGLVGSCPNTSFSQNIGIISLTKVASRHVAVMAGILLVILGFLPKVAAIITGIPNPVLGGVGIMMFGTVAAAGIRTLSNIKLTERNLLIIAISMGLGLGVTFRPDVIHNLPEAIRMIFSSGISTGTIAALILNAVLKESPTSMEFENMYDEETKAS

SEQ ID NO: 29661 - protein, 427 aa, Legionella pneumophila str. Paris
MKVNDRFNALKILTALMESRKNLSYLMSPQEISPMTKEICYGFCRHYFRLQSIADTLINKRPKDNEVWIVLLIGIYQLQYMNKPDYAVVKETVSLLGQVKKSWAKGLVNAVLRNFCRRQDHILEKLAAEPVFIYGQPNWLLQRLQKDWPNDWQFIAEANDRHPPMTLRVNVLKHSVDEYLDLLKKSGIEAFKHPVAPDGITLAIPCDVMTLPGFAQGSVSVQDAAPQLAAYLLSLKPGQRVLDACCAPGGKTCHILEKESGLASCVALDLDPQRLQRVRDNLNRLDLQATVVEGDVLEPRSWWDGHPFDRILLDAPCSATGVIRRHSDIKLLRTDEEISAISQVQSSMLNSLWPLLAPGGLMVYATCSIMSDENELQISRFVAEHPDCQVSDGKWSWGRWTGHGQQILPGEHGMDGFFYSVLRKDEK

SEQ ID NO: 29662 - protein, 285 aa, Burkholderia thailandensis E264
MSTTLLFHPTPDVAYGFPNARRLARIESAHQEIEVWETSLLGRLFTLDGRPMTSVGDEFVYHECMTHPAALAHPAPRKALVLGGGDGGAARQLLRHPCIERIVVAELDAAVVDMARRFLGDVHQGALDDPRVELVIGDAARYVDHACEHFDLAVFDLTPPDSPAAGLYTPKFYTRLKRILTPQGAVSLHLGSPLYHEARVVSLLAGLRASFAVVAPLCAHVPLYGSPWLMAIASDALDAASLFSHDVEARLAERRIEGLRFYDAKLHPALFTLPHALRDTLGMHR

SEQ ID NO: 29663 - protein, 618 aa, Arabidopsis thaliana
MDRVSNLPEEVRCHILSFLPTKHAALTSVLSKSWLNLWKFETNLDIDDSDFLHPEEGKAERDEIRQSFVEFVDGVLALQGDSPIEKFSLKCITGIHPDHVNRWICNVLQRGVSDLYLFTDFSDEDTEEDGGYRLPQEMFVSRTLVKLKLRSEHCVNWWHWDIGASLPNLKSLNIDSDLIFFGEMEKFLSSFPVLEEVHMANMEWRELDETMSSASLTKLSIHGTGVEEFEHPKSISIDTPNLLYLNYSDLVAEDYPLDDEGDVVLQFCNVVKLINGIQNIQTLYLTEDTLEVLTMCCESMPVFNNLKTLGLKSDEGRGWQAVPALLRNCPHLEFLIIEGLLHSVTDKCGDACDCISREDKGRSLISCPVKKLEVRGFRGTIREKEMIRHFLEYFPCLDEMEIDAEENDSTNFEVPRILKVVAYRLHDVVSTEIVGHWQSSAQSGGWSQTQMDEMYYELAPRNKERIYDMFFFMRRASSTVPPPPPQEMSQDYLQMQLEVADLKERQRDQEAKLADLKERLRAMLDMIVDQNPIIASALRAREATNSEREKASSGQEMTEKERDYDALFDIIVEQNPMLASAVRALRATDSERAETSSNQEMTELGQATATYFPPREGE

SEQ ID NO: 29664 - protein, 694 aa, Botryotinia fuckeliana
MTYTNMLSRQPASSLGRIGSNSLLLRRSPYSSLSRSALSFNSLPGQKFSTGSRRPLTALTNQTQWGKLPITRNVRFVSGKPLPQRRSKALNFLYRSAALLGGSLIVLGVGVVGFFVYDATTYREDLSYSDISISELALSPRLGGPKDLPIAEVQIDDDDSEEMQKQKDKPKLVILGGGWGNVALLKTLNPDDYHITLVSPTNYFLFTPMLPSATVGTLEFRSLVEPIRRIITRVKGHFIRATAEDIEFSEKLVELAGKSPDGKEVRFYLPYDKLVIGVGSTTNPHGVKGLENCHFLKDIDDAQTIRNSILTNLEYACLPTTSDEERKRLLSFVVSGGGPTGVEFAAELFDLLNEDLTAHFPRILRNEISVHVIQSRGHILNTYDEAVSKYAEERFARDQVDILTNSRVQEVRPDKILFTQKGENGESIVKELPMGFCLWSTGVSQTRFCQRIAAALGSSQTNRHALETDTHLRLKGTPLGDVYAIGDCATVQNNVADHLVTFLRTLAWEKGQDPEKVQLTFRDWRDVAQKVRKRFPQAADHLKRVDKLFQEFDKDQSGTLDFGELRALLMQIDSKLTSLPATAQRAHQQGQYLGHKFNKIARAEPGMRVNDMRDGDLDEAIYKAFEYHHLGSLAYIGNSAVFDLGGGWSFAGGLWAVYAWRSVYFAQSVSFRTRCLLAMDWAKRTLFGRDLMNW

SEQ ID NO: 29665 - protein, 225 aa, Brassica napus
MATSSHLFPQALHMIPRNPTQPSKKLGFSSFQSCAPSMNPPRLSVSRLSLNHSVSKSSFSLDAKARREVLVRAEGEGEGEGEAEEGVDEGNVEDVVEAGEVKAPKKTRVKLGDVMGILNQKAIEVSEKLRPVPEIRTGDIVEIKLEVPENRRRLSIYKGIVMSRQNAGIHTTIRIRRIIAGIGVEIVFPIYSPNIKEIKVVSHRKVRRARLYYLRDKLPRLSTFK

SEQ ID NO: 29666 - protein, 388 aa, Yarrowia lipolytica CLIB122
MIRRLALGRSLRPSLFPALHSQPFQRRFNSSIPQKAEAALDTVERDIEKTADAASNLTEKVLDKVAPIQTHIQQFPDHVSTHAPDTIGYFQSLDITGSLWSLWPSDIYLNLLEHVHVYTGLPWWAAIASTTVIVRVLLFPLFVQAANEQGKMSEVKPELNVIDEKLKSAANMTEMQMVAHEKKKILKKYGISQMKLFYPMAMFPLTIGIFLGIRRMCEIGGVQGLSTEGVLWFQNLAAPDPYLGLQVITAAMYMASIRLGSETGTNNLSPGMKKILQWAPWISVPFLMKMPAALLLHFFVNGILMLIQGVALRNPFFRKKLGIHEIVPLPAAAPGASGKTDSVRDTIRNAIDKRKRDAAMQKKEDDKNAELSKLAAKRAEGVVLKRRK

SEQ ID NO: 29667 - protein, 589 aa, Candida albicans SC5314
MLELNSITIPRNFTEFQLTALKIYYQLKILFLATYCTQGSLGLNGSVCLARDIFVGYVVYTQLLKLYRVLRGYGIIDSIRRLYLYVSSIVSSQIFSLPFIKSKIDKELQATIGKVEEEIMKNDPQLLQFPELPEQGIDADNVSLELDKLQNLKHSDWINGRVSGAVYHGGENLLSLQVEAYKKYSVANQLHPDVFPGVRKMEAEVVHMVLDIFNAPSDGCGSTTSGGTESLLLAGLSAREYGKKYRGITEPEVIAPVTIHAGIEKACFYFGMKLHKVDLDPVTFQVDVKKVERLINSNTVLICGSAPNYPHGIIDDIESLSKLAVKYNIPLHVDACLGSFIVSFLEKSKVHGDRKLPIFDFRLPGVTSISCDTHKYGFAPKGSSIIMYRSPKLRECQYYIASDWTGGMYGSPTLAGSRPGALVVGCWATLINIGKQGYTKFCYDIVSASMKVKRAIETDPILSKHLQIIGDPIGSVISFQLAPQQSGNLSIYEISDLLTKKGWHFATLQNPSALHFAFTRLTVPVVDELIADLVEATKEAVAIAEEHKKNGVTKAPGDTAALYGIAGSVHTAGLADRLIVAFLDTLYKI

SEQ ID NO: 29668 - protein, 758 aa, Oryza sativa (japonica cultivar-group)
MILGHPSVVFNERGEREKLLVESAENFVKEFELLIKTILDGSSGACILKQPILDDLSPGSSNYQESSAVVADRKKFRSQLASFDKAWCAYLYHFVVWKAKDAKSLEEDLVRAACKLELSMMQTCKFTAEGQPENLNDNLKAIQKEVMVDQTLLREKVRHLGGEAGIERMEVALSEARTKFFEAKGNRSPLATTIKNVAATCSSGESPISDMKENSNINDKRPSQAVQSMFRVPSSPSESNTAGITMSNPMTVSSTLSEKRPTENEQMVNEILHGFLADSSSNIGTVEGGFKEKVRETMEKAFWDVVVDSLRGDMPDYSYLVQLVKEVRDTLYEMVPKGWKEEIINNIDLEILLQVLESGTQDMQYLGQILQYSLGMLRKLSSPAKEDEMKRSHDKLLGELTEHSECNNSGSNSFVIAVIKGLRFTMEELKALKTEVSRARIQLLEPIIKGSGGVEYLQKAFADRYGFPSNASVALRSTAQWISTSKDTVEVEWNEHVSSFSALPETDHAQPFVATLRSGHGVPDQRQSTIPVSDDTGLPECTGQRLDQLIRIGLLQLISGIEGVQMQSVTETFKLNWLRLRSVQSQFQQVIVIATSMLVQRQVLATDDPNITPTELESATSQLFNTLAELLDNFPDVSTAKIMEVMLRSSSSSSSGSTTGSPSDERTESRKQILARVFLKSLQTDDPVFKKVSRSVYCAFRAITLGGSGARGRKLADAALRRIGATKLTDRVVRSAEILIRAASISQQVHGPWYNHLV

SEQ ID NO: 29669 - protein, 671 aa, Zea mays
AAGDLCLHKLGANLYERIKKECEIHIAEKISALVGQSPDLVVFLSLVQRTWQDFCDQMLIIRGIALLLDVKYVKNVANICSVWDMGLQLFRKHLSLSPEIEHKTVTGLLRLIESERLGEAIDRTLLSHLLKMLTALGMYSESFEKPFLECTSEFYATEGVKYMQQSDIPDYLKHVESRLQEEHERCFLYLEANTRKPLIATTETQLLDRHTSAIIEKGFAMLMDANRINDLLRMYNLFQRVNAVELLKQALSSYIRATGQGIIMDEEKDRELVPFLLDFKASLDKILEESFAKNEAFSNTMKDSFEHLINLRQNRPAELIAKFLDEKLRAGNKGTSEEELEGILDKVLVMFRFIQGKDVFEAFYKKDLAKRLLLGKSASIDAEKSMITKLKTECGSQFTNKLEGMFKDIELSKEINDSFRQSSQARTKLPSGIEMSVHVLTTGYWPTYPPMDVKLPHELNVYQDIFKEFYLSKYSGRRLMWQNSLGHCVLKADFPKGKKELAVSLFQSVVLMLFNDAQKLSFLDIKDSTGIEDKELRRTLQSLACGKVRVLQKIPKGRDVEDKDDFVFNEDFSAPLYRIKVNAIQMKETVEENTSTTERVFQDRQYQVDAAIVRIMKTRKVLSHTLLITELYQQLKFPVKPADIKKRIESLIDREYLERDRSNPQIYNYLA

SEQ ID NO: 29670 - protein, 128 aa, Marinobacter sp. ELB17
MTNKSIIETENAPQAIGPYSQAVKAGDTVYISGQIPLVPETMELVQGDFAANARQVFDNLKAVCVASGGSLQDIVKLNIYMIDLANFAVVNEIMATYFQKPYPARAAMAVAALPKGVPIEMEAVMVLT

SEQ ID NO: 29671 - protein, 99 aa, Bacillus megaterium
DLPTFRPGDTVRVHVNIVEGTRERVQVFEGVVIKRRGGGISETFTVRKISYGVGVERTFPLHTPKIAKIEVMRRGKVRRAKLYYLRELRGKAARIKEIR

SEQ ID NO: 29672 - protein, 405 aa, Zea mays
  misc_feature (83)..(83): Xaa can be any naturally occurring amino acid
  unsure (1)..(405): unsure at all Xaa locations
SCCKGGAAAAAYARTKGQQDKAASGGNGGGDGAAARAGEQLVIRAPVHGDGCGRKLRRSRQRHANVGEVTVDSRTDTVVVRSXGAVENAAEVVQVVERKTGEKAVLLSPSPPEKLLLPPRSSAPKAKGGETNTNKDIGNELPELDMKMVTVLKINLHCDACSEEIKRRILKITGVEEAMPHLKSSQVAVKGKVEPATLVGFIHKCTGRRAAIIRAEPLDDALLPQPPNPPAAPPSKAESKKDEPPAENPPAKVEDEENRGGGGKDNADDDNPKTEKPASDGHGAAEEHGAHATTEAPDRDNDDDAGDGLVLENHTKAAVDRLFAVPTPAGGVVTVVAPEMALGSRSYCYPAYPCAQYYYPYQPHLYPPQPYPAASAYSPVAMYGYPAGYPPEAFSEENPNACTIV

SEQ ID NO: 29673 - protein, 149 aa, Glycine max
MAEQTFIMIKPDGVQRGLIGEIISRFEKKGFYLKGLKLVTVDRPFAEKHYADLSAKPFFSGLVDYIISGPVVAMIWEGKNVVTTGRKIIGATNPAQSEPGTIRGDFAIDIGRNVIHGSDAVESANKEIALWFPEGPANWQSSQHSWIYE

SEQ ID NO: 29674 - protein, 123 aa, Bdellovibrio bacteriovorus HD100
MAKETNLVRRVSVKAANKNIQSFNSGDTVNVFVKVKEGEKERVQLYKGIVTKIQGSGAAKSFTVRKMSAGVGVERTFPFASPALDKVEIVNVGKVRRSKLYYLRALKGKAAKIESELVSSKAE

SEQ ID NO: 29675 - protein, 541 aa, Vibrio cholerae O1 biovar eltor str. N16961
MKFQYDFVFLNQFSCKKLISFYRIIFPSKKVAVFYMIYPIPNSETSTVHFKDVYDNYIGGQWMKPHSGEYFSNTSPVNGLVFCRVARSSSQDVELALDAAHNALESWSTTSAVERSNILLRIADRIESNLETLAIVESWDNGKPIRETLAADLPLTIDHFRYFAACIRSQEGAASELDSRTLTYHLPEPIGVVGQIIPWNFPLLMAAWKLAPALAAGCTVVLKPAEQTPVSILFLMEIIGDLIPAGVINVVNGFGSEAGNALATSQRIDKLAFTGSTEIGNHILKCAADNLIPSTIELGGKSPNIYFPDIFSHEDQYLDKCIEGALLAFFNQGEVCTCPSRILVHESIYEKFIAKIIERVALIKQGNPLDTETQIGAQVSKEQYDKILGYIQIGKDEGAELIFGGHPNNQENYLSGGYYIKPTLFFGHNQMHIFQEEIFGPVIAITKFKDEIEALHLANDTVYGLGAGVWTRDINIAHRMAKNIKAGRVWVNCYHAYPAHAAFGGYKKSGIGRETHKLTLSHYQNIKNVLISHEIHPLGLF

SEQ ID NO: 29676 - protein, 425 aa, Oryza sativa (japonica cultivar-group)
MQVELADRAAARPSETGEAPPSSPAAAAAASAAAEDAPLLPGGGGGVRRRVVVSERFRQRSGSFRREVRRAAEETYLLTRLTLILLRYLGIGYRWIRQFLALCCYTFLLMPGFIQVVYYYFFSSQVCRSVVYGEQPRNRLDLYIPTDRTGLKPVVAFVTGGAWIIGYKGWGALLGRRLAERGILVACIDYRNFPQGTIGDMVEDASQGIAFVCNNIASYGGDPERIYLVGQSAGAHIAACTLLHQAIKESGEGDASTWSIAQLKAYFGISGGYNLLNLVDHFHKRGLYRSIFLSIMEGEESLQKFSPLVMVKDPAARSAVSLLPRIFLFHGTSDYSIPSAESEAFFDALQQNGAKADLFLYDGKTHTDLFLQDPLRGGRDKLLEEIVTVIHNDNPDTSAQHLAVPVARRLVPEFMLMLAGRVSPF

SEQ ID NO: 29677 - protein, 615 aa, Glycine max
  misc_feature (311)..(311): Xaa can be any naturally occurring amino acid
  misc_feature (315)..(315): Xaa can be any naturally occurring amino acid
  misc_feature (336)..(336): Xaa can be any naturally occurring amino acid
  unsure (1)..(615): unsure at all Xaa locations
ISHFISSLRPPRFPRNGIPCTASPEIRRPSDRFYGSSPSTSRPEDLNLFLELLPLTLRRELYLHTEIGGLIEVVMDLGRKPLARFPSGDWVISEQPIAQEDLRHAISKVGEFSDDNRSGIDRSLHRISAIRNRKMQIIGLTCRVGRAVGGSAEIIRDLVEDGGSILVIGPPGVGKTTLIREIARMLADEFRKRVVIVDTSNEIGGDGDVPHAGIGRARRTQVPNVNMQHGVMIEAIENHMPETIIIDEIGTELEALAASTIAQRGVQLVGTAHGMTIENIIKNPYLQILVGGIEVQSCTFNFPFTFMIYNXIMIXLNALLCFGPPLLSQSESVLNXEPHTNGMCSAFPHFVTLGETSDLTNNDITSSEIESSKDDKDHPRTWSTNWSTSVPVMTRSSRMQVYTYKILEADLLQVAKVMGLEDVIDVTDDIGTAEAILASSSEIRQNPWIRGVAKFHHVPVFVIKSNTMAQVVKAVRMILGLEFFGPTPKKALNECLDIEIEDDEPKRKPSLEEIDALEEVRLAIEYIVIPGGEAVELLPRRSEIIARQLELVQSYQLAAEKSGSDQNPRLQILPLRLNTKKPSKSTIGRKKTSPTSMSTGDSGNGISVTKASYFS

SEQ ID NO: 29678 - protein, 189 aa, Campylobacter upsaliensis RM3195
MKRVLVPLAVGFEEAEFIGIADVLKRASAMSGNLELIIASLDSELWVKGANGICIKAECSLESVDTKSLDAIALPGGFDGMNNLKNNGTIISIIKKLHNDKKIVAAICASPIVLHAAGVLSEEFACYPGCETGLKGQRLEKAVLVRDNVITGAGPATAILFGLELAKALCGEEIYKALYEGMLVPLSKA

SEQ ID NO: 29679 - protein, 456 aa, Gibberella zeae PH-1
MLSAALRRRVLAPTHSALRTGFAAHVVRHYASFPEHQVIKMPALSPTMQAGNIGAWQKKIGDSIAPGDVLVEIETDKAQMDFEFQEEGVIAKILKDAGEKDIPVGSPIAVLVEEGTDVAAFEKFSVEDAGGAAKPAAPKEEKSESKSESASTPEPSSEPQQYESQGRLQTALDREPNIAAPAKRLAREKGISIDGIKGTGKNGQITEADVKKAVSSPAASAASSAASYEDIPISGMRKTIANRLVESTQTNPHFYVTSSLSVSKLLKLRQALNASADGKYKLSVNDFLIKAIAVASRKVPQVNSSWRDGNIRQFNTVDVSVAVSTPTGLITPIVTGVEGRGLEAISAQVKSLAKKARDGKLKPEEYQGGTISISNMGMNPAVDHFTAVINPPQAAILAVGTTKKVAIPSDNEAGVEFDDQITLTASFDHKVVDGAVGAEWLKEVKKVIENPLELLL

SEQ ID NO: 29680 - protein, 1413 aa, Aspergillus nidulans FGSC A4
MADLKPPFTEEAARAKVKIAQNLWNAQDPVRVSQAYTPGCIWRNRTSFFSGTEAIVDFLTAKWKRERNYRLRKELFSFTDNRIAVQFWYEFQDANDSMRWKRCYGLEDWTFDRESGKMCKRMMSGNDILLGPDGNGEGRCDYRLLTQRWDHPTYHPYNRNRRLQQLDLNHFCRARISLAMEETSPFPDSKTMRSPLTDASNRINNCHTPTTERRLMREEHALTSPVPMSIVDSPLSPRNNAENNGPPPVGDSRACSKRNSAVSAASIVSAKGKRKTHVGPWQLGRTLGSGATGRVRLAKHAVTGQTAAVKIVSKKCAAISQSDSIAAMDRNAGTFIGAGGRQMPSGIEREVVIMKLIEHPNVISLYDVWENRGELYLVLEYVEGGELFDYVSNHGPLPEEEAVRLFRQIIAGLGYCHRFNICHRDLKPENILLDGEHNIKLADFGMAALQPAGHWLNTSCGSPHYAAPEIIYGRKYRGDKADLWSCGIILFALLTGFLPFDGEDLHATLQLVRKGDYMIPPHVSAEAADLIQRILQKKPDDRISMKDIWKHPLLKKYEKFHQAICNHYLGPPPPLSPQDCGPPVVRQDIDVDLLRNLQTLWHDVKPERLIEKLISLEPTQERLFYHALVKFRNEQLENYEGQPLRYSTSDYHHISRGQARLSKHLRSRSQNGSQRRSRAPSVKETGKRRPSTRELKPSASVETYDPYRSPFNRVPDKSPQYAHVTIHREAPETSPKPAEVEVDSSNPFLDDEQEIECQQSPPFTLVRKRKQNFNSVKSFQSKTSLISSRRALNSASTPRSVSYKRNVTFHHNRNRSQSSASAKAKRAHCNRQPSEASLISGFDDDPFSDSRSSSLLPAQPAVVRGAGIAVKNSVQRRVQHSDFVWRDEARKVSHELSQICEEAFNGSSLSTGCTDTTCVSPETPATSVSLASPGVSNHQMDSSSSTVCLAATPPADSPKTSHVRRELEETRRRLIEHSMKDGSKEIPQCLAPVIDHLDRLIEQEKTRRPGKVSTKEDYSSMSDLFCGSPVEPTQLSVLSEELNTGRRSDDTPSSKKDRQVSGSTAASSQISRGKRSIRMVPHSSYQSISNTEPRAVHRPAAALIDRPENDRGNALASRVGSNHRHNRTPCELDPIDEHPASPRRSAVRSTDHKKWSWFRKSQNIEEDFVKAPTVVKPLHPSSATVIVHEVHPARNTAENQPKLGKPPSDSQKVSFWSFIKRKKGKNADPESTATNPVLESRRDDERQRAHPGPKLSENKTATKPRRSIRSSGISNNWFARVFQFKPATRVVALNASKIKGRKEIYKMLRDWKQYGMEDIYLDKPNSIIYGRVGESNFLHLRPVDFSADFYTVIEDGRQANLSVVRFRQERGAASSFNRVVDTLCMVMKQRGLLVEDPARAKRMAQVLDAFPNA

SEQ ID NO: 29681 - protein, 377 aa, Shewanella sp. ANA-3
MSKRDYYEVLGVGRDASEREIKKAYKRLAMKFHPDRNPGDKAAEASFKEVKEAYEILTDANKKAAYDQFGHAGVDPNRGGGGGYGGAGDFGDIFGDVFGDIFGGGRRGGQRQAARGSDLRYNLELSLEEAVKGLTKELRIPTLASCDVCDGSGAKKGSSATTCGTCHGQGQVQMRQGFFTVQQPCPTCHGRGKIIKDPCSKCHGDGRVEKTKTLSVKIPAGVDTGDRIRLAGEGEAGEFGAPPGDLYVQVTVREHAIFVRDGNNLYCEVPISFSKAALGGEIEVPTLDGKVSLKIPAETQTGRMFRLRGKGVKSVRSHAVGDLLCKVVMETPVNLNERQKELLREFEATLTGESKKHSPKAEGFFDGVKKFFQDLNS

SEQ ID NO: 29682 - protein, 371 aa, Arabidopsis thaliana
MGGSGNWIRSLISNRKPVNDQQEKLSDKSSKKKWKLWRISSESLASSSFKSRGSYAASSLGSELPSFSADEAFTTAMAALIRAPPRDFLMVKREWASTRIQAAFRAFLARQAFRALKAVVRIQAIFRGRQVRKQAAVTLRCMQALVRVQSRVRAHRRAPSDSLELKDPVKQTEKGWCGSPRSIKEVKTKLQMKQEGAIKRERAMVYALTHQSRTCPSPSGRAITHHGLRKSSPGWNWYDDVGTFSRKSSESSVLSEYETVTVRKNNLSSTRVLARPPLLLPPVSSGMSYDSLHDETSTSSTSQSPVAFSSSVLDGGGYYRKPSYMSLTQSTQAKQRQSGLSCNGDARRSAGSDQCTDLYPPGNVWAKSQRS

SEQ ID NO: 29683 - protein, 260 aa, Triticum aestivum
  misc_feature (237)..(237): Xaa can be any naturally occurring amino acid
  unsure (1)..(260): unsure at all Xaa locations
PAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWDXDITEDTAEEEIREAPKHDSSEGQ

SEQ ID NO: 29684 - protein, 473 aa, Magnaporthe grisea 70-15
MASAMRLSSAFRATARAPAFTARRTAFNGMRCYSAKTQTLKERFAELLPEKIEEIKSLRKEHGSKVIDKVTLDQVYGGARGIKCLVWEGSVLDSEEGIRFRGKTIPECQELLPKAPGGKEPLPEGLFWLLLTGEVPSEAQVRALSAEWAARSDLPKFVEELIDRCPNDLHPMAQFSMAITALEQTSSFAKAYAKGINKKEYWGYTFEDSMDLIAKLPTIAARIYQNVFKGGKVAPVQKDKDYSFNFANQLGFGNNSDFVELLRLYLTIHTDHEGGNVSAHTTHLVGSALSSPFLSLAAGMNGLAGPLHGLANQEVLNWLTEMKKSVGDDLSDKSITDYLWSTLNSGRVVPGYGHAVLRKTDPRYTAQRVFAQEKMPNDPMFKLVSQVYKIAPGVLTEHGKTKNPFPNVDAHSGVLLQYYGLTEANYYTVLFGVSRAIGVLPQLIIDRAVGAPIERPKSFSTEKWIEIAKKTAA

SEQ ID NO: 29685 - protein, 522 aa, Candida tropicalis
MSIQDIVETYSTKWYVVVLVALIVYKVFDFFYARYLMYKLGAKPFLQSQTDGYLGFRVPFELMGKKSEGTLIDFTYQRTLELDNPDIPTFTFPIFSVLIISTLEPDNIKAILATQFNDFSLGTRHSHFAPLLGDGIFTLDGAGWKHSRSMLRPQFAREQVSHVKLLEPHMQVFFKHIRKHHGQTFDIQELFFRLTVDSATEFLFGESVESLRDESIGMLNDALDFDGKAGFADAFNYSQNYLASRALMQQMYWILNGKKFKECNAKVHKFADYYVEKALELTPDQLEKQDGYVFLYELVKQTRDRQVLRDQLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 29686 - protein, 524 aa, Candida tropicalis
MATQEIIDSALPYLTKWYTVITLAALVFLISSNIKNYVKAKKLKCRDPPYFKGAGWTGISPLIEIIKVKGNGRLARFWPIKTFDDYPNHTFYMSIIGALKIVLTVIQENIKAVLATQFTDFSLGTRHAHFYPLLGDGIFTLDGEGWKHSRAMLRPQFARDQIGHVKALEPHIQILAKQIKLNKGKTFDIQELFFRFTVDTATEFLFGESVHSLYDEKLGIPTPNEIPGRDNFATAFNTSQHYLATRTYSQTFYFLTNPKEFRDCNAKVHYLAKYFVNKALNFTPEEIEEKSKSGYVFLYELVKQTRDPKVLQDQLLNIMVAGRDTTAGLLSFAMFELARHPEIWSKLREEIEVNFGVGEESRVEEITFESLKRCEYLKAILNETLRMYPSVPVNSRTATRDTTLPRGGGPNGTDPIFIPKGSTVAYIVYKTHRLEEYYGKDADDFRPERWFEPSTKKLGWAYVPFNGGPRICLGQQFALTEASYVITRLVQMFETVSSPPDVEYPPPKCIHLTMSHDDGVFVKM

SEQ ID NO: 29687 - protein, 484 aa, Rhodococcus sp. RHA1
MTDFERLRATLPTGLWIDGAQTDPIDGGTFPVYDPATGTLIADVADAGGKDAMRALDSAAAVQEEWAATAPRQRSIILRSAWEKVIERTDDLALLMTMEMGKALPESRGEVNYGAEFLRWFSEEAVRIQGRYTTSPSGSGRIMVTKVPVGPTLAVTPWNFPLAMGTRKIGPALAAGCTIIVKPAEDTPLTMLLLAEIFAEAGLPAGVLSVLPASNAAAVTEPLLADPRLRKVTFTGSTRVGKILIEQSAQQVLRTSMELGGNAPFVVFDDADIDAAVEGAMAAKMRNGGEACTAANRLIVANSVREEFTTKLTDRIAALTVGPGSEEGTNVGPLVNEKQRRNVASLVDDAVAAGARVRTGGKSVDGPGYFFQPTVLDEVPANARIVREEIFGPVAAITGFDTEAEGVAAANDTEYGLAAYIYTQNVDRAFRVADKLESGMVGVNRGVISDVAAPFGGVKQSGLGSEGGTEGIEEYLETKYVGFA

SEQ ID NO: 29688 - protein, 507 aa, Candida tropicalis
MIEQVLHYWYYVLPAFIIFHWIVSAIHTNSLRRKLGAKPFTHTQLDGFYGFKFGRDFLKAKRIGRQVDLINSRFPDDIDTFSSYTFGNHVIFTRDPENIKALLATQFNDFSLGGRIKFFKPLLGYGIFTLDGEGWKHSRAMLRPQFAREQLPMSPSLEPHFNVKAYPQEQRWVFDIQELFFRFTVDSATEFLFGESVNSLKSASIGCDEETELEERKKFAEAFNKAQEYISTRVALQQLYWFVNNSEFKECNEIVHKFTNYYVQKALDATPEELEKQSGYVFLYELVKQTRDPNVLRDHHSISLLAGRDTTAGLLSFAVFELARNPHIWAKLREDVESQFGLGEESRIEEITFESLKRCEYLKAVMNETLRLHPSVPRNARFALKDTTLPRGGGPDGKDPILVRKMSCSIFISGTQIDPKHYGKDAKLFRPERWFESSTRNLGWAYLPFNGGPRICLGQQFALTEAGYILVRLAQSFDTLELKPDTEYLTKISHLTMCLFGAFVKMD

SEQ ID NO: 29689 - protein, 630 aa, Sulfolobus solfataricus P2
MKIPIEPNFRTDPKDYSEEERAKLKTKGLTEDTIGIYSSFHDLSREDLEKEVSLIAKSFGIYIEFNRDKMKLNGVKDWIYMVRLPIPGGGPISSKQWRILDDISNKYTISDAYTGYPSPSLKLTTRQAIQFHHVKKRDLPNLIREVAESGFLTVNGCGDNVRNTIACPLSKYWVFDANSLARKIANYFRLPLDLYLQVFEIPLIENRQFDRESFKYGENLLPRKFKIAIAGVLRTINGKYIIDNCVEVQSNDIGIVPLIEDEKVIGYQIYVGGSMGENNSYPTFSALGLPIGTVVNDSELIKVLDAIVTIQEEWGDRKNRHWARFKYVVYKMGLEWLREKVREHSGIQLGKIVKVDLTHKDLHLGWINLGDNKWAYGIFVENGRLIDGKNGRTKSMIRYIADNFDNLMFYITPNQHLLITEIDQPQKEKIDGILREFNYGFRDGKPYSSLRINSTACVGFPTCKLSFTDSERFLPSLIDELERRGWKDIPVSIGLSGCVAQCSRPALHPISWVGSGYELYMLKIGGGNGSLGEPLIDWDENSIYLYQVPSNRLADVTEALFELYEKNKDISEDPSLVFRLLGNKKIIEWLKGHEKTKDLMKPHKFDRKIEGYREYHDLLRKRLEEVSRYG

SEQ ID NO: 29690 - protein, 517 aa, Candida tropicalis
MYEQVVEYWYVVLPLVFILHKVFDMWHTRRLMKQLGAAPVTNQLHDNFFGIINGWKHLSSRKKVELKNIMIINLPIRKFQVWVHMLVPSLEQSSSSQKIRRNIKALLATQFSDFSLGKRHTLFKPLLGDGIFTLDGQGWKHSRAMLRPQFAREQVAHVTSLEPHFQLLKKHMVKNKGGFFDIQELFFRFTVDSATEFLFGESVHSLKDETIGSYQDDIDFVGRKDFAESFNKAQEYLAIRTLVQDFYYLVNNQEFRDCNKLVHKFTNYYVQRALDATPEELEKQSGYVFLYELVKQTRGPNVLRDQSLNILLAGRDTSAGLLSFAVFELARNPHIWAKLREDVESQFGLGEQSRIEEITFESLKRCGYLKAFLNETLRVYPSVPRNFRIATKNTTLPRGGGSDGNSPVLVKKGEAVSYGINSTHLDPVYYGDDAAEFRPERWNEPSTRKLGWAYLPFNGGPRICLGQQFALTEAGYVLVRLAQSFDTLELKPPVVYPPKRLTNLTMSLQDGTIVKID

SEQ ID NO: 29691 - protein, 446 aa, Rhodococcus sp. RHA1
MNDIQYRLPQKRALVTELPGPKSAALTARRRATVAAGVGSSVPVYAADADGGVVVDVDGNSLIDLGSGIAVTSVGASDPAVAEAVREQVGHFTHTCFMVTPYEGYVRVAEELAALTPGDHEKRTVLFNSGAEAVENAIKVARLATGRDAVVAFDHAYHGRTNLTMALTAKSMPYKAHFGPFAPEVYRLPMSYPYRDQDGLTGEQAAQRAISQMEKQIGADSLAAIIIEPIQGEGGFIVPAEGFLPTLVNWARANGVVFIADEVQTGFSRTGAWFACEHEEIVPDIITMAKGMAGGMPLSAITGRAELLDKVHPGGLGGTYGGNPVACAAALAAIDSMRKFDLPARAQHIGDLALPRLKALAADVGVIGDVRGRGAMLAMEFVKPGTDEPDAELTKAIAAHALEQGVILLTCGTYGNVIRLLPPLVISDDLLDDALTVIEQIVRSLV

SEQ ID NO: 29692 - protein, 476 aa, Rhodococcus sp. RHA1
MSIDVLENYINGEFVASSATETLDLINPVDESVVGRAPVSTKADVDAAVEAAERAFVSWGKTTPSVRQTALLKLADAIEAHSDELVEAECRNTGQPKQVIADEEIKVGADQLRFFAGAARMLEGKAAGEYMDGFTSYVRREPIGVVGQVTPWNYPFMMALWKIGPALAAGNTIVLKPSDTTPNSTLVLARLTKGILPDGVFNVVLGNGETGATLVENPALGLVSITGSVRAGIAVAVSAARQLKRAHLELGGKAPAIVFGDVDIEKTASGIAEAAFFNGGQDCTAATRVLVHESIHDQLVDALVRKAETLKPGLPDDPDTFYGPLNNVNHFNAVSSKIAALPTSAKIVTGGKRSGEQGFFFEPTVITGVDQRDDIVQEETFGPILTVQSFSDEKEAVTLANDVRYGLASSVWTNDHGVTQRLSAALDFGAVWINCHIPLVAEMPHGGFKYSGYGKDLSGYGVEDYTRIKHVMSSND

SEQ ID NO: 29693 - protein, 209 aa, Magnaporthe grisea 70-15
MASTAKTTNSGIVTDDSGQRHIPESTRADGSTRKAIKIRPGYRPPEDVELYKNRTAEAFRNRGKGGGIPGAEGLKDDENKDATTSAAASAASLKNAKRREARKKAKAAEEEAGKAEEPAAGAANGDAKPVAEAVDPEVEKEKKIRNLKKKLKQAKELEQKKEGGGSLLPEQIAKVIKINELIRELQSLGIDTEDGKKEDRQGEAGEKKD

SEQ ID NO: 29694 - protein, 212 aa, Oryza sativa (indica cultivar-group)
MGEEDISNDSKSSCGCEDGTVEAPAAAAPKENGRAADPRLQAISDAIRVVPHFPKPGIMFNDITALLLRPAVFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKNFYKLNGKPVYILVESRK

SEQ ID NO: 29695 - protein, 1074 aa, Shewanella sp. ANA-3
MPKRTDIKSILILGAGPIVIGQACEFDYSGAQACKALREEGYRVILVNSNPATIMTDPEMADATYIEPIQWEVVRNIIAKERPDAILPTMGGQTALNCALELEAKGVLAEFNVEMIGATADAIDKAEDRSRFDKAMKSIGLECPRAGIAHSMEEAYGVLDLVGFPCIIRPSFTMGGSGGGIAYNKEEFEEICSQGLDLSPTKELLIDESLIGWKEYEMEVVRDRNDNCIIVCSIENFDPMGVHTGDSITVAPAQTLTDKEYQLMRNASMAVLREIGVETGGSNVQFGINPKDGRMVIIEMNPRVSRSSALASKATGFPIAKIAAKLAVGFTLDELMNDITGGRTPASFEPAIDYVVTKVPRFNFEKFAGSNDRLTTQMKSVGEVMAIGRTFQESLQKALRGLEVSRHGFDPITDLTKADALARIRLELKEPGCDRIWYIADAMRAGLTLDEIFRLTNIDPWFLVQIEELIKLEGQVAEGGLAGLNEELLRKLKRKGFADARLAAVLGVNETEVRKLRDRFDIHPVYKRVDTCAAEFATDTAYMYSTYEEECEANPSDREKIMVLGGGPNRIGQGIEFDYCCVHAALALREDGYETIMVNCNPETVSTDYDTSDRLYFEPVTLEDVLEIVRIEKPKGVIVQYGGQTPLKLARALEAAGVPIIGTSPDAIDRAEDRERFQQAIQRLEMKQPENDTVTTVEGAVIAAERIGYPLVVRPSYVLGGRAMEIVYDQQDLLRYFNEAVSVSNASPVLLDHFLDDAIEVDIDAVCDGETVVIGAIMEHIEQAGVHSGDSGCSLPPYTLSQAIQDEMRVQVRKLAMELGVVGLMNVQFAVKNNEIYMIEVNPRAARTVPFVSKATGVPLAKIAARVMAGQSLKAQNFTQEVIPPFYSVKEVVLPFNKFPGVDPLLGPEMRSTGEVMGVGDTFAEAYAKAQLGATSEVPKSGRALLSVRNSDKKRVADLAAKLIELGYQIDATHGTAVILGEAGINPRLVNKVHEGRPHILDRIKNGEYTYIVNTTEGRQAIEDSRQLRRGALRYKVNYTTTMNAAFATCMAHAADDRTNVTSVQELHQRVLAK

SEQ ID NO: 29696 - protein, 189 aa, Brassica napus
MRLLKVATCNLNQWAMEFECNMKNIKASISQAKAAGAVIRLGPELEVTGYGCEDHFLELDTLTHAWECLKELLLGDWTDGILCSIGMPVIKGAERYNCQVLCMNRRIIMIRPKLWLANDGNYRELRWFTAWKQRGDLDEFHVPIDVSEALSQTSVPFGYGYIQFIDTAVAVEVCEELFSPVPPHAELAL

SEQ ID NO: 29697 - protein, 483 aa, Xylella fastidiosa Dixon
MLKKHLFIVKPIEPTNHTGTGKGETQLKRSLTARQLVMLGIGAVIGAGIFVLSGHAAAEYAGPAVVLSYILAGIACALAGLCYAEFAAMLPVSGSAYSYAYATLGEFTAWFIGWNLVLEYMFSASTVAVGWSGYLNSFLSSFGYGLPASLSSAPLDVVDGRLIYSGGLINLPAVAIVAAISGLCYVGITQSAFVNSITVAIKVSVIVLFIAFATRYVNTDNWVPFVPDNVAPGKYGIEGVIRGAAVVFFSYIGFDAVSTTAGEAKNPQRDMPIGILGSLAICTVIYIVFSGVLTGLMHYSQLDTPKPVATALETYPTLSWLKHVVEIGAIAGLSSTMLMMLMAQPRIFYAMSQDGLLPKLLSKVHPKFQTPHVGTLIVGACACTLAGLFPISLLGDLVSMGTLLAFATVCIGIVVLRRTRPDLPRPFRVPIYWVIAPAGAAACLYLFWQPFTEHWPLMVGWTVLGLVMYGLYGYHHSKLRHGG

SEQ ID NO: 29698 - protein, 363 aa, Oryza sativa
MAASGVSEFDIVACITFTGMVRKLILALAVFLPALVYQQLQPPPPKICGSPGGPPVTGTRTQLKDGRHLAYLESGVPKDQAKYKIIFVHGFDSCRYDALPISPELAQELGIYQLSFDRPGYAESDPNPASTEKSIALDVEELADNLQLGPKFYLMGFSMGGEIMWSCLKHISHRLAGVAILGPVGNYWWSGLPSNVSWHAWNQQLPQDKWAVWVSHHLPWLTYWWNSQKLFPASSVIAYNPALLSEEDKLIMPKFAFRTYMPQIRQQGEYSCLHRDMTVGFGKWSWSPLELEDPFAGGKGKVHLWHGAEDLIVPVSLSRYLSEKLPWVVYHELPKSGHMFPLADGMADTIVKSLLLGDQPPQA

SEQ ID NO: 29699 - protein, 506 aa, Candida tropicalis
MSLTETTATFIYNYWYIIFHLYFYTTSKIIKYHHTTYLMIKFKASPPLNYINKGFFGIQATFTELKHLICHTSIDYAIDQFNNVPFPHVHTFVTKVLGNELIMTKDPENIKVLLRFPVFDKFDYGTRSSAVQPSLGMGIFTLEGENWKATRSVLRNMFDRKSIDKVHDFEPHFKTLQKRIDGKVGYFDIQQEFLKLGLELSIEFIFGQVVSEDVPHYDDFTQAWDRCQDYMMLRLLLGDFYWMANDWRYKQSNQIVQAFCDYLVQKSLENTCNDKFVFVHQLAKHTTNKTFIRDQALSLIMASRDTTAELMAFTILELSRKSHHLGKLREEIDANFGLESPDLLTFDSLRKFKYVQAILNETLRMYPGVPRNMKTAKCTTTLPKGGGPDGQDPILVKKGQSVGFISIATHLDPVLNFGSDAHVFRPDRWFDSSMKNLGCKYLPFNAGPRTCLGQQYTLIEASYLLVRLAQTYETVESHPDSVYPPRKKALINMCAADGVDVKFHRL

SEQ ID NO: 29700 - protein, 505 aa, Candida tropicalis
MYQLFCFLAGIIVVYKAAQYYKRRTLVTKFHCKPARISPNKSWLEYLGIASVVHADEMIRKGGLYSEIDGRFKSLDVSTFKSITLGKTTYVTKDIENIRHILSATEMNSWNLGARPIALRPFIGDGIFASEGQSWKHSRIMLRPVFAKEHVKQITSMEPYVQLLIKIIKNHEGEPLEFQTLAHLFTIDYSTDFLLGESCDSLKDFLGEESNSTLDTSLRLAFASQFNKTQQQMTIRFMLGKLAFLMYPKSFQYSIQMQKDFVDVYIDRVVGMSEEELNNHPKSYVLLYQLARQTKNRDILQDELMSILLAGRDTTASLLTFLFFELSHHPEVFNKLKEEIERHFPDVESVTFGTIQRCDYLQWCINETMRLHPSVPFNFRTAANDTVIPRGGGKSCTDPILVHKGEQVLFSFYSVNREEKYFGTNTDKFAPERWSESLRRTEFIPFSAGPRACLGQQLPRVEASYVTIRLLQTFHGLHNASKQYPPNRVVAATMRLTDGCNVCFI

SEQ ID NO: 29701 - protein, 219 aa, uncultured bacterium
NSRLCMSSAVAGYTRSLGSDGPPCSYEDLDHCTVAFLIGTNTAECHPVLFQRLLKRKKRHPGSVTIVVIDPRQTDTARAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 29702 - protein, 386 aa, Tetragenococcus halophilus
MATKRDYYEVLGVDKGASDDEIKKAYRKLSKKYHPDVNQEADAEEKFKKFQKPMNTLSDPQKRAAYDQYGHAGADANFGGGGAGGFGGFGGGFSDAGGFGGFEDIFESFFGGGRSADPNAPRQGDDLQYSINLTFEEAVFGKDTEVSYKRNEVCHTCGGNGAKPGTQPETCHKCKGSGTINAERQTPLGRVMTRQTCDVCHGTGKEIKEVCETCHGTGHEKKTHSVNVSVPAGVEDGQQMRLANQGEAGTNGGPYGDLYVVLYCSHETCNIFDRDGSEIYYELPINFVQAALGDEVDVPTVHGNVKLKIPAGTQTSTKFRLRGKGAPRLRGNSTGDQQVTVKIITPKNLNEEQREALRNFAELTGQSTEEQQSEGFFDKMKDAFKK

SEQ ID NO: 29703 - protein, 213 aa, Brassica rapa
MVRGKTQMKRIENATSRQVTFSKRRNGLLKKAFELSVLCDAEVSLIIFSPKAKLYEFASSNMQDTIDRYLRHTKDRVSTKPVSEENLQHLKHEAANMMKKIEQLEASKRKLLGEGIGSCSIEELQQIEQQLEKSVKCIRARKTQVFKVQIEQLKQKEKALAAENKKLTEKWGSHEIEVWSNKNQESGRGDEESSPSSEVETELFIGLPCSSRK

SEQ ID NO: 29704 - protein, 219 aa, uncultured bacterium
NSRLCMSSAVAGYTRSLGSDGPPCSYEDLDHCTVAFLIGTNTAECHPVLFQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVSQRREGTAVVGGIINLHLLTGQIGKEGAGPFSLTGQPNAMGGREAGGLSHLL

SEQ ID NO: 29705 - protein, 839 aa, Pseudomonas fluorescens Pf-5
MHNNNELTLGAPLSGPVLALRSVPDPVFASGAMGDGIAIDPLNDTLHAPCAGQVIQVARTGHAITLRAANGAELLLHLGLDTVELQGEGFALLVKEGQQVRAGQPLLRVDLDHVAQHCRSLISLLILTNGEGFDLRPLTLSTVQVGEPLLHISRRANAGPQPLTQEQSGQQASARIKVAHRGGLHARPAALVRQTALSFNSHSQLTFKDKSAPCTSLIALMSLGIGEQEEVLVSCQGDDCQDALQAMLQTLGTAMAADAHGETPVPAPAAQGPVEDGVLPGVCAAPGLVYGPLVRLNAMVLAEDHGQHAPEPQRQALSTALDQVRGEIRHTLEQARQRRDQQEQDIFSAHLALLEDPTLLDAAEASIAQGRAATHAWSAAITEQCQILQQLGSTLLAERANDLRDLQQRVLRALLGEAWHYDLPAGAIVAAEELTPSDLLQLSAQGVAGLCMAAGGATSHVAILARGKGLPCLVALGPQVLRIDSGRQVVLDANGGRLELEPDPQRIAQVQQAGETQRQRHALQQQKAHEPALTQDGQQIEVAANVASSDEARDAHQGGADGVGLLRTEFLFVDRQTAPDQEEQRQAYQAVLNAMGDKPVIIRTIDVGGDKQLDYLPLPVEANPVLGLRGIRLAQARPELLDQQLRALLQVSPVQRCRVMLPMVTEVAELLHIRQRLDLFAAELGLSQRPELGVMIEVPAAALMAEQLAEHADFLSIGTNDLSQYTLAMDRDHAGLAARVDALHPALLRLIAQTCAGAQRHGRWVGVCGALASDPLATPVLIGLGVSELSVSPPQVGEIKDRVRQLDASQCRQLSQPLLNLPGAAAVRQACERLWPLHS

SEQ ID NO: 29706 - protein, 219 aa, uncultured bacterium
NSRLCMSSAVAGYTRSLGSDGPPCSYEDLDHCSVAFLIGTNTAECHPVLFQRLLKRKKRSPGSITIVVVDPRRTDTAKAADIHLPIAPGSDLALLHGIAHLVMRENGQDPAFIDDHTEHYDAFFDVVARWTPRRVALFCNIPEKRLRDVAALFHRREKVLSLWSMGVNQRREGTAVVQGLINLHLLTGQIGKEGAGPFSLTGQPNAMGGREAGGLSHLL

SEQ ID NO: 29707 - protein, 219 aa, uncultured bacterium
NSRLCMSSAVAGYTRSLGSDGPPCSYEDLDHCTVAFLIGTNTAECHPVLYQRLLKRKKRHPGSVTIVVIDPRQTDTAKAADIHLAVAPGSDLALLHGIAHLVMRENGQDPTFIDNCTENYDSFFDVVARWTPRRVALFCGIPEKRLREVAQLFHRREKVLSLWSMRVNQRREGTAVVGGIINLHLLTGQIGKEGAGPFSLTGQPDAMGGREAGGLSHLL

SEQ ID NO: 29708 - protein, 219 aa, uncultured bacterium
NSRLCMSSAVAGYTRSLGSDGPPCCYEDLDHCSVAFLIGTNTAECHPVLFQRLLKRKKHDPKSLTIVVVDPRCTDTAKIADHHLAVAPGTDLALLHGLARLVIEDNGFDSDFIDAATEGFSAYAKTINAWTAEETAKLCGINEQELREVGRLWSRREGILSLWSMGVNQRREGTAIVSGLINLHLLTGEIGKPGAGPFSLTGQPNAMGGREAGGLAHLL

SEQ ID NO: 29709 - protein, 412 aa, Oryza sativa
PRMELLPRVGVAAPGPGRGGASPSPTRRHRAPSHPILKRSAAVCGAVAVCRGGAVARRSRWSTLVTAAYYTGTAELVDFNWETLGFQPVPTDFMYVMRCSEEGVFTKGELVPYGPIELNPAAGVLNYGQGLLEGLRAHRKEDGSVLLFRPDENALRMRVGADRLCMPAPSVEQFLEAIKLTILANKRWVPPTGKGSLYIRPLLIGSGAILGVAPAPEYTFVVFACPVGHYFKDGLSPISLLTEEEYQCAAPGGTGDIKTIGNYASAVYAKERAKERGHSDVLYLDPVHKKFVEELSSCNIFMVKDNIISTPLLTGTVLPGITRRSIIEYARSLGFQVEECLITIDELLDADEVFCTGTSVVLSSVGCIVYQGRRVEYGNQKFRTVSQQLYSALTAIQKGLVEDSMGWTVQLN

SEQ ID NO: 29710 - protein, 464 aa, Xylella fastidiosa Dixon
MFKQLWATKLSQPSQDSAEGLSLQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIHLSAALVNAPLDGTLHATGAIANLPAATIVLLLTWLCYFGIRKSSKINIAMVALKSGLILLIIGVGWKYVNPDYWQPFIPTNQGPGKYGWNGVLHGASMVFFAYIGFEAVSVAAQESHRPQRDLPISMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAAVFPLDVLGELTSMGTLIAFTAVCAGVLILRCTRPDLPRPFRMPAAWLFCSAGVLSCITLLSAMTRHNWMLMSVWTVLGFSLYFSYGYRHSKLHREST

SEQ ID NO: 29711 - protein, 394 aa, Bacteroides fragilis YCH46
MQKENQTYKVAPADRLAGVSEYYFSKKLKEVARMNAEGKDVISLGIGSPDMPPSEQTIETLCNNAHDPNGHGYQPYVGIPELRKGFADWYKRWYGVELNPATEIQPLIGSKEGILHVTLAFVNPGEQVLVPNPGYPTYTSLSKILGAEVVNYNLKEEDGWMPDFDELEKMDLSRVKLMWTNYPNMPTGANATPELYKRLVEFARRKNIVIVNDNPYSFILNDKPISILSVPGAKEYCIEFNSMSKSHNMPGWRIGMLASNAEFVQWILKVKSNIDSGMFRAMQLAAAKALEADSTWYEVNNVNYRNRRHLAGEIMKTLGCTYEEKQVGMFLWGKIPASCADVEELTEKVLQEARVFITPGFIFGSNGARYIRISLCCKDAKLAEALERIKLIMK

SEQ ID NO: 29712 - protein, 284 aa, Alkaliphilus metalliredigenes QYMF
MELWYTEEQTQHVRLSFKVKEHLFSEQSEFQKVDVLDTYEFGKLMTLDGLVMVTEKDEFIYHDMIVHVPMAVNPNIKNVLIIGGGDGGTARELMRYQSIKHVDMVEIDKMVCDVARDYFPTISSELENPRVSLYYEDGVAFIKDKENKYDLIIIDSTDPVGPGEGLFSQEFYTNCFKALTEQGILVNQNESPVYEQFAREAIRANSKLKKIFPIVEVYQAQIPTYPSGYWLFGFASKSLHPVKDLKSSVWNQLNLNTKYYNTQLHVGAFALPSYVKEQIENGNV

SEQ ID NO: 29713 - protein, 420 aa, Burkholderia thailandensis E264
MKLHGFLIGQTEALLADVLKFAGPADVTTSRFFRAHPKLGHAERGVIAEAVFAVLRRKMEYAHLAESGTGAPARRLVLLGLMQTVGRSAVKPFVSDAEWAWLDHVAKIDPASLPLRVRTNLPDWIHQALAERMGADELAQFAAAVNYPAPLDLRANALKATRDEVIDSLRAAGIDAGATPFAPFGVRVVGKPALTKLKLFEEGQIEVQDEGSQLLCSLVAPRRGEMVVDFCAGAGGKTLALGAMMRSTGRLYAFDVSEKRLAKLKPRLARSGLSNVNPVLIDSEHDAKIKRLAGKIDRVLVDAPCSGLGTLRRNPDLKWRQSRETVDELAPKQASILASAARLVKKGGRLVYATCSVLEAENEAIVSEFLAAHPEFALVPASRVLAEQRIALDTGDYLSLWPHRHATDGFFAAVLERRAQ

SEQ ID NO: 29714 - protein, 206 aa, Xylella fastidiosa Dixon
MCNEPVTSDVALPDLDWAKGDGLLPVIVQDADTLRVLMLGYMNSHALEVTQRSRLVTFYSRSKQRLWTKGERSGHVLHLVAIDADCDADTLLVQARPRGPTCHLGRTSCFPAAPGQFLGALDALVAERERERPQDSYTTALFEQGVRRIAQKVGEEGVETALAGVVQADDALLDESADLLYHLIVLLRARGLSLADAVTVLEARHR

SEQ ID NO: 29715 - protein, 469 aa, Streptomyces filamentosus
MFQNADEVQKYVADNDVKFIDVRFCDLPGVMQHFTIPAATFDPAEELAFDGSSIRGFQAIHESDMALRADLSTARVDPFRRDKTININFFIHDPITGEQYSRDPRNIAKKAEAYLASTGIADTAYFGPEAEFYVFDNVRFQTSANESFYHIDSEAGAWNTGAVENNRGYKVRYKGGYFPAPPVDHFADLRAEISLELDKNGLQVERQHHEVGTAGQAEINYKFNTLLAAADDLMLFKYIVKNVAWRNGKTATFMPKPIFGDNGSGMHVHQSLWQGGSPLFYDEQGYAGLSDTARYYIGGILKHAPSLLAFTNPTVNSYHRLVPGFEAPVNMVYSQRNRSAAMRIPITGSNPKAKRVEFRAPDPSSNPYLAFSALLMAGLDGVKNKIEPAEPIDKDLYELAPEEHANVQQVPTSLPAVLDALEADNEYLQAGGVFTSDLIETWIDYKRTNEIAPIQLRPHPHEFELYFDI

SEQ ID NO: 29716 - protein, 473 aa, Synechocystis sp. PCC 6803
MARTPQEVLKWIQDENIKIIDLKFIDTPGIWQHCSFYYDQLDENSFTEGIPFDGSSIRGWKAINESDMCMVPDPNTATIDPFCKEPTLSMICSIKEPRTGEWYNRDPRTIAAKAVEYLRGTGIADTVYFGPEAEFFLFDDIRFGQTENSSYYFADSVEGRWNTGREEEGGNLGYKPGYKQGYFPVAPTDTAQDIRTEMLLTMAGLCVPIEKHHHEVASGGQNELGIKFDKLVNSADNLMIYKYVIKNVAKKYGKTVTFMPKPIFNDNGSGMHVHQSLWKDGQPLFAGDKYAGFSQMGLWYIGGILKHAPALLAFTNPTTNSYKRLVPGFEAPVNLAYSQGNRSASVRIPLSGGNPKAKRLEFRCPDATSNPYLAFAAMLCAGIDGIKNQIDPGEPLDVDIYDLSPEELAKIPSTPGSLEAALEALEKDHEFLTGTGVFSPDFVESWIEYKLDNEVNPMRLRPHPYEFSLYYDC

SEQ ID NO: 29717 - protein, 572 aa, Saccharomyces cerevisiae
MCGIFAAFKHEDIHNFKPKALQLSKKIRHRGPDWSGNAVMNSTIFVHERLAIVGLDSGAQPITSADGEYMLGVNGEIYNHIQLREMCSDYKFQTFSDCEPIIPLYLEHDIDAPKYLDGMFAFCLYDSKKDRIVAARDPIGVVTLYMGRSSQSPETVYFASELKCLTDVCDSIISFPPGHVYDSETDKITRYFTPDWLDEKRIPSTPVDYHAIRHSLEKAVRKRLMAEVPYGVLLSGGLDSSLIAAIAARETEKANADANEDNNVDEKQLAGIDDQGHLHTSGWSRLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSAAEFHTESVQRVKNLHLADCLRANKSTMAWGLEARVPFLDKDFLQLCMNIDPNEKMIKPKEGRIEKYILRKAFDTTDEPDVKPYLPEEILWRQKEQFSDGVGYSWIDGLRDTAERAISDAMFANPKADWGDDIPTTKEAYWYRLKFDAWFPQKTAADTVMRWIPKADWGCAEDPSSRYAKIHEKHVSA

SEQ ID NO: 29718 - protein, 219 aa, Shewanella sp. ANA-3
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGKFPLPVEVIPMARSYVARELVKLGGDPVYREGVVTDNGNVILDVYNLKIINPKELEEKINAIVGVVTNGLFAKRGADVLLVGTPEGVKTFTA

SEQ ID NO: 29719 - protein, 177 aa, Triticum aestivum
  misc_feature (145)..(145): Xaa can be any naturally occurring amino acid
  misc_feature (158)..(158): Xaa can be any naturally occurring amino acid
  unsure (1)..(177): unsure at all Xaa locations
MSWCYCAKPMTLQLPLQPRASSSFHSHVGGVTVTSSTLSLRLSSTLVFTHNLHFQPKLKRASTTVRCSSALTPQLKSTLDQVIASNKVVVFMKGTKDFPQCGFSNTVVQILKSLNVPFETINVLENDLLRQGLKEYSSWPTFPQXYIEGEFFGGCDIXVDAYQKGELQELLEKAMLS

SEQ ID NO: 29720 - protein, 375 aa, Xylella fastidiosa Dixon
MTPIVFIDRDGTLIEEPPDFQIDAYEKLRLVNGVIPALLKLRDAGYHFVIVTNQDGLGSPTYPQASFDGPNALMLQIFSSQGIVFRDVLIDRSWPADNAPTRKPGIGLMVAYLQDRDIDWARSAMVGDRPTDLQFAENLNIRGFQLRTPQFGGDWDWDGIAHTLADAPRRAVVQRHTKETNIRVEIDLDGAPQARITTGLPFFNHMLEQIAKHAGISLQISAVGDLHIDEHHTIEDTGLALGQAVRQALGDKRGIGRYGFDPPQLPWQVSGAAAHGGFTLPMDETQASAVLDFSGRPYFVFEGTFVRERVGDMPTELVPHFFRSLCDASGMNLHLSVHGDNDHHKVEACFKALARALRQALQRHGHVLPSTKGAL

SEQ ID NO: 29721 - protein, 303 aa, Arabidopsis thaliana
MCNIINQNKAFFAKKKKKKTRERESSLVPPPPMAKTGESLRDKPRWSLVGMTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGGFTVNGFSFKPLP

SEQ ID NO: 29722 - protein, 422 aa, uncultured archaeon GZfos11A10
MTTTTQSKKVYEEARKLIPGGVSSPVRAIKPYPFYTASAEGSVITDIDGNRYIDYVMGYGPLILGHAHPAIKDAVAGQLERGWLYGTPIEAELKLASKIAAIYPSIEMMRFVSSGTEATMSALRLARGYTGRNKFLKIEGGFHGAQDAALVKAGSGATTHGTPDSLGVPPDFTKHTLQVPYNDIETMTEAIESNREDLAAVIIEPVLGNIGPILPAPGYLESVRKITEENDVLLILDEIITGFRLAMGGAQECFEIVPDMTTLGKIVGGGFPFGVFGGKKEIMELISPSGGVYQAGTFSGNPVSVTAGLAVLDVLEGEDVHRRLELAGNELRAALQDLVADRKLSYSVAGIASMFKVFFGDAPHNYQEALSCDKEGYLRFFHRMLKSGVFLPPSQFETNFISIAHTGGDLDATIAAYEENLR

SEQ ID NO: 29723 - protein, 605 aa, Oryza sativa (indica cultivar-group)
MSPNLESHIKSQVPALLLRRFFAGRGRRRVFVQTETGCVLGMDLDRSDNAHTVKRRLQLALNVPTGETSLTFGDRVLENDLSFIRPDSPLLLTRNSINRSCSTPCLCPVSKDFEHKDRSGLVEMLGCSISCARVKRLVDDVVTAIRSGVDPVPIGSGLGGSYYFRNISGDRVAIVKPTDEEPFAPNNPKGFVGRALGQPGLKKSVRVGETGFREVAAYLLDHDNFANVPPTALVKITHSIFHINCPVNGGSPAHDQKQQVSSKIASFQQFIAHDFDASDHGTSSFPVAAVHRIGILDIRIFNTDRHAGNVLVRKLDGGTGRFGCQTELFPIDHGLCLPENLEDPYFEWIHWAQSSIPFSEEELEYIKNLDPMRDVAMLRRELPIIREACLRVLVLCTIFLKEAAASGLCLAEIGEMMTREFRGLEEEPSKLEVVCMEARRKLAEWEPYSPVIEQGEDMDFQFSLDMLGEYNDVIRSPRFNGLGAKGNGFRNPLSKLVESIDEDNDDDDGRSESSKRSSERVHSGGLKFPSADKSSGSNGSVHALNRSADEQLPSSVYFVRLSDMNAEEWNIFLEKFQELLKEALQERAAAAGQRMKQRLGTSCKF

SEQ ID NO: 29724 - protein, 271 aa, Coccidioides immitis RS
MTFLLRRNATLAKTLYRVTCPRQRSIPMSTSGPLNNKEKDYFRNIQRMATPKVQTTVPDAYQQALVRNSEWASKTVEEQPLLFPKLASGQHPEILWIGCADSRCPETTVLGLQPGDVFVHRNIANVIQYNDLSCASVLEFAVIYLKVKHIILCGHTSCGGVAAALSNKKLGLLDTWLMPLRRLREQNLDLFKNLDAKEAAVKLAEINVHNGLRVLKENSAVLDAIQERGLKLHGLIYDVGSGKLRELDTEEPMEVIARRLTAFRTVAGEMK

SEQ ID NO: 29725 - protein, 219 aa, uncultured bacterium
NSRLCMSSAVAGYTRSLGSDGPPCSYEDLDHCTVAFLIGTNTAECHPVLFQRLLKRKKRHPGSVTIVVVDPRQTDTAKAADIHLAVAPGSDLALLHGIAHLVMHENGQDPAFIDDCTDNYDTFFDVVARWTPRRVALFCGIPEKRLREVAQLFHRREKVLSLWSMGVNQRREGTAVVGGIINLHLLTGQIGKEGAGPFSLTRQPNAMGGREAGGLSHLL

SEQ ID NO: 29726 - protein, 219 aa, uncultured bacterium
NSRLCMSSAVAGYTRSLGSDGPPCSYEDLDHCTVAFLIGTNTAECHPVLFQRLLKRKKRHPGSVTIVVIDPRQTDTAKAADIHLAVAPGSDLALLHGIAHLVMRENGQDPTFTDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 29727 - protein, 456 aa, Nostoc sp. PCC 7120
MVASLENHQPHEVVIVGGGFGGLYAAKALAKTNVNVTLIDKRNFHLFQPLLYQVATGTLSPADISAPLRSVLSKSKNTKVLLGEVNDIDPNLQQIIVGDKVVPYDTLIVATGAKHSYFGKDNWQELAPGLKTVEDAIEMRRRIFGAFEAAEKETDLEKRKALLTFVIVGGGPTGVELAGAIAELAYKTLQEDFRNINTSETRILLLQGGDRILPHIAPELSQAATTSLREFGVVVQTKTRVTSIENDIVTFKQGDELQTITSKTILWAAGVKASPMGKVLAERTGVECDRAGRAIVEPDLSIKGHQNIFVVGDLANFSHQNGQPLPSVAPVAIQEGEYVAKLIKKRLQGKTLPAFKYNDHGSLAMIGQNAAVVDLGLLKLKGFSAWAFWLLIHIYFLIEFDSKLLVMIQWAWNYITRKRGSRLITGKESLAFANNFDDSNDTNNYSAANNRQPLNV

SEQ ID NO: 29728 - protein, 219 aa, uncultured bacterium
NSRLCMSSAVTGYTRSLGSDGPPCCYEDLDHCSVAFLIGTNTAECHPVLFQRLLKRKKRNPGSVTIVVVDPRRTDTAKAADIHLPIAPGSDLALLHGIAHLVLRENGQDPAFIDDHTDNYEAFFDVVARWTPRRVARFCNLPEKRLREVAQLFHRRERVLSLWSMGVNQRREGTAVVCGLINLHLLTGQIGKEGTGPFSLTGQPNAMGGREAGGLSHLL

SEQ ID NO: 29729 - protein, 453 aa, Nostoc sp. PCC 7120
MVEALDNNPPHKVVIVGGGFGGLYAAKALAKAKVDVTLIDKRNFHLFQPLLYQVATGTLSPADISSPLRAVLSKSKNTQVLLGEVNDIDPEAQELVMGDEKIPYDTLIVATGAKHSYFGKDNWEEFAPGLKTVEDAIEMRRRIFTAFEAAEKEKDPAKRRAWLTFVVVGGGPTGVELAGAIAELAYKTLKEDFRNIDTTETQVILLEGLDRILPPFAPELSQEAEISLKQLGVLVQTKTLVTNIENDIVTLKQGEEVKEIASKTVLWAAGVKASAMGKVLAEKTGVECDRAGRVIVESDLSIKGHSNIFVVGDLANFSHQNGKPLPGVAPVAKQEGEYVAALVQKRLQGQTLPAFNYTDKGSLAMIGQNAAVVDLGFIKLKGFFAWLFWLVIHIYFLIEFDNKLVVMIQWVWNYITRNRGARLITGQEIHLAVNTVNNSGHYQPLEKRLPVNV

SEQ ID NO: 29730 - protein, 219 aa, uncultured bacterium
NSRLCMSSAVAGYTRSLGSDGPPCSYEDLDHCSVAFLIGTNTAECRPVLFQRLLKRKKRNPGSITIVVVDPRRTDTAKAADIHLPIAPGSDLALLHGIAHLVMRENGQDPAFIDDHTEHYDAFFDVVARWTPRRVALFCNIPEKRLRDVAALFHRREKVLSLWSMGVNQRREGTAVVQGLINLHLLTGQIGKEGAGPFSLTGQPNAMGGREAGGLAHLL

SEQ ID NO: 29731 - protein, 493 aa, Arabidopsis thaliana
MQSRIVGLAPAFSLFPNLNTPHKTFTFHQILVLIITFTAYASFHASRKPPSIVKSVLGPPSLNSSSIDNGWAPFNGTQGTKRLGELDLAFLSSYALGMYFAGHLGDRIDLRYFLVFGMMGSGILTLVFGLGYWMNVHTLGFYMSVQIVCGLFQSIGWPCVVSVVGNWCGKEKRGLIMGLWNSHTSVGNILGSVIASSVLDFGWGWSFVLPGVLVLVSGVVVFMFLVVSPNDLGFEELGKEIEIEMSLGENVEESLRKHEAEGAVLLENVDDSSFAIGFLEAWRLPGVAPYAFCLFFSKLVAYTFLYWLPYYLRHTAVAGVNLSHKTAGILSTVFDVGGVLGGISAGFISDKIKARALTSITFLALSIPALIMYRVYGSVSMFINIVLMFISGLLVNGPYALITTAVAADLGTQDSIKGNGRALATVTAIIDGTGSVGAALGPLLAGYISSRGWNSVFFMLIVSIFFAGLFLVRLAKSEINTMRSGELIASSVP

SEQ ID NO: 29732 - protein, 219 aa, uncultured bacterium
NSRLCMSSAVAGYTRSLGSDGPPCCYDDLDHCSVAFLIGTNTAECHPVLFQRLLKRKKRYPGSVTIVVVDPRRTDTAKAADIHLPIAPGSDLALPHGIAHLVLRENGQDPAFIDDHTENYEAFFDVVARWTPRRVARFCNLPEKRLREVAQLFHRRENVLSLWSMGVNQRQEGTAVVCGLINLHLLTGQIGKEGAGPFSLTGQPNAMGGREAGGLSHLL

SEQ ID NO: 29733 - protein, 365 aa, Zea mays
MASAARSTGSLPVANVQALAEACNDDGGDVQVPERYLSKDPSSAEEVVVVAGDDSACRAIPVIDLRRLLDPESSEEETAKLASACLDWGFFQLINHGIPDEVTGNLMKDVAAFFRQPLDAKKECAQQADSLEGYGQAFVVSEDQKLDWADMLFLIVQPREARDTRFWPTRPASFGDSVDSYSLEASRLAYRLLELMARGVGADPASLRRVFEGQTQGMRVNYYPPCRRAADRVLGLSPHTDASGLTLLLQASNGVQGLQVRKDGRWFAVDAIDGALVVNVGDFLEILSNGKFTSVEHRAVVHPTRERMSAALFLYPCQNMRVGPLPEFVNGGEERYGSTDYEEFMKHYFATKLDGRKHLDRLKLE

SEQ ID NO: 29734 - protein, 116 aa, Pseudomonas fluorescens Pf-5
MTNKIILALEAEQMTKEIPAFAPGDTIVVQVKVKEGDRSRLQAFEGVVIAKRNRGVNSAFTVRKISNGVGVERTFQTYSPQIDSMAVKRRGDVRKAKLYYLRDLSGKAARIKEKLA

SEQ ID NO: 29735 - protein, 754 aa, Haloarcula marismortui ATCC 43049
MSDDELAKDLGLVSAMTIGIGTMIGAGIFVLPGVAANAAGPVVVVSFVVGGLIAMVNALSVSELGTAMPKAGGGYYYINKSLGPLFGSIAGMGDWMGLAFASAFYCIGFGQYLAVFVPLPEVAFLNPIQIGALIAGAIFVAVNYIGAKETGGVQTVIVFILLSILTVFAVAGFFAFDYATLAGADGLAPFGTGAILPATALVFVSFLGYAKIATVAEELKNPGRNLPIAIIGSVGIVTVIYAILVSMMLGVVPWPELSQDAPVAQAAQLAFPESIGPIGGVAAGAAAVMTVGALLATASSANASILASARINFAMGRDKIVTNWLNEIHPNYATPYRSILVTGGLIIVFIAFLGRDIEVLAKAASVLHLIVYALLNVGLIVFRETDAPEYDPDFTVPLYPITPILGAVLSLGLVAFMDSIEIALSAGFVLVAVVWYFVYARGKTTQKGVLSDYISDREEQLPDQVVNAADAVAPNGAGGPTIMVALANPRTESALITLASALAQHEDGRVLATHIATVPDQTALETAAANRDRIDATSESLLDTAKADAEAFDVPIETKTILSHRGIEEVFDAARTNHADTVVMGYGGTQFAGGRAEGTLDELAHDLPCDFLVLDGQDLDLSDVLVPTAGGLSSDLSAAVAKALEETFGVAVSLLHVVDPGEEESGRQFMYEWAAEHGLSDAELRIETGDIEATIERLGRDYSLVIVGATERGLLSRIVRGSLVFDVIETLDTPVLLAERPSSRSLRERLFGRE

SEQ ID NO: 29736 - protein, 393 aa, Frankia sp. EAN1pec
MSVRDMVEKDYYAALGVPKDASAADIKKAYRKLARELHPDKNPGDVKAEARFKEVSEAYDVLSDENRRREYDEARALFASGSYPGAGGRGGGMGGFGTPGGYGPGAGNLNLDDLLNGNGGGGLGGIFDNLFQRTPTGRAPRRGTDIAAEVTISFEKSLTGLEATVRLPGAATCATCAGIGARPGTSPRTCPVCRGLGVISRSQGGFALSEPCRDCLGKGSLIDHPCPDCHGTGRREREQRIRIPAGVSDGQRLRVRGRGSPGERGGAAGDLEVTVHVQSHPVFGREGHNLTINLPVTITEAALGASVKVPTIDGTPLTVKVPAGTSSGRRLRARNRGVPRPGGENGDLIVTLEVTVPKPSELSPKARTALQEFARAHPEDPRESLIAQMEGRA

SEQ ID NO: 29737 - protein, 139 aa, Synechococcus sp. WH 8102
MESSQENLFDQAMARYQAGASAAEILPDFLKITEIAPRQAAGWTCLAWLQLLCDQPEEALRSARFAVKLSPQDPQARINLSLALLETDSKGVRDQIQMVQQVLTMAPQISDDLKGALEDGLVRRPGWKALEKVKSWLNL

SEQ ID NO: 29738 - protein, 220 aa, Brassica napus
  misc_feature (76)..(76): Xaa can be any naturally occurring amino acid
  unsure (1)..(220): unsure at all Xaa locations
MKGLFKSKPRTPADIVRQTRDLLLYADRSKSLPDLRESKREEKMAELSRNIRDMKSILYGNSEAEPVAEACAQLTXEFFREDTLRLLITCLPKLNLETRKDATQLVANLQRQQVNSRLIASDYLEANLDLMDVLMEGFENTDLALHYGAMFRECIRHQIVARYVLESEHVKKFFDYIQLPNFDIAADAAATFKELLTRHKSTVAEFLTRNEDWTYTQSFL

SEQ ID NO: 29739 - protein, 541 aa, Methanocaldococcus jannaschii
MCSISGIIVKDNQISAKYSIDMMKILKHRGRDNSGLLLDDEVIYFNDFEDVEDLEEEMIGNLSLAHNRLAIVGRYGVQPIPNEDETIWLVCNGEIYNYIELREYLKQNHEFRTDSDNEVIIHLYEEEKLEELDGDYAFAIYDKSKNVVRLARDMFGVKPLFYVDRDKYFAFASERKALWHLLINIDGCERDLDELNSKIKTLKPNSQLIYYLDDNRFEIIEGFKKLELNYMKERSYEEAKEYLDRALKNSVLKRVRGLDKVGIICSGGVDSSLIAKLASLYCEVILYAVGTENSEDLIYAERLAKDLNLKLRKKIISEEEYEEYVFKVAKAIDEVDLMKIGVGIPIYVASEMANEDGLKVVLSGQGADELFGGYARHERIYRERGEEELKKELLKDVYNLYKVNLERDDHCTMANGVELRVPFLDEEVVEIALSIPIEYKMSELSNRPYAESNISLKSEPINGLKNTNLNIKCVRSVRKKILRDVASQYLPDYIAYRPKKAAQYGSGGEKMIYKVAKKYGFSKKRINEFLDMLKRKIVSEF

SEQ ID NO: 29740 - protein, 183 aa, Citrus unshiu
MRDGSLKGLFCTAPKSIRSVRRNSGSFNVTAFTEEQEALVVKSWNAMKKNSGELALKFFLRIFEIAPSAKKLFTFLKDSDIPVEQNPKLKPHATTVFVMTCESAVQLRKAGKVTVRESNLKDLGATHFKYGVADEHFEVTKYALLEPIKEPVPEMWSPELKNAWAEAYDQLAAAIKIEMKPPS

SEQ ID NO: 29741 - protein, 161 aa, Marchantia polymorpha
DSATHSVTFFAKIFEIAPGAKALFSFLKDSDIPFDKNPKLKAHALTVFRLTGDSACMLGEKGAIDALHPKLKELGKKHVGYGVIAAHFDVVKAALLSTIESLLPEDWPAEKKVATCGAWSQAYDELAGVMINEMQAIRDAEKAPAAEEAPEAPAAESKALP

SEQ ID NO: 29742 - protein, 176 aa, Pyrococcus furiosus DSM 3638
MRRTTKETDIIVEIGKKGEIKTNDLILDHMLTAFAFYLGKDMRITATYDLRHHLWEDIGITLGEALRENLPEKFTRFGNAIMPMDDALVLVSVDISNRPYANVDVNIKDAEEGFAVSLLKEFVWGLARGLRATIHIKQLSGENAHHIVEAAFKGLGMALRVATKESERVESTKGVL

SEQ ID NO: 29743 - protein, 446 aa, Enterococcus faecalis V583
MTRKAKTAEEIKHIAEEENVRFLRLMFTDIMGTIKNVEVPVSQLDKVLDNKMMFDGSSIEGFVRIEESDMYLYPDLSTWMIFPWESDHGKVARLICDIYNPDGTPFAGDPRGNLKRALADMKELGFTSFNLGPEPEFFLFKLDENGEITTDLNDKGGYFDFAPTDLGENCRRDIVLELESLGFEVEASHHEVAPGQHEIDFKYADVVDACDNIQTFKLVVKTIARKHGLHATFMPKPLFGINGSGMHCNMSLFNEEGNVFYDESGEMGLSQTAYHFLGGLLKHARAYTAVCNPTVNSYKRLVPGYEAPVYVAWSGRNRSPLIRVPESRGLSTRLELRSVDPSANPYLTMAVLLQAGLDGIRNELTPPPAVDRNIYVMNEEERQHAQIEDLPSTLHNAIKELRKDQVMIDALGRHIFANFVEAKRMEWAAFRQTVSEWEREQYLELY

SEQ ID NO: 29744 - protein, 221 aa, Pyrococcus furiosus DSM 3638
MEFQLDLIRGEHMEIEKLLEQVNWEKNNGIVPVIVQDEKGEVLTLAYMNKEALRKTLETGIAHYYSRSKGRIRMKGEVSGNIQTVKEIKIDCDNDALLLIVSPKGPACHTGNYSCFYRKLGEPERVLPIDYSLSILKELEEIIKRRKETPVEGSYTSKLFKEGREKIYKKFGEEAIEVLVAEKRERIIYEVADLLYHLLVLLTYNDISLGEVMNELRRRRK

SEQ ID NO: 29745 - protein, 219 aa, uncultured bacterium
NSRLCMSSAVAGYTRSLGSDGPPCSYEDLDHCSVAFLIGTNTAECHPVLFQRLLKRKKRNPGSITIVVVDPRRTDTAKAADIHLPIAPGSDLALLHGIAHLVMRENGQDPAFIDDHTEHYDAFFDVAARWTPRRVALFCNIPEKRLRDVAALFHRREKVLSLWSMGVNQRREGTAVVQGLINLHLLTGQIGKEGAGPFSLTGQPNAMGGREAGGLAHLL

SEQ ID NO: 29746 - protein, 219 aa, uncultured bacterium
NSRLCMSSAVAGYTRSLGSDGPPCSYEDLDHCTVAFLIGTNTAECHPVLFQRLLKRKKKHPGSVTIVVVDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 29747 - protein, 861 aa, Klebsiella pneumoniae
MTETRTTCPYCGVGCGVIASRAPHGQVSVRGDEQHPANFGRLCVKGAALGETVGLEDRMLFPEVDGERATWPQAGGGRFAPAGDYRSARGQAVRFTSGQLLTEDYYAANKLMKGFIGAANIDTNSRLCMSSAVTGYKRARWGTVVPCSYEDVENSDLVVLVGSNAAWAHPVLYQRLAQAKRDNPQMRVVVIDPRRTATCDIADRHLALAPGSDGGLFVGLLNAIAASRRISDDFNDAQRALTIAQDWDLDKVAQFCGLPRQQIADFYREFIAAPRAITLYTMGINQSASGSDKCNAIINVHLACGKYGRPGCGPFSLTGQPNAMGGREVGGLATMLAAHMNFEPDDLRRPARFWGSERLAQTGGLTGLELFAAIGRGEVKAVWIMGTNAMVSLPGTSHAVTEPWPVSLVIISDVADTDTGRFAHIRFPALAWGEKSGTVTNSERRISLQRAFMPPPGEARAAGGLSPAGRGLASALPGSIRTRCSANTPRFQGMKTMASGRLISADWRISAATWIALEPVRWPVSRSEAAWSVHKGWHRDGKLRMVPVAPQPTRATTVASIALLNADPQQRADPRSMAHHDPHPAVRLMQHINEPVVEVPPAEPQRYHLLEGELARVRSPKGVMVAKVTIGEANGPGSLFVPMHWNNQFARQGRVNNLLAAVTDPHSGQPESKQTAVAIATWLPAWKGELFSRQPVPLPCRCTGGGGRPRALSIFRWPGDTPSRDWLVEWCQRQGWQMQVAEGGKVWNLLAWRAGELMLGWWSDASEPAISASWIHARFVPPQNAARAHALLSGRKGGVEMPRGRIICSCFSVGERAIGEAIAGGCRSPGGRLGGKLKCGTNCGSCIPELKALLAANVAQA

SEQ ID NO: 29748 - protein, 132 aa, Rubus idaeus
MARTKETARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIR

SEQ ID NO: 29749 - protein, 219 aa, uncultured bacterium
NSRLCMSSAVAGYTKSLGSDGPPCCYDDLDHCSVAFLIGTNTAECHPVLFQRLLKRKKRNPGSVTIVVVDPRRTDTAKAADIHLPIAPGSDLALLHGIAHLVLRENGQDPAFIDEHTDNYEAFFDVVARWTPRRVARFCNLPEKRLREVAQLFHRRERVLSLWSMGVNQRREGTAVVCGLINLHLLTGQIGKEGTGPFSLTGQPNAMGGREAGGLSHLL

SEQ ID NO: 29750 - protein, 425 aa, Ostreococcus tauri
MHISNIHPHTAPLERALPNKPSPTARDTRAMSHARAPLVKTRSTGTVSSKTSRRGSMTRMGGIHPTSLRTRDSVVVRASADGKKLNGRSTHRVRATKAPPGSALDAAQAFSNLVLDSKKFVADAENAMIDLGPRAGVVSAGVLIHSAKSGGRDAGALEGAMASAMAEGKDFSHVVDKAKANLASMWAQKVEGRVSVELGWQLANDAEGTVMKAREMVALCDETRTPRDKLLFKIPATYAGIKACKTLEAEGVPCHLSHVYCREQAYAAVDAGVSVVQLYYSRLNAWYKAKGSSSDDVDPAYDLVRDTLARVKATGSKTKVMVASLANVDAVMRVLGVDYCLVGQRIIDELAEMPASDLGETIISDARASPGAGGAAANLSEADFLAACAASPAKEELELALKRNAARDADLMNFITQSKAGGGNA

SEQ ID NO: 29751 - protein, 381 aa, Vibrio cholerae O1 biovar eltor str. N16961
MSKRDFYEVLGVGRDASERDIKKAYKRLAMKYHPDRNSGDAGAAEKFKEVKEAYEILTDAQKKAAYDQYGHAAFEQGAGGFGGGGFGGGGADFGDIFGDVFGDIFGGGRRGGGPRAQRGSDLRYNMELSLEEAVRGCSKEIEVPTLVHCDACDGSGAKKGTSAQTCGTCHGHGQVQMRQGFFAVQQTCPTCHGKGKIIKDPCNVCHGQGRKQKTKTLNVKIPAGVDTGDRIRLSGEGEAGEMGAPAGDLYVQVHVKEHHIFERDGNNLYCEVPVSFAMAALGGEVEVPTLDGRVSLKVPAETQTGRMFRMRGKGVKGVRSAALGDLIVKLVVETPVNLSARQKELLKEFEESCGGEAATKHKPKAEGFFNGVKKFFDDLTS

SEQ ID NO: 29752 - protein, 305 aa, Ostreococcus tauri
MPCACAWITGAGTGAPLCSYDFQPKEEPLAVVVFLHGVGEHARRYDGFFRLLNSKKIHVVTYDCVGHGASDGLPGYIQSFDDVVKDARGVLRRTRERFGGGVPIVLCGQSFGGLVAATVAAMEGAEGDGALDGLVLTAASVDVHWTPVLRAQAAVGAALAAAAPKARWVPAVRLEDMTSDAATLESYASDPYVQLGGVRCKTAYEILRGFRSLRNRYQSVRCPLLVLHGGDDACADKNAARRLVSEALSSTKEYVEFAGMHHLILQEPGSDAVQARVVDFIENVARSNSRRRSMHSSSSSLRSRL

SEQ ID NO: 29753 - protein, 470 aa, Coprinopsis cinerea okayama7#130
MSVPATGQFYPLQMHLQNGEPFLRLKKHKNVIITPPRMSDACELCSMTNHPLVFEWSEIPRLPVTLEETEIELKTRKATSDQTLCTLQAAQDGPEFLTVGFCPVDTLRLVLPSGTDTLIGSIFITRCEKGEFLSPAGPSIVDWENRLEHLEDNSSLDVGDPDIVWSLGSVLGWFIAFISQAFVEARNGGVGRLWFAIFLELALILGVLYTLATDSIDLNRLTISVFGGIAIVLTVQGIDEGIYSGVAARNAMGAGYFILTIVNILWVLYFTAEADSLTLHVFNSLGTGGLSGPNRRRRTRTQSVMNMPTTNGGYAGSYAGGGISSGDPYDSKLGGMGYGNGGPGMRSQNSFPSMRDGGAHSISGNTGAGSIHNAPSGGSINGGDNGPSSPLMAGVGAGGTSPQDAPGASDTYPYKAKALYAYSANPEDANEISFAKGEILDILDKQGKWWQARKSDGTVGIAPSNYLQLI

SEQ ID NO: 29754 - protein, 219 aa, uncultured bacterium
NSRLCMSSAVAGYTRSLGSDGPPCSYEDLDHCTVAFLIGTSTAECHPVLFQRLLKRKKRHPGSVTIVVVDPRQTDTAKAADIHLAVAPGSDLALLHGIAHLVMRENGQDPTFIDNCTDNYDSFFDVVARWTPRRVALFCGIPERRLREVAQLFHRREKVLSLWSMGVNQRREGTAVVGGIINLHLLTGQIGKEGAGPFSLTGQPNAMGGREAGGLSHLL

SEQ ID NO: 29755 - protein, 345 aa, Glycine max
MMSNIAFRLTLVFLLFSAVLSTPPEDPIKCATSENTTCTITNSYGAFPDRSICKAAQVLYPTTEQELVSVVASATRNKTKMKVATRFSHSIPKLVCPEGENGLLISTKYLNKILKVDVEARTMTVESGVTMKQLINEAAKVGLALPYAPYWWGLTIGGLMGTGAHGSTLWGKGSSVHDYVVELRIVRAAGPEEGYAKAESLNEQHEDLNAAKVSLGVLGVISQVTLKLEPLFKRSITYVAKNDSDLGDQVAAFGHAHEFADITWYPSQRKAVYRVDDRVPFNTSGNGLYDFIPFRPTPSLELAILRTTEDLQESTGDADGKCIGSKTTTNTLITAAYGLTNNGII

SEQ ID NO: 29756 - protein, 251 aa, Bacteroides fragilis YCH46
MRKNIVAGNWKMNKTLQEGIALAKELNEALANEKPNCDVIICTPFIHLASVTPLVDAAKIGVGAENCADKESGAYTGEVSAAMVASTGAKYVILGHSERRAYYGETVEILKDKVKLALANGLTPIFCIGEVLEEREANKQNEVVAAQLASVFDLSAEDFSKIVLAYEPVWAIGTGKTASPAQAQEIHAFIRSAVAEKYGKEIADNTSILYGGSCKPSNAKELFANPDVDGGLIGGAALKVADFKGIIDAFN

SEQ ID NO: 29757 - protein, 154 aa, Bacteroides fragilis YCH46
MMEKTLVILKPCTLQRGLVGEITRRFERKGLRLAGMKMVQLTDEVLSEHYSHLSSKPFFQRVKDSMMTAPVIVCCFEGVDAIQAVRALAGPTNGRLAAPGTIRGDYSMSFQENIVHTSDSPETAAVELNRFFKPEEIFDYKQATFDYLYANDEY

SEQ ID NO: 29758 - protein, 183 aa, Bacteroides fragilis YCH46
MGTVYAFFADGFEEIEALTTIDTLRRAGLDVEIVSVTPDEIVVGAHDVSVLCDKNFENCDFFDAELLFLPGGMPGAATLDKHEGLRKLILSFAEKNKPIAAICAAPMVLGKLGLLKGRRVTCYPSFEQYLDGADCTNEPVVRDGNIITGMGPGAAMEFALTIVDTLLGKEKVNELVEAMCVRR

SEQ ID NO: 29759 - protein, 291 aa, Haloarcula marismortui ATCC 43049
MSKSLDISTTEAEQTVTEVIDTIVATTPDVRRAVADYRGQSNSVNPTGDDQLAADLRADELFEQRVLGIDGVASYASEERADVKTTDGRLHVAMDPLDGSSNLEPNSGMGTIFGIYSEQPPTVGTNLLAAGFVIYGPITSMVVARDGSVREYILEDGDKRVVDDDVTVPEDPTVFGFGGGVDSWTDEFESYAEAVRHELKLRYGGAMVADINQVLTYGGIFSYPALESRPEGKLRVQFEGHPMAYILESAGGRSSDGDQSLLEIEPDELHERTPLYLGNDDLIDRLEANID

SEQ ID NO: 29760 - protein, 374 aa, Mesorhizobium sp. BNC1
MKADFYETLCVSRNADEKELKSAFRKLAMQYHPDRNPGDMEAEKKFKEINEAYETLRDPQKRAAYDRFGHAAFEQGMGARGGFNGGGFADIFEDIFGDIMGGARQRRSGGRERGADLRYNMEITLEESFTGKTAQIRVPTAVTCDECAGSGARPGSSPVQCPMCHGAGRVRASTGGFFSIERTCPQCQGRGQIIDDPCRKCSGQGRLTEERSLSVNIPAGIEDGTRIRLAGEGEAGLRGGPPGDLYIFLSIKPHEFFQRDGADLYCKVPISMTTAALGGSFEVTTLDGTQTRVKVPEGTQSGRQFRLRGKGMPVLRQPQVGDLYIQVAVETPQNLTRRQRELLEEFEKISSGENSPQSTGFFARMKDFFETFGE

SEQ ID NO: 29761 - protein, 324 aa, Ajellomyces capsulatus
MENYQKIEKIGEGTYGVVYKARDLTHPNRIVALKKIRLEAEDEGVPSTAIREISLLKEMHDPNIVRLLNIVHADGHKLYLVFEFLDLDLKKYMEALPVSEGGRGKALPDGSTLDMNRLGLGEAMVKKFMAQLVEGIRYCHSHRVLHRDLKPQNLLIDREGNLKLADFGLARAFGVPLRTYTHEVVTLWYRAPEILLGGRQYSTGVDMWSVGAIFAEMCTRKPLFPGDSEIDEIFKIFKLLGTPDENTWPGVTSFPDFKASFPKWKREDTRKLVPGLERNGLDLLDAMLEYDPARRISAKQACMHPYFQAGSSAYSGRERLQPYP

SEQ ID NO: 29762 - protein, 294 aa, Vigna unguiculata
MEQYEKVEKIGEGTYGVVYKARDRVTDETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCLFAEMVNRRPLFPGDSEIDELFKIFRILGTPNEETWPGVTALPDFKSTFPKWPPKDLATMVPNLDAAGLNLLSSMLSLDPSKRITARIAVEHEYFKDIKFVP

SEQ ID NO: 29763 - protein, 561 aa, Oryza sativa (japonica cultivar-group)
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKISWLSLHNYYSLTDMIMLQNCTKMFKQVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 29764 - protein, 1186 aa, Aspergillus nidulans FGSC A4
MPSILSDADKETVKRSVPKPANKIHAVAVARLFVAYPDPHKWTYTGLQGAVVLANDLVGRTFWLKLVDVSPAGRGVIWDQEIYENFQYNQDRTFFHTFELDDCPAGLSFADEKEAKTFIKKMSEREKNASKETRQTPFASTRGQGPTPVANGKSHGVGRSIFGSLLGRSSAPTHITPAELPPAPTIQVAPPPPAPAATPPRKELPFDTSDPSWKGLLNELEAMGFTEDQIADNADFIKSYIEQKKASEGESATPPADDRKGKAPPPPPPSVPPPKTSAVSPQHTGSSSGSKRGAPPPPPPSRKTPAKTEDDQAPTPPRDPSPPRPRFRAPPPIADAGKYAHTAGQAPPARPRAASGATPGPPPPPRPPKAPVDDAPPRFGVPPPFQGERKVSAPPAPPSRSPAGPPPPPPRTASPATPPQLPPKVPAFSSGPPPPPPRSPASQPPPPPPVPGASRPVPPPTASVPPPPPPPARPTPTVTGPPPPPPPPPASSGPPMPPPPPPPAPGSSAPPPPPPPPPGAGAPPPPPPPPGAGAPPPPPPPPGAGAPPPPPPPGAGAPPPPPGGAAPPLPQPSGGRNDLMAAIRASGGGGLRKVKDSEKKDRSAAMVPGAASESAAATPSTGGGPQGGLAGALQDALAKRKQKVSGSVFCCSLSHIVRGLIAEAMRNIVDPALSVLENLKSGKRLSRSPQSRNFSSTRSRPILRRFWDFRRKKQAAEPRRGPSLLDDTENLSLARALAAKASNELRLRCTEFDINGNVTLMNGEFKKSELIAKYGLLPRDLRKIDSSTLPHIFVRPSTILINLLHLRVLIKADRVLVFDAYGSTDSYMQSLFVYDLEGKLRQKQAQSTGAGSLPYEFRALEAVLISVTTGLEEEFNGVREPVVRVLRALEEDIDRDKLRHLLIYSKKLGTFEQKARLVRDAIDDLLEADDDLASMYLTERANGFQREEHDHQEVEMLLESYHKVCDEIVQASGNLVTSIRNTEEVVKAILDANRNSLMLLDLKFSIGTLGLATGTLFSALYGMNLKNFIEESDLGFGAVSVTCFAISALVCVYGLAKLRKLQRVRMWGEAGVGGTPIIPLHSSRASAVPGHRANWRADSIEPVWGSLPGEGRAERMKRLKDSSAAAAARSAASNAASTRAASLRRAIRFPSDSAVKGKENQKDAAAAVGADADTGVQTQSGGSTAA

SEQ ID NO: 29765 - protein, 113 aa, Populus tremula
AEEGQVIACHTVDTWKEHFEKGKGSQKLIVVDFTASWCPPCKMIAPIFAELAKKFPNVTFLKVDVDELKAVAEEWNVEAMPTFIFLKDGKLVDKTVGADKDGLPTLVAKHATA

SEQ ID NO: 29766 - protein, 92 aa, Zea mays
MAGIDTQKQLLSLIRDFTSERSRGEQRVVGLKKRIEILQSEVEAANSEVEKAKRIKEVAEEELNGYEVELSLNDATIQSLEGGPGTPIFPPI

SEQ ID NO: 29767 - protein, 225 aa, Oryza sativa (indica cultivar-group)
MRRRLVLGVGAAAAPAVAALAASATPAALRDCAATLLITAGAYSLVRAFDGLTARRLIEQNLSRKIVHVLSGVLFMSSWPLFRELLRGPLYYVIVLLVSVLVFWRQSPIGIVSLSMMSGGDGFADIVGRRYGSAKLPFNENKSWIGSISMFISGFLLSALMLFYFSCLGYFTVCWDLALGKLALVALAATVVECIPVNDVVDDNISVPLATMLAAYLLFGYSSCC

SEQ ID NO: 29768 - protein, 355 aa, Coccidioides immitis RS
MAESNGNGASAVGHESINTDIITLTRFLTEEQTKHPEATGDFTLLCHALQFSFKSIAYYIRRASLINLTGLAGSSNTTGDDQKKLDVIGNDLFVASMRGSGKCRILVSEEEDEAILFNECKGARYAVVCDPIDGSSNLDAGVSVGTIFGIFQLPEEVLSENYTVSAKDILLPGTELVASGFTMYGASAQLVITMKGGTVNGFTLENSLGEFILTHPNMRLPAKRAIYSVNEGNSMYWEEWVKAYFHELKFPANGGKPYSSRYIGSMVADAYRTLLYGGIFAYPADSKSPKGKLRILYECAPMAMVFENAGGQAVNSSMQRLLEVVPESIHDRSGIFLGSFDEVQKVIDTHKKFVN

SEQ ID NO: 29769 - protein, 173 aa, Zea mays
QHLLSSPYRDDPIYVSTMAQEHAHSSAVERLLNCEVPLRAQYIRVLFCEITRISNHSLASTTHAMDVGASTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGPGQCI

SEQ ID NO: 29770 - protein, 219 aa, uncultured bacterium
NSRLCMSSAVAGYTRSLGSDGPPCSYEDLDLCTVAFLIGTNTAECHPVLFQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLVHRREKVLSLWSMGVNQRREGTAVVGGIINLHLLTGQIGKEGAGPFSLTGQPNAMGGREAGGLSHLL

SEQ ID NO: 29771 - protein, 219 aa, uncultured bacterium
NSRLCMSSAVAGYTRSLGSDGPPCSYEDLDHCAVAFLIGTNTAECHPVLFQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 29772 - protein, 219 aa, uncultured bacterium
NSRLCMSSAVAGYTQSLGSDGPPCCYDDLDHCKVAFLIGTNTAECHPVLFQRLLKRKKRNPGSLKIVVVDPRRTDTAKAADIHLPIAPGSDLALLHGIAHLILRENGQDPAFIDNHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLL

SEQ ID NO: 29773 - protein, 444 aa, Burkholderia vietnamiensis G4
MTTVFHRAPRATLPVAVAGDGIEIIDSTGKRYIDACGGAAVSCLGHSNQRVIDAIKRQVQQLPYAHTSFFTTDVAEELADRLVEAAPAGLEHVYFVSGGSEAIEAALKLARQYFVEKGEPQRRHFIARRQSYHGNTLGALAIGGNAWRREPFLPLLIEAHHVSPCYAYRDQAAGETDEAYAQRLADELEQKIVALGAENVAAFVAETVVGATAGAVPPVRTYLKKIRAVCDKYGVLLILDEIMSGMGRTGYLFACDEDDVAPDLLTIAKGLGAGYQPIGATLVSDRIYRTIVDGSGFFQHGHTYLGHATACAAALEVQRVIADEKLLDSVKARGEQLRASLREHYAAHPHVGDVRGRGLFVGVELVRDRDSKAPFDPKLKLHAAVKREAMQRGLMVYPMGGTIDGVHGDHILVAPPFICTAQQIDTIVERLSGAIGAALASAGA

SEQ ID NO: 29774 - protein, 219 aa, uncultured bacterium
NSRLCMSSAVAGYTRSLGSDGPPCSYEDLDHCIVAFLIGTNTAECHPVLCQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 29775 - protein, 271 aa, uncultured bacterium
NSRLCMSSAVAGYTQSLGSDGPPCCYDDLDHCNVAFLIGTNTAECHPVLFQRLLKRKKRNPGSLKIVVVDPRRTDTAKAADIHLPIAPGSDLALLHGIAHLILRENGQDPTFIDEHTENYEAFFDVVARWTPRRVARFCNLPEKRLREVAQLFHHRETVLSLWSMGVSQRREGTAVVSGLINLHLLTGQIGKEGAGPFSLTGQPNAMGGREAGGLSHLLPGYRLVANDQHRQVVEQAWNLPAGSIAAKPGLAAWQQIEAMERGELDLWWVA

SEQ ID NO: 29776 - protein, 302 aa, Ralstonia metallidurans CH34
MQNTQSHPGFRGIWLPLVTPFHRGEVDFDALQRLVGHFSVTGIAGFVVCGSTGEAAALEEPEQLAVLDTVLECANGLPVIMGLAGNHLGHVLARLGRCNERPLAGVLAPAPYYIRPSQDGLRDYFRRLADASRAPLVLYDIPYRTGTTLMLETLLSLADHGNIGAIKDCGGNALNTQALIADGRLAVLAGEDHQLLGTLALGGQGAIIACAHFHPERFVAIWRAVSEGRLDEARRLFYALMPLIQTLFAEPNPGPIKALLARHGWLRDELRAPMTCASPELANQLAAMFDAMDIVSGAVSQP

SEQ ID NO: 29777 - protein, 181 aa, Shewanella oneidensis MR-1
MNTETLSLIKQSIKTIPNYPKEGILFRDVTSLLENATAYKATIDLLVEHYRSKGFTKIVGTEARGFLFGAPLALGLGIGFVPVRKPGKLPRATISQSYELEYGHDSLEIHTDAITANDKVLVVDDLLATGGTIEATVKLIRQLGGEVQDAAFVISLPDLGGEARLTALGLELVKLCEFEGE

SEQ ID NO: 29778 - protein, 430 aa, Ralstonia metallidurans CH34
MSRNQQLFDRAQQTIPGGVNSPVRAFRSVGGTPRFITRAEGAYMWDADGQRYIDYIGSWGPMIVGHAHPDVVRAVQETATQSFSFGAPTEAEIDMAEEICKLVPSIEQVRLVSSGTEATMSALRLARGFTGRDLIIKFEGCYHGHADSLLVKAGSGLLTFADTTQNAPSSAGVPADVTRHTMVLEYNNVTQLEEAFARHKGEIAAVIVEPVAGNMNLVRASEAFLTAMRNLCSEHGSVLIFDEVMTGFRVALGGAQAHYGIKPDMTCLGKVIGGGMPAAAFGGRRDIMAKLAPLGGVYQAGTLSGNPLAVAAGLTTLRLIQAPGFYDRLATQTRKLADGLTKAAREAGVPFCADAIGGMFGIYFTNEVPGSFAEVTKADVGRFNRFFHAMLAEGVYLAPSAFEAGFVSAKHDDAIIEATVAAAAKAFKAG

SEQ ID NO: 29779 - protein, 374 aa, Ostreococcus tauri
MGDARAVARAVAPDVAGDKYPRSGRSAGTSFDELDPEHNTHFGSSDEGKGYDITQITAPVNADMEQMRMNLRDIIGRKNPLLLAAADQIFGAGGKRLRPVLVFLVARATAIKMNMSDITDRQRRLAEITEMIHTASLVHDDVLDDCDTRRGKETIHTLYGARVAILAGDFLFAQSSWFLANLDNLEVIKLISQVIADFADGEISQAGALFNCDITLDEYMEKSHNKTASLIAASCKSASVFSECEESVKIDMYEYGKHLGLAFQVVDDILDFTQSEEQLGKPQGQDLASGNLTAPTIFALKRVPELRGLIENQFEKEGDLQRAIDIVNEHGIAEARKLAKREGDIALASLRQLPDSDAKRSLVGMVGYVLERIY

SEQ ID NO: 29780 - protein, 418 aa, Haloarcula marismortui ATCC 43049
MSPEVNPFESLQEQIDDASDYLEYSTDVLERLKHPERVLETNLSVEMDDGSVEVFRAYRSQFNGDRGPYKGGIRYHPQVTRDEVKALSGWMVYKCAAVNIPYGGGKGGIEIDPRQYSASEIERITRSFAKELRLIIGEDRDIPAPDVNTGQREMNWIKDTYETLENTTEPGVITGKAPESGGSAGRVEATGRSVMLTAREAFDYLGKDIEDATVAVQGYGNAGSVAAKLIEDLGANIVAVSDSSGAVYNPDGLGARDAKAFKSETGSLAGYEGATEELTNEELLTMDVDLLVPAALENAIDGDLARDVQADIVVEAANGPLTPNADDVFTERDVAVFPDILANAGGVTVSYFEWVQNRQRFYWSEERVNDELETIITNAFDDLVETYEETGAPNFRTAMYVVAIQRVVAAAEEGGIWP

SEQ ID NO: 29781 - protein, 372 aa, Zea mays
MRWNATSDEFMSAVSFRNHAIGTSGGRLRRAPTEAKLKVAINGFGRIRRNFLRCWHGRDDDSPLDVIAINDTGDVKQASHLLKYDSLLGIFDADAELVGDNAISVDDKVIKVVSDRNPSNLPWGELSVDLFIEGTGVFVDHEGAGKHIQVGAKKVLITAPDKGNIPTYVVGVNADQYNPDEPIISNTSCTTNCRVPFVKVLDQKFGIIKGTMTTTHFYTCDQRLLDASHRDLRRARAAALNIVPTSTSAAKAVVLVLPNLKGKLNGIALWVPTPNVSVLDLVVQVSRKTLAEEVNQAFRDAAANELQGILEVCDVPLVSVDFRCSDFSSTIDASLTMVMGDDMVKVISWYDKEWGYSQRVVDLDDICANQWK

SEQ ID NO: 29782 - protein, 450 aa, Brassica napus
  misc_feature (89)..(89): Xaa can be any naturally occurring amino acid
  unsure (1)..(450): unsure at all Xaa locations
MGKKAKWFSSVKKAFSPDSKKSKRKSPESPNGVISNPPPPPLADHHARQSSPPAPLEVRVAEVIVEQNINLSAPSTDAVNATTSDIPVXVPSSSAPPEVVVRPRAAAPPRFAGKSNEEAAAILIQTVFRGYLAKRALRAMRGLVRLRLLMEGSVVKRQAANTLKCMQTLSRVQSQIRARRIRMSEENQARQKQLLQKHAKELAGLKNGDNRDDSIQSKEKVEAKLLSKYEATMRRERALAYAYTHQQNWKNNSKSGNPMFMDPSNPTWGWSWLERWMAGRPLDNTSEQNNDNAASKPITRNNSTQPNTPSSARGGGGTPRNKNSFFSPPTPSRLNQSSRKSNDDDATGTISVLSERNRRHSIAGSSVRDDESLAGSQTLPSYMVPTKSARARVNKPQSPSSGGTTQENDGFTAKKRLSYPASPALPKPRRFSAPPKVEGGGVAVTNGGGS

SEQ ID NO: 29783 - protein, 723 aa, Oryza sativa (indica cultivar-group)
MPPRRAALLLLALAVYVPLGTASSTTIASYLLGLWSRAHRHSLPAPAPAPAPAPAPETHRPGIRHPVPRHHRKRPHVAPPLPPPSSSERQVAPYQLFPRIDELEIEIAAGTFLKQSQVRIMGAGSSLQDPEKTTVTVDLVPLGQKFDRTSALLTSNRFLQKKVPINSSIFGDYNVIYVHYPGLPSLVPSVPGSLGPISSSQYPFSANVHNRRHQKINSKSVAIIALSAVVLVLMSFGICIIWKYKGFEKSRGTGRVSNSSATRKTGMRSSFSSMTSSTASFVSTIATCPPTVKTFSISELEKATENFSFNKIIGEGGYGRVYRGTIDDEVDVAVKLLTRKHQNRDREFIAEVEMLSRLHHRNLVKLIGICIERSTRCLVFELVPNGSVESHLHGSDKIYGPLDFDTRMKIALGAARGLAYLHEDANPHVIHRDFKASNVLLENDFTPKVADFGLAKEASEGMDHISTQVMGTFGYVAPEYAMTGHLLVKSDVYSYGVVLLELLSGRKPVDMTQPPGSENLVTWARPLLTDRDGLQQLVDPSMPAASYGFEKLAKAAAIASMCVHVEASHRPFMGEVVQALKLIYNGNNDDTCTSGSFGGGGGEEYEDEEASSPWNNRSWSHDFAATPPPASRRLAFPRAPARPTTMDYSSDPADGAAGTSSASARRQRSTSSLVLDKIESLAAYDWSGPLRASRGRNFYRLRGSMSEHGGHPSEDCSMEGYWM

SEQ ID NO: 29784 - protein, 474 aa, Arabidopsis thaliana
MSATLTGSGTALGFSCSSKISKRVSSSPASNRCCIKMSVSVDEKKKSFSLQKSEEAFNAAKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDLEAVEKLFAAHKGEISAVILEPVVGNSGFIPPTPEFINGLRQLTKDNGVLLIFDEVMTGFRLAYGGAQEYFGITPDLTTLGKIIGGGLPVGAYGGRRDIMEMVAPAGPMYQAGTLSGNPLAMTAGIHTLKRLKQAGTYEYLDKITKELTNGILEAGKKTGHPMCGGYISGMFGFFFAEGPVYNFADSKKSDTEKFGRFFRGMLEEGVYFAPSQFEAGFTSLAHTPEDIQLTIAAAERVLSRI

SEQ ID NO: 29785 - protein, 137 aa, Zea mays
MESPDGSSLPDFLELQRTRVLCKADAPTHTEGFQYSGAFAAMGVDTSVSVEKFCKNFKIEINRLTDEDMEFDMIGVDASIANAFRRILIAEVPTMAIEKVFMVDNTSVIADEVLSHRLGLIPLDADPRLFDYISDDV

SEQ ID NO: 29786 - protein, 271 aa, uncultured bacterium
NSRLCMSSAVAGYARSLGSDGPPCCYDDLDHCSVAFLIGTNTAECHPVLFQRLLKRKKRNPGSLKIVVVDPRRTDTAKAADIHLPIAPGSNLALLHGIAHLILRENGQDPAFIDNHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVTNDQHRQDVEQAWKFPAGSIAATPGLAAWQQIEAMERCEIDLWWVA

SEQ ID NO: 29787 - protein, 327 aa, Coccidioides immitis RS
MVLHNPNNWHWVNKDVSAWAKDYLGEKLAAISAEENGVTAKVSKIVSMDGDVDVSQRKGKVITLFDVKLTLEFEGTTDEDDSVSGSIKIPEVAHDTEEDEYVFDISLYSESASKQPVKDLVRSKIVPQLRTELAKLAPALIAEHGKDIQHAPGSNPSSGFATPKYLSSDVQSSSKPATQTTTTTTRKQAVNTVTVNASDEFRTTAEEMYTTFTDPQRLAVFTRAPPRRFDGAQVGGKFSIFDGNVTGEFVKLEQPTLIVQKWRLAQWPEDHYSTLEIRFDQNDVDCVTTLHVKWDGVPVGQEDVVQRNWDVYYVRSIKQAFGFGTIL

SEQ ID NO: 29788 - protein, 271 aa, uncultured bacterium
NSRLCMSSAVAGYTRSLGSDGPPCSYEDLDHCTVAFLIGTNTAECHPVLFQRLLKRKKKHPGSVTIVVVDPRQTDTAKAADTHLAVAPGSDLALLHGIAHLVMRENGQDPTFIDDCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPAHRAEVEQTWGFPQGKIAPEPGLTAWQQVEAMERGELDLWWVA

SEQ ID NO: 29789 - protein, 271 aa, uncultured bacterium
NSRLCMSSAVAGYTQSLGSDGPPCCYDDLDHCKVAFLIGTNTAECHPVLFQRLLKRKKRNPGSLKIVVVDPRRTDTAKAADIHLPIAPGSDLALLHGIAHLILRENGQDPTFIDEHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVANDQHRQVVEQAWNLPAGSIAAKPGLAAWQQIEAMERGELDLWWVA

SEQ ID NO: 29790 - protein, 488 aa, Zea mays
  misc_feature (47)..(47): Xaa can be any naturally occurring amino acid
  unsure (1)..(488): unsure at all Xaa locations
MAPPQTIPRRGLFIGGAWREPCLGRRLPVVNPATEATIGDIPAGTAXRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 29791 - protein, 271 aa, uncultured bacterium
NSRLCMSSAVAGYTQSLGSDGPPCCYDDLDHCKVAFLIGTNTAECHPVLFQRLLKRKKRNPGSVAIVVVDPRRTDTAKAADIHLPIAPGSDLALLHGIAHLVLRENGQDPTFIDDHTENYEAFFDVVARWTPRRVARFCNLPEKRLREVAQLFHRRENVLSLWSMGVNQRQEGTAVVCGLINLHLLTGQIGKEGAGPFSLTGQPNAMGGREAGGLSHLLPGYRLVANDQHRQDVEQAWKFPAGSIAATPGLAAWQQIEAMERGEIDLWWVA

SEQ ID NO: 29792 - protein, 503 aa, Burkholderia vietnamiensis G4
MKHVSERAPAKAGGAQPRDAERDAMFASHEAGYEQKLKPRHVQMIAMGGAIGTGLFLGAGGRLQSAGPALALVYLVCGAFAFLIMRALGELVMHRPTSGSFVSYAREFMGERASFVAGWMYYLNWATTGIVDITAVAIYMKYWAVFTDVPQWVFALGALGIVSVMNMIGVKVFGEMEFWFSIVKVGTLALFLAVGAVFLASGHPVAGQMPGLHLVADHGGIFPHGILPAVLIVQGVVFAYASIELVGVAAGETADARKVLPKAINSVMWRIALFYVGSVVLLTMLLPWTAYSAHESPFVTFFSKLGVPYVGTVMNVVVLTAALSSLNSGLYSTGRVLRSLAMGGSAPRFVSRMNARGVPYGGILVTVAVNALGVPLNYIVPAQAFEIVLNMASLGIITTWGFIVMCQILFRRAVDRGELSPVSFRMPGAPFTSWLTLGFLVSVLVLMAFDYPGGTWTVAMIPVVVLALVVGWKLAKRGAARDAAAAAAAQAASPIAADPAGSV

SEQ ID NO: 29793 - protein, 478 aa, Ralstonia metallidurans CH34
MHAQHFVANRLIAPDSGLRIKVFDPSSGQPFAEIARGNATDINVAVHAARRAFDGAWGAMSPADRVRLLNRVALTLIEHEDELAALEARDTGKPLRQARADARAVARYFEFYAGAADKLHGQTIPYQAGYTVLTVREPHGVTGHIIPWNYPLQIFGRSVGAALAAGNACVVKPAEDACLSLLRVAELAAEAGLPEGALNIVTGYGHEAGAALARHPDINHISFTGSPETGKLVSQLAAENHVPVTLELGGKSPQIVFADADLDALLPVVVNGIVQNAGQTCSAGSRLLVERPVYEELLDRVASVFESLRVGPSELDLECGPLISRKQQQRVWDFVSDAQHAGISVMAQGQIVAEAPESGYYQVPMLFRDVPATHRLAQEEVFGPLLAAMPFDTEDEALQLANGTAYGLVAGVWTRDGGRQLRLARKLRAGQVFINNYGAGGGVELPFGGTGQSGYGREKGFEALYGFTTLKTIAIQHG

SEQ ID NO: 29794 - protein, 716 aa, Ralstonia metallidurans CH34
MLRRRMRGSTRRVCVVECRHPQPPNPGPSMTHPFFNLYSHGFARVAVGVPECRVADPAFNAEQTILLARQAADGGAVLVAFPELGLSAYTCDDLFHQRALLRECELALQRIVEASAGINAALIVGLPVLVEHQLFNCAVVVAGGKIQGVVPKTYLPNYWEFYEARQFSSADCAATPLVSLLGAEVPFGADLLFEIESIPFFRFHAEICEDVWVPIPPSSFAALAGATVLVNLSASNIVIGKSGYRHQLVSQQSARCLAAYLYTSAGKGESTTDLAWDGQALIYENGELLGESERFADSSHLLFADVDLERLSRERMHQTSFGQSVRRHHEEVERFDTVSFHIDVPSTQALPLQRKVARFPYVPSDPRQRDERCMEVYNIQVQALVQRLSSSKISKVVIGVSGGLDSTHALLVCAKAMDRLGLPRSNILAYTMPGFATSDRTLQQARELMKLVGCTAREIDIRPSCLAMLADLDHPYSRGEPVYDVTFENVQAGERTNHLFRLANHNHAIVIGTGDLSELALGWCTYGVGDHMSHYNVNASVPKTLISHLVRWVAETGQVAEGGQDVLLAVLATDISPELVPSGATAAGQDKAPEQKTEQIIGPYELQDFNLYYTLRFGFTPSKVAFLALHAWGDAARGTWPNGPHVARNVYQLPEIKRVLGIFVDRFFRTSQFKRSCIPNAPKVGSGGSLSPRGDWRAPSDGESVVWMRDLARIPD

SEQ ID NO: 29795 - protein, 238 aa, Arabidopsis thaliana
MNMHNSFFEGLLIDPNDQLLPDPWSKSTIPNAKSELLENFPFLDNMFLVDSEAESLLDHEIRNHKSSKEQITQDYKNLTSKRSEELEENSDEYSPRLLKRPRLETLSPLPSFKVRKEKLGDRITALQQLVSPFGKTDTASVLNEAVEYIKFLQEQVTVLSNPEQNTIGSVQQQQCSNKKSINTQGEVEEDECSPRRYVDLSSRGLCLMPISASYPVAAAAASAAEMNVHLVSGIFHSL

SEQ ID NO: 29796 - protein, 446 aa, Oryza sativa
  misc_feature (54)..(54): Xaa can be any naturally occurring amino acid
  misc_feature (80)..(80): Xaa can be any naturally occurring amino acid
  misc_feature (140)..(140): Xaa can be any naturally occurring amino acid
  unsure (1)..(446): unsure at all Xaa locations
MEIRWLSSTGFPPHLVVGMPALSPTMNQGNIAKWRKQEGEKIEVGDVICEIETXDKLRLKFESLEEGGIWPKIFRHLEGXQKDVQVGQPIAVTVEDLEDIKNIPADASFGGEQKEQSIASEAQKVETDAAKESSIITRIXSPAAKLLIREHRLDQSVLNASGPRGTLLKGDVLAALKLGASSSSTKQKNAPAAPSSQPTHDFQAQSVTIPQQNDAYEDIPNSQIRKVIAKRLLESKQTTPHLYLSQDVILDPLLAFRNELKEQHGVKVSVNDIVIKAVALALRNVPEANAYWNNDKEQAQKCVSVDISIAVATEKGLMTPIIRNADQKTISAISSEVKQLAEKARAGKLAPNEFQGGTFSISNLGMYPVDHFCAIINPPQSGILAVGRGNKIIEPVVDSDGTEKATVVTKMSLTLSADHRVFDGQVGGKFFTELSQNFGDIRRLLL

SEQ ID NO: 29797 - protein, 296 aa, Parvularcula bermudensis HTCC2503
MSGRFIIDVDGQRWFKEEVTPEIGHALRIDRTLYEGEIDHQHLIVFENQRFGRLFALEGFVQISTADEFIYHEMLVHVPFFAHGRAKRVLIIGGGDGGAIREVLRHRTVEQVTLVEIEKAVVDFSKEWFPSLSAGAFDDPRLDLRIADGAAFVKEDQEPYDVILVDSTDPVGPGKVLFTEEFYRDCYARLGDEGIMVTQCGLPFLQAPELKTAYENQSASFAAPRFYTIAVPAYSGGLMALGFARKGGEDPSPADLAARIEKADLGTFKVYSAKTHQGAFMGPAYIDTILKTGQFG

SEQ ID NO: 29798 - protein, 339 aa, Brassica napus
  misc_feature (167)..(167): Xaa can be any naturally occurring amino acid
  unsure (1)..(339): unsure at all Xaa locations
MAGGKIKIGINGFGRIGRLVARVVLQRDDVELVAVNDPFITTEYMTYMFKYDSVHGQWKHHELKVKDEKTLLFGEKPVTVFGIRNPEDIPWAEAGADFVVESTGVFTDKDKAAAHLKGGAKKVVISAPSKDAPMFVVGVNEHEYKSDLDIVSNASCTTNCLAPLAKXVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDSRSSIFDAKAGIALSDNFVKLVSWYDNEWGYSTRVVDLIVHMSKC

SEQ ID NO: 29799 - protein, 541 aa, Ashbya gossypii ATCC 10895
MAIPTPFSPWGKAARTLSRCLSKRNFSKLVIARRLNSTHHRGKPMRLERELRYAIIGGTLLLTYSYMSSCLSSDTIKGIKQYGAPARSLSTSSDGKANGNPDTISLLTDYEVNTKLRSLEESYYVNRGKGVLRYDVSQLPSNNPIEDSRVEQIITVPNEQTQAQEELYFFGIFDGHGGPYTSSKLSEALVPYVAHQLSKIYAQGNEALTSEAIDDAIEQGFLQLDNDIVQKTLGQFFENPSKESLIEALPAVSGACSLLAMYDSNNCTLKVALTGDSRALLGRVDENGKWTVQSLTIDQTGDNADEVARIRAEHPGEPNCVRNGRVLGSLQPSRAFGDYRYKVKEINGKNVYDLPSHLKIFFRKEPREFLTPPYVTAQPEITTAQIDSSARFMVIASDGLFELLTNEEIAGLVVKWMEKHPVKKGFETLKSSARDKIPPVHDTTVHAESQRPAFRYKDANKGSAGFLMEDNNVATHLIRNALSGGGDKRYVSTLISIPSPKSRSYRDDLTVTVVFFGEEQNQPDNQLILNHEATRPLEPKL

SEQ ID NO: 29800 - protein, 258 aa, Anabaena variabilis ATCC 29413
MPTALITGASGGIGKAFAQELAARQTNLVLVARSQDKLHQLAQELQQQHKIQVDVIAKDLTETDAVADVFDITKSQGLTIDCLINNAGFGDYGDFAESDRTRQIKIVQLNVLALVDLTHRFLPLMRQSRSGSIINVASIAGFQPIPYLSVYAASKAFIVSFSEALWAENRQYGVRVLVTCPGPTETDFFTEANFPQALAETTNKVMSSEEVVLKSLKALENWEPTVIISDTSTQLRSNVARLVPRKTLLSLLAKHFKA

SEQ ID NO: 29801 - protein, 288 aa, Xylella fastidiosa Dixon
MFDIPGLSTGDFHGFPSLLIQTPFSHAAISLFGGQLLSFVPSGGEEVMWLSPLVQPPPTAIRGGIPVCWPYFGRQGQRDTMPAHGFVRTVPWQQVESCQENDGSLFLVLGPPPLKHLGLHLRMTLRIGRTLEQELATENISHAPISFTQALHNYFRVSNALQVTVQGLDGVEYLDKFEGYTQRHRQQGNWTLQDPRDPGRADRIYVDTSGHYVLVDPLFSRRIVLTTEGSHSLVVWNPGHAGASNMIDVADGWHDYLCLEPANAGPDEIELLPGARHVLRQSIAIAPL

SEQ ID NO: 29802 - protein, 251 aa, Neurospora crassa
MTEGPAYSKKVVVVGDGGCGKTCLLISYSQGYFPEKYVPTVFENYITYPTHPPTGKTVELALWDTAGQEEYDRLRPLSYPETDLIFVCFAIDCPNSLENVMDKWYPEVLHFCPYTPLILVGLKSDLRNKKTCIDMLKTQGLTPVTTEQGLAVAKKMGAQYMECSSKEMKGVEEIFEQAILTVVANDRKTLEQEAANGMLGVGAGSGSGKGSGISFSSGDKAGSGIGPVKAAGVGGTIVPKTRKKKRKCGMM

SEQ ID NO: 29803 - protein, 208 aa, Triticum aestivum
HELGLTFSNEAGTLPPCGTGGQCCIWQFNFRGFNPHTDPYSPDSIDLLRRSGIDFDLFAVEGVDSTRFAELMMSSGIVLNDDVQWVTFHGSHDFGYLLRLLTGREMPNTLDEFLKLTKIFFPVMYDVKHLMKFCGPGLYGGLSRLGKLLKVERVGTGHQAGSDCLLTLQCFMKLKQLYLKESVKLYDGLLFGLIPGEVEIKTAPPPIG

SEQ ID NO: 29804 - protein, 468 aa, Medicago truncatula
MEENTSSWLRRAKYSQTVCHRLDTSRLNNIPIREQSEQNSRPSSNVKNNLLANKQRSLSPLPETFLNDVFREARHEQKRFSTPGPRRDKRIMGKVSNKDTRESPKVSSTKFLSSSPNGQKMFKDISKDGSWGKYFENGGGGGGKVTALETAEEWTIDMSKLFLGHKFAHGAHSRLYHGVYKEESVAVKIIRVPDDDENGELASKLENQFVREVTLLSRLHHRNVIKFIAASRNPPVYCIITEYLSEGSLRAYLHKLEHKAIPLQKLIAFALDISRGMAYIHSQGVIHRDLKPENVLIDEDFRLKLADFGIACEEAVCDLLADDPGTYRWMAPEMIKRKSYGRKVDVYSFGLILWEMLTGTIPYEDMNPIQAAFAVVNKKLRPVIPSNCPPAMRALIEQCWSLQPDKRPDFWQIVKVLEQFESSLARDGTLTLVQNPRCPDQKKGLLHWIQKLGPVHQNNGPKLKPKFT

SEQ ID NO: 29805 - protein, 401 aa, Coccidioides immitis RS
MKNTTPISLDVNNSEALDAELSKNDLVISLIPYIHHATVIKAAIRTKKNVVTTSYVSPAMLELEKEAKEAGITVMNEIGLDPGIDHLYAVKTITEVHAAGGKITSFLSYCGGLPAPECSDNPLGYKFSWSSRGVLLALRNAAKYYKDGKIESVSGPELMGTAQPYFIYPGFAFVAYPNRDSTMYKERYHIPEAETVIRGTLRFQGFPAMIRALVDIGFLSDEPKDYLNSPIAWKEATKQVLGASSSDEKDLAWAISSKTEFPSTEEKNRIIAGLRWIGLFSDEKITPRGNPLDTLCATLEQKMQYGPGERDMVMLQHRFEIENKDGSKETRTSTLCDYGDPKGYSSMARLVGVPCAVAVKQVLDGTISEKGILAPMSMEICAPLIKALKEEYDIEMIEKTL

SEQ ID NO: 29806 - protein, 271 aa, Pyrococcus furiosus DSM 3638
MINGETKIYGIIGNPVKHSLSPIMHNALFKKFGINAIYVPFEVKKDLKNAINGVKALDIQGVNVTMPYKEEVIKFLDELSEDSQNIGSVNTVVNLEGKLVGYTTDGIGARRALERFTQVDGANILILGAGGAGKAIAYELSKVANVVVLNRTIEKAKRLEKFGIVGDSLEALPYYVEWADILINATSVGMNEEKSLVPKNLLRPGLVVMDIVYKPLNTLLLRYAQEKGCIAIDGLWMLVYQGAESFRLWTGEEGDVELMRRVALAWLRERK

SEQ ID NO: 29807 - protein, 523 aa, Glycine max
MEAPWATTSSSIVFVIVILALTSWAWRMLNWLWIRPKRLERLLREQGLQGNPYRILVGDLKEIVKLQMEARSKPMNLSHDIVPRVFAHLHQSVLKHGKNSFIWFGPKPRVTLTDPELIKDVLNKISDFRKPEANPLAKLLATGLVNYDGEKWNKHRRLINPAFSLEKLKIMLPIFFKSCNDLIIKWEGMLSYDGSCEMDVWPFLQNLASDVIARTAFGSSFEEGKRIFQLQKELAELTMKVIMKVYIPGWRFVPTATNRRMKEIDRYIKASLTDMIKKREKAPKTGEATRDDLLGILLESNHKEIQEHRNNENVGMNLNDVIEECKLFYFAGQETTSVLLVWTMVLLSRYPDWQSRAREEVLQVFGKQAPNFDGLSHLKIVTMILYEVLRLYPPGIGLTRSVHRDMKLGNLTLPAGVQVSLPIIMVHHDRELWGDDAKEFNPERFSEGVSKATNGRVSFFPFGWGPRICIGQNFSLLEAKMALSMILQHFSFELSPAYTHAPFTVITLQPQYGAHVILRKVEM

SEQ ID NO: 29808 - protein, 462 aa, Listeria monocytogenes
MFKTNVEQNNVPVFGSFESGQDLPEKRMNKESVDPRIAYQLVKDQLIDEGSARQNLATFCQTYMEPEAEQIMAETMEKNAIDKSEYPQTAKLESSCVNMLADLWNVDESEHYMGTSTVGSSEACMLGGMAMKFRWRSAALKNGLDIHAKKPNLVISSGYQVCWEKFCVYWDIELREVPMSEEHLSINTDIIMDYVDEYTIGIVGILGITYTGKFDDIMTLNDLVEDYNNTHDNEVVIHVDGASGAMFTPFVEPGLEWDFRLPNVVSINTSGHKYGLVYPGVGWILWRDKEYLPEELVFDVSYLGGHMPTMAINFSRSASQIIGQYYNFLRFGYEGYRQIHMRTRDGALQLSQAVAETGLFEIYNDGANLPIVCYKLKDDANVAWTLYDLADRLQMKGWQVPAYPLPKEMGNTIIQRYVCRGDLGQNMVTAFKNDLSESIEELNNAHILYHDVNTSKTHGFTH

SEQ ID NO: 29809 - protein, 464 aa, Listeria monocytogenes
MLYSKENKESYLEPVFGSSAEDRDIPKYTLGKEPLEPRIAYRLVKDELLDEGSARQNLATFCQTYMEDEATKLMSETLEKNAIDKSEYPRTPELENRCVNIIADLWHAPKDQKFMGTSTIGSSDACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVCYKLKTTANVNWTLYDLADRLQMRGWQVPAYPLPKSLENIIIQRYVCRADLGFNMAEEFIQDFQASIQELNNAHILFHDTQQSGVHGFTH

SEQ ID NO: 29810 - protein, 149 aa, Parvularcula bermudensis HTCC2503
MADGPAFAESVARLASPVRAGGYTAIAGIEARGLVFGAAVAAATGLGFVPIRKPGKLPATVLRESYELEYGRDALEIHHDAIAAEAKVFLIDDLLATGGTLLAAATLIERLGGTVGGAGVVVDLPDLGGSRRLAERGIPLHTLVCFEGE

SEQ ID NO: 29811 - protein, 469 aa, Photobacterium profundum SS9
MSVENVLALIQENEVKFIDLRFTDTKGKEQHITIPSHQIDSDFFEDGKMFDGSSVAGWKGINESDMVMMPDASSAVLDPFTEDSTLNIRCDILEPATMQGYDRDPRSIAKRAEEFMRSTGLADTVLVGPEPEFFLFDDVKFNTDMSGSFFKIDDIEAAWNSGSDFEGGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHMSLNKDGQNLFAGDKYGGLSEMAIYYIGGIIKHARAINAFANPATNSYKRLIPGYEAPVMLAYSARNRSASIRIPVVPSPKARRIEVRFGDPAANPYLAFAAMLMAGLDGIQNKIHPGEAMDKDLYDLPAEEAAEIPQVAESLEIALKNLDEDREFLTAGGVFSDDFIDSYIKLKSEDVEKVNMTTHPLEFELYYSV

SEQ ID NO: 29812 - protein, 255 aa, Ashbya gossypii ATCC 10895
MSVTPIEELPSLGDALEDAKRAASYRAVDENLDPAKHRVVGIGSGSTVVYVAERIGKYQASPELKAKVEFICIPTGFQSRQLILDNGLRLGSIEQYPEVDIAFDGADEVDPELNLIKGGGACLFQEKLVSTSSAQFIVVADSRKRSPQRLGTSWTRGVPVEVVPSAYVRVLRDLHGIPGCRSAQLRLGEPGKAGPVVTDNNNLLIDADFGPLEDPAALHARIKALVGVVETGIFAGNAAKAYFGSADGSTQTLAR

SEQ ID NO: 29813 - protein, 458 aa, Bacillus clausii KSM-K16
MKQKRVAIVGAGATGLSAALWLHDHSDLQYDVYEASNQVGGKIVTYKDRGFVIEGGADSYLERKASMTHFIQRVGLGDSLVRNEVGQSYILKSGTLFPTPKNTVLGIPTDIDAFLETKLISDEGKRNLLKEYEKPRFAKPGEDVSAGAFFEYRLGKEMVDSLIEPLLGGIYGGNIYELSMKAIFPHFLQYEAEYGSLLKGVAATKSTSKQAKKQGMFLTVKSGLASVLEAAAEQLRPGSVHLNAAVERIDVLDDGAFTVFVNGTQKRYDAVIVTIPPQQAAKLFVEINPFSDIGSIEATSCATVAMIFPEGAVDNEHEGTGFVVARGGDETITACTWTDLKWPHTSPSRETLLRAYVGRPGEEAIVEANDQTIVNAVLADLQNVMAIRTRPTFYRVTRWKKAMPQYQVGHLQRIERFKKACAKHPGLYVTGAYFGGVGVPDCIDQGQACAKQLMNETT

SEQ ID NO: 29814 - protein, 274 aa, Zea mays
MSHFGRSGPPDIRDTFSLLVLNISFRTTADDLFPLFERYGKVVDVFIPRDRRTGDSRGFAFVRYKYADEAQKAIDRLDGRDVDGRNIMVQFAKYGPNAEPIRKGRVKEGVEKSQDRSRSRSPRPRHRDRDHRSQSRSRSRERHVRDRDRGYRRRSRSRSQSLSSSPDNRSHHRARDDDRRKSMSKSRSRSRSTSRSRSYYSASPARHSASPRKSPPPQRSPTPAKHANGKDSPLSRCVSPLPKRATSRSPGSDGKVRLMSNCLLCSLLPMHLFM

SEQ ID NO: 29815 - protein, 338 aa, Mesorhizobium sp. BNC1
MGVVLNLEDGKRNGASIERLIGLTKDDMARVNDLILSKAGSDVELIPQLARHLISSGGKRLRPMITLAAAQMFGYSGEGHVKLATSVEFMHTATLLHDDVVDESDMRRGKKTARTIWGNQASVLVGDYLLGQAFRMMVDVGSLEALDVLSSAASIIAEGEVMQLGVSKNLETTEDEYLSVIKAKTAALFSAAAEVGPIIAEASRNDRAALRSFGINLGLAFQLVDDALDYGGSSRDLGKNVGDDFREGKVTLPVILSYRRGSEEERLFWKRAIEENQNDDDALAKAIGLMNRHGSIGDTIARARHFGEIARDALAPLKSTPQKAALFDVIDFCISRVS

SEQ ID NO: 29816 - protein, 233 aa, Arabidopsis thaliana
RSHTKFSFTLVNKISEKLSKLKETQQWFDKNAPDWGFTEMISLTELHAEEGLLRNGELTVVAKVEVLEVVGKLDVSEESSPVIETIDVNGFQVLPSQVEYAKSLFERHLDIASKFRPKNPYLKTAYMNVLLSLTQTICQSPQELSNDDLSDAGAALAYLREAGFELDWLEKKLNEVKEKKKKEEACLAEIQDMDEHVKPLKKKYLDLEAQIDKKKAELLAARAPLSLNDDNVV

SEQ ID NO: 29817 - protein, 397 aa, Leuconostoc mesenteroides subsp. mesenteroides ATCC 8293
MPEVKPSLLNNLNQHLKLVGPSAIRAFDIEVSEIPDIIKLTLGEPDFNVPDHIKQAAIRSIEANDSHYAASNGTIHLREAAAGFLADRYDIDYDPTNEIIVTIGATEAIYDTLTTILNPGDKIILPTPIFPLYIAVGLVDGAEPVFIDTSSNDFVLSPEMLKAAIAKHGDDIKAVVLNFPSNPTGVTYNDEQIKAIADVLRGTDIIVISDEIYSELSYENSHVSMAKYLPEQTILLNGVSKSHAMTGYRIGILAGPAQLVQKIAMIHQFATTTASNPAMAAAAEALGTEAGRQDTLVMKAEYLQRRDYVYDTMTQLGFKVAKPDGAFYIFAKIPAGYIQDDFAFARDLAQNNGLALIPGSSFGPGGEGYVRLSYAASIETLQKAMHRLTAYMEENGK

SEQ ID NO: 29818 - protein, 466 aa, Leuconostoc mesenteroides subsp. mesenteroides ATCC 8293
MSLLARAFKRESVDNYLSADSHMSRVLTTRDLISLGVGTVIGTGIFILPGHEAADHAGPAVAIAFLIAAIFSGLSGMAFAEFSAAMPVAGSAYSYGGAIYGEIIGWLLGWSLIVEYFLAVSAIATGFSAYLGNLLAIFGIHIPKYLSAGPMEGGIVNLFAVLIILFVAAILSRGLNTSKKVENGAVVIKIAILILFIVGGSFFIKTSNYVPFYPKEFHSGLGGLNGIWAATASIIFAFLGFDTIAAHAAEVKNPQKTMAKGIVGTVIISALLYTLFSIVLTGIVNYKKLGVDDPAAFALQVVHQTQFSIVITIGALIGMFTAVLALIYASSRLTYSFGRDGLLPRSLGKISPGSHLPVNALILAVAVEVIFAGLIPLSTLASLINAGTLTAFAFINFGILILRRRKDLAHDGFKVPGYPIVPFIAGMISLFFITQLSAETLKMFGLWLLLGVIWYFSYGIKHSKLS

SEQ ID NO: 29819 - protein, 219 aa, Glycine max
  misc_feature (174)..(175): Xaa can be any naturally occurring amino acid
  unsure (1)..(219): unsure at all Xaa locations
MAHPTSSGQSHDLKKEDCKETRSLVVCFGEMLIDFVPTVGGVSLAEAPAFKKAPGGAPANVAVGISRLGGSSAFIGKVGADEFGYMLGNILKQNNVETSGMRFDSNARTALAFVTLKTGGEREFLFFRNPSADMLLQESELDKNLIKKAKIFHYGSISLIDEPCKSAHLLLMRXXKESGCIPFRNDPKFENWHMGQSGWKAGSGMGNKWSYGGSKAGLF

SEQ ID NO: 29820 - protein, 209 aa, Triticum aestivum
  misc_feature (118)..(118): Xaa can be any naturally occurring amino acid
  misc_feature (165)..(165): Xaa can be any naturally occurring amino acid
  misc_feature (197)..(197): Xaa can be any naturally occurring amino acid
  unsure (1)..(209): unsure at all Xaa locations
VDPRVRCKLRVVAHAHVPTVPATEAGETRVIFFLCSCSDPIPCSSTPFAARRGAAQHRGVGGDVGSDGGRGQVARAQSEEDAAMQEVVDGADLGYVGDDTPVSTPGAGLKGSSLETGXVCVFPKNAGKIVPTGEETELLVGLQNEGESTLNVVAVHSTLHLPYDXKMYGQNLTVQSFYNASVPVSVQATFPYTFAVXSKFLQPGAYDLV

SEQ ID NO: 29821 - protein, 125 aa, Propionibacterium acnes KPA171202
MRRVQTEEPTLAPAIAARLRRNDAGLVPAVVQDAATGDVLMMAWMDDVALARTLATRRATYWSRSRQEYWVKGETSGHTQHVCSVRLDCDGDTLLLRVDQVDGACHTGDHTCFDADVLLAEEVES

SEQ ID NO: 29822 - protein, 450 aa, Ipomoea batatas
LTVEAPILERRRANPKNVAAIILGGGAGTQLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECSVEHSIIGERSRLDCGVELKDTLMMGADTYETESEIASLLADGKVPIGVGENTKIRNAIIDKNVRIGKDVVIMNKDGVQDSDRPDEGFYIRSGITIIMEKATIPDGTVI

SEQ ID NO: 29823 - protein, 552 aa, Zea mays
GFVVSLYVKVELRPFGLHNLGNSCYANAVLQCLMFTRPLTTYLLEGLHSKNCSQNGWCFMCEFEKLIVEGKRRKIALSPTGILSHLNDIGSSFGPGKQEDAHEFLRYAIDAMQSVCTKEARKGGVLRSAEETTLVQLIFGGYLRSKIKCSRCHVSSEQCEPMLDLTVEIDGDISSLDEALVRFTSTEALDGENKYHCSRCKSYERAKKKLTIEEAPNILTIALKRYQSGKFGKISKAIRFPETLNIVCYMNPDTDDISPVYSLYAVVVHHDVMNAAFSGHYVCYVKDTHGKWFKADDSQVKPVSLDNVMSKCAYMLLYARCSPRAPSSVRQAISDPARPKKAKQKVVPGGTTWRGGSFNRHQDGQRHSNHTADDLTHAFDEYRNAPYSPSDSPSPSESSSLFSNSDAGSHSTVSTDSSESTRNSTSTEEYEYVFGAADQMYPGGPHGRSTCGDDYSTYSRSRSSLNTSSSGRDAYSAASSADHKHQVVGSGGQVEGDESTSLLYTDRSNQQLSSKLTDQYRQLDGSGHDPGETRGGVLLRRPSRDRTAQTFY

SEQ ID NO: 29824 - protein, 261 aa, Solibacter usitatus Ellin6076
MAKGMALITGASSGIGAELARLCAADGYGLILVARRTDRLEQLGAELAAAHNVKFRTIAADLAEPDAATAIYRQTSGDTIDILINNAGFGLRGRYDQTEWNAEARLIQVNITALAQLTKSYVKDMVRRGSGRILNVGSTAAFVPGPLMAMYYASKAFVVSFSEALAKEFEGTGVTVTVLCPGPTRTEFDAAAGITDSKLFRGSAMTAQEVAQIGYRAMMAGQAEVIAGARNRWMILSTRLAPRTMLAAIAKRLNSSEHSVQ

SEQ ID NO: 29825 - protein, 463 aa, Synechococcus elongatus PCC 7942
MPDSVVLPATLQTALQTAEQLLWDRALVRYHDQWAGAIAALPEDQELAAANYREIFIRDNVPVMLYLLLQGKTDVVRDFLQLSLSLQSQALQTYGILPTSFVCEETHCVADYGQRAIGRVVSADPSLWWPVLLQAYRRASHDDAFVHSPTVQQGLQRLLAFLLRPVFNQNPLLEVPDGAFMVDRPLDVAGAPLEIQVLLYGALRACGQLLQYTEAANAAHVQARRLRQYLCWHYWVTPDRLRRWQQWPTEEFGDRSHNPYNIQPIAIPDWVEPWLGESGGYFLGNIRAGRPDFRFFSLGNLLAIVFDVLPLNQQGAILRLILQNEAQILGQVPLRLCYPALTGSAWKILTGCDPKNQPWSYHNGGSWPSLLWYLSAAVLHYQQRGGDRNLCQVWLNKLQHYHTQQCEQLPGDEWPEYYEGQDSVQIATRACRYQTWTFTGLLLNHALLSQPQGIQLLSLRGLP

SEQ ID NO: 29826 - protein, 207 aa, Solibacter usitatus Ellin6076
MSDPQAIFFDFDGVLLDTEPVHWACWADRLATLDVTLTWEYYRDCCIGIDDRVMLRNIACEAKPARDWETLWALYPAKKKLFQVRMTTPPFEAALVDLLPELRRTHRLAVVSSSSCSEIEPLLISAGIRGHFETIVGGDDVQRHKPAPDPYLLAAERLGVSHALVLEDSEAGLASGRAAGFEVLRVGHPSEVVGLLRRRLSGSGTSA

SEQ ID NO: 29827 - protein, 1378 aa, Coprinopsis cinerea okayama7#130
MANTPADTLTLNGDPASSGDLSITRHRPTDDVVAQAEEEFNALSRQLTSHSQRDVKRVSKKLSTETTDVEAANSDDGQVFDLREYLTSSNDANQRAGIKHKVRWASGVLKPGEMCLVLGCPGSGCTTFLKAIANKREEFAKVSGNVLYAGIDAAEMQKYYKGEVISKTPGPNGRLPGLSRKEFDREVEDTLLRMLNIPHTKNTLVGNEFVRGVSGGERKRVSIAEMMATRARVQSWDNSTRGLDASTALDFVRSLRVMTDVLGQTTFVSLSVALIQSLRHTTDKTSLCNRYQASESIYQLFDKVLLIDKGRQVFFGSPSEARAYFEDLGYNPLPRQTTADYLTGCTDVNERQFAPGRSARDTPSTPEALENAFRQSKFGKQNTEEVERYKAYMATEKADQEAFREAVAADKKRGVSKNSPYTLGYTGQVWALTKRQFQMRLQDRFQLYTSFSLAIALALVLGGAYFNLPATSAGAFTRGSLYRASAISAANLLADIPFSAVRILIFNIIVYFMAGLHRSAGAFFTFHLFNYVGFLVMQSFFRTFGLICFDFNHAFRLGVFFIPNFIQYCGYTIPVLDMKRWLFWIYYVNPLSYAWQACMENEFMRLRFTCDGNYVIPRNGLGIVKYPDNLGPNQACTVFGATSGNNIIEGTNYLKVGYDLDVANLWRLNLTVLIGFFIFFQLAQFIALEFYPQYGYTPTVNVFIRESEETKALNQAQRERKQQRDVLKEKGEALEAKESLDRSKEVVHKGRAFTWERLNYHVPSPGGSLRLLHDVYGYVKPGTLTALMGASGAGKTTCLDVLAQRKNIGVVSGDILVDGRPLPLDFARGTAYAEQMDVHEGTATVREAMRFSAYLRQPSSVPKEEKDAYVEEMIELLELTDLADALVFSLSVESRKRLTIGVELASKPELLLFLDEPTSGLDAQSAWNLVRFLRKLADQGQAILCTIHQPSSLLFESFDRLLLLERGGETVYFGEIGEDSKTIRDYFARHGAHCPANVNPAEYMLEAIGAGVAPRIGNKDWKDIWLESPEFKQVLAEIEQIKAEGLSRPEPAKADTRTYATSFFVQLREVAKRNTLLLWRTPNYIFTRFFVCSFISLFISLSFLQLGNSSRDLQYRVFSIFWTAVLPAILLTQTIPSFIANRRIFIREASSRIYSPYVFAIGQLLGEFPYSVVCALLYWVLMVYPTGFGQGEAGLDGTGFQFLIILFVVLFGVSLGQFIAALCPDVQIAVLTIPSVSLVLSTFCGVTIPYPALEPFWRSWLYHLSPYTRTLAAMLSTELHGLAIKCKPDEFAVFNPPTGETCASWAQEFVDRFGGYLDNPLDTIACRYCQYKVGDEFFVPLNIRFENRWRDAFIVFSFFVFNLIGTIIASRFLRYAKR

SEQ ID NO: 29828 - protein, 1096 aa, Parvularcula bermudensis HTCC2503
MPKRTDIESILIIGAGPIIIGQACEFDYSGVQAVKALKDEGYRVILVNSNPATIMTDPELADATYIEPITPEFVTKIIAAERPDALLPTMGGQTALNCALALLDDGTLDTYGVEMIGARGDAIRMAEDRELFREAMDRIGLENPRATIAKSPEIRDATGKLVGYNRAQGFANAMADLDTIGLPAIVRPAFTLGGTGGGVAYNREEFERIVKAGLDASPVGQVLIDESLLGWKEYEMEVVRDRADNCIIICSIENIDPMGVHTGDSITVAPALTLTDREYQRMRNASLAVLREIGVETGGSNVQFAVNPEDGRLVVIEMNPRVSRSSALASKATGFPIAKVAAKLAVGYTLDELDNEITGGAMPASFEPTIDYVVTKIPRFAFEKFPGTKPLLTTAMKSVGEAMAVGRTFQESLQKALRSLETGLSGLDPIEIDGLGEGNDIDAFRRALAAPTPERLRVTAEAMRAGVPVEQVRSVTSYDPWFLEQIRGIVDAEKEVAQFGLPATAKGLHALKGMGFSDKRLAALAEATEEEVRAYRRELGVHPVFKRIDTCAAEFRAVTPYMYSTYEWQGEDESAPSDRGKVVILGGGPNRIGQGIEFDYCCCHAAFALEDAAIESIMVNCNPETVSTDYDTSDRLYFEPLTAEDVLELINRERQNGNLIGVIVQFGGQTPLNLADTLAAEGVPILGTPVEAIALAEDREKFQRLVRELGLKQPLNATAGHRDKVVEIAGQVGYPLVTRPSFVLGGRAMEIVHDETGLKRYLQTAKIEITDRLPLLLDHYLQNAVECDVDAICDGTDVFVAGVMQHVEEAGVHSGDSACSLPPYTLSDDIIEELKRQTIAMGKALGVRGLMNVQYAIKDDEIYVIEVNPRASRTVPFVAKTIGIPVAKIAARIMAGASLDMFDLPTAPPRHVAVKEVVFPFSRFPGVDTVLGPEMRSTGEVMGLDVDFDRARAKSLIAAGTKLPLEGTVFISVKDRDKEGIGNAARDLCAMGFDLMATGGTAAFLSQQGIPVKPINKVLEGQPHIVDALINGDVQLIFNTTETLQSIEDSRSIRLTALQRRIPCITTLAGAKAAVRAIAAVREGDLEARPLQAYSL

SEQ ID NO: 29829 - protein, 339 aa, Bacteroides fragilis YCH46
MKEIDWANLSFGYMKTDYNVRINFRNGAWGELEISSSEVLNLHMAATCLHYGQEAFEGLKAFRGKDGKVRIFRLEENAARLQSTCQGIMMAELPTERFKEAILKVVKLNERFIPPYESGASLYIRPLLIGTSAQVGVHPADEYMFVVFVTPVGPYFKGGFSTNPYVIIREYDRAAPHGTGIYKVGGNYAASLRANKKAHDLGYSCEFYLDAKEKKYIDECGAANFFGIKDNTYITPKSTSILPSITNKSLMQLAEDMGMKVERRPVPEEELSTFEEAGACGTAAVISPIERIDDLENGKSYVISKDGKPGPVCEKLYNKLRGIQYGDEPDTHGWVTIVE

SEQ ID NO: 29830 - protein, 251 aa, Photobacterium profundum SS9
MVHFTQFYIKVISLLHEDLTELTVNQPLNYRNTGFITSAPDIRHLPQDTGVEIAFAGRSNAGKSSALNRITDQKGLARTSKTPGRTQLINMFEVTQGCNLIDLPGYGFAQVPLELKIKWQKALGEYLQKRECLKGLVVLMDIRHPMKDLDQQMIFWAIESRLPVLVLLTKADKMKSGARKAQLLKVRESSKSFGGDVQIELFSSLKGIGLDQVRRKLDTWFGPELERQLMLAAAENGETYTGESLSDKSDD

SEQ ID NO: 29831 - protein, 173 aa, Triticum aestivum
  misc_feature (107)..(107): Xaa can be any naturally occurring amino acid
  misc_feature (115)..(115): Xaa can be any naturally occurring amino acid
  misc_feature (124)..(124): Xaa can be any naturally occurring amino acid
  unsure (1)..(173): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGXYYDGRYWXTMWKLPMFXGCTDATQVINEVEESKKEYLTRIPHHRIDNMRKCSASLIANNGLQDPEG

SEQ ID NO: 29832 - protein, 300 aa, Synechococcus sp. WH 8102
MPQAASHESADAGARLAIRLLQDAAERGELDPWDVDVIAVVDGFLDQLRQRIEVPRQVAAVLDGRGGSYERDLADSSEAFLAASVLVGLKAEVLEASILPPPVEVEEYIDAEFDAQGWLDQSFDLPHRPERHLQRRPVAPPPLRRPVTLGELIEQLESIAEHLEADELEARRRQRKRRFSNREAIAQVAGLAHREKLPETTAALGVYLNGWEDALDWIDFERLVQRWTSVAPGDLDTDRVGVFWALLFLSSQGAVELEQEGWLHAPLRLKRIPASGSFTQLPITRLEVPDPVPTRTTQAA

SEQ ID NO: 29833 - protein, 1820 aa, Anabaena variabilis ATCC 29413
MNRQHKHHRCNPVNFLSKQNLLPFLLGIVILLVVVMLWLRLQAEEEIKIQQLIKQQAIATQTELVTQLKTRILALKRIGKHWEMHGSIPQAQWELEARAYLEDYGGYQAIKLVDPSWQVLRSVSVAKNKAAENLEIMPKFPQCKGATAQPSHETTLTHTVNLNQGDRVFFACVPLWMGDKFGGAVLGIFQVKQFFESVLHIAPGYKIRVFDGQELIYGQDRQSSTLPSWQQSVNINFDGMTWQLQIYPTPELLKDLYSPLPTVVLVAGIFNAGAVTLLIYFAQATKLSNHQIGRINQELADRIEKQTQVEIALRASENRLRELLETVRVIPWEVDLKTQHFTYVGPQAETLLAYPIAQWYEENFWDNHLHPHDRDWAVRFCQEAANKGQNHELEYRMLAADGRVVWLRDVVNVVEVDGTPVMLRGFMFDITDLKRVEETLRLRERALAASSNGIVISDAKLPNYPVIYVNSAFEQITGYKATEIVGRNCRFLQGNDTTQPAIEELRSALKAGKNCKVILRNYRKDGSLFWNQLSVSPIYNDNGQLSHFIGIQTDISDRQQAEASLRRQALTFENIYDGVIITNLQGQILDWNPAAERMFGYSKDHICGQSISILHKVEEDAALNSAIIAEITKQGRWSGEINFVRQDGSQGICETTIVALQDDQGQTVATISVNRDITERKHAELLLRRSEERFQAFMNHSPTPAWITDIDGTIVYLSETYRRTFQLPTQELIGTNIFDIYPPELIQTFRETIQIVARTHQVMETVESVPCSDGTVRDFLVYKFPISSKPDECLIGGIAIDITERKQAEAALRKSEERWQLVIEGNQDAIWDWNIITNETFRSARWAELIKEQNYQPIADHADCISRIHPDDYERVMAVRQDCLSRKIPNYVVEYRLRCNDDSYKWVLVHATGQWDERGNPVRMVGSIKDITERIEAQEALQRQLHRTLLLEKITQKIRQSLDSKEIFETAATQIGQALAVDRCLIHSYISHHDPHIPLVAEYNNVLDYCSMQKWEFTTTGNRHILQMMSQDKAIASANVYTDPLLQTAVPSCCEIGVKSMLAVRTSYQGEPNGAICLHQCKYFRQWTPEEIELLEAVAAQLGIALAQAQLLEQETRQREELTIKNFALEQAKRAAEAANRAKSEFLAMMSHEIRTPMNAVIGMTGLLLDTELTSQQRDFVETVLTSGDALLSIINDILDFSKIESGKLELEEQPFEVRTCVEQVIDLLAAKAAQKDIELAYLIHPQVPMQIAGDLTRLRQILTNLLNNAIKFTPEGEVVVSVRSQPSPNQKTKNCCEIIFTIKDTGIGIAPETMDLLFQPFVQADASMTRKYGGTGLGLVISKRLGEMMGGYLWVESRGCVGGNPPPGWQRKNSISSASVATGSTFYFSMTVPVVAHADLETSITSPVQLSGKRLLIVDDNPTNRQILRLQAEPWQMETYTAPSGAEALALIDQGMAFDIAILDVQMPEMDGLTLARQIRQRPSYQHLPLVILTSWGQPDTDLSDIEFAACLNKPIKQSQLFDVLAASLGNQPIRASVVPDRSAQVNSCLAQQIPLRILLAEDIVVNQKVALLILKKLGYRADVVANGLEVLEALQRQSYDVVLMDVNMPEMDGLKASQIICQTWSPRSRPYIIAMTANAMRGDREACLAAGMDHYISKPLQLEELAKALGKCHPSTSSTEKALEKTSSQNQTFTDISDLKFATIDTKILQALRDMLGGDKVAFAELINCYLTESPKLIENLNVAINTEDTQGIWKTAHKFKSSSGSVGAVFLAQLCKLLEAKGRNNNLEGCIELGSQLCQEYELVKTALYREVNKETP

SEQ ID NO: 29834 - protein, 397 aa, Synechococcus sp. WH 8102
MSETPMKAMILAAGKGTRVQPITHVIPKPMIPILQKPVMEFLLELLKEHGFNEVMVNVSHLAEEIENYFRDGQRFGVEIAYSFEGRIEDGELIGSALGSAGGLKKIQDFQNFFDDTFVVLCGDALIDLDLTEAVRRHREKGALASLVTKRVPKEQVSSYGVVVTDAEDRISHFQEKPKVEEALSDTINTGIYIFEPGIFDHIPSGVSFDIGSDLFPKLAELGAPFYAIPMDFEWVDIGKVPDYWQAIRSVLLGDVRQVGIPGKEIQPGVYTGLNVAANWDKINVSGPVYVGGMTKIEDGATIVGPAMIGPSCHICEGAVIDNSIIFDYSRIGAGVQLVEKLVFGRYCVGKDGDHFDLQEAALDWLITDARRQDLVEPSPQQKAMAELLGTELTQAAS

SEQ ID NO: 29835 - protein, 334 aa, Anabaena variabilis ATCC 29413
MQVGQKEAAAAALADELRAKAFGITPANVEEMIRERSLLLQAVLPAFNQFCQNNLKIPPEKMFPVLWDLWLPLGMKIAAQHQKLKHPFIQGILGSQGTGKTTTSLVIQIILQQLGYRTLSLSLDDLYKTYSDRLALLQQDPRLIWRGPPGTHDIDLGLNVLEQIRQGKSPVIVPRFDKSAHSGAGDRTDSDVITGVDILIFEGWFVGVRPIDPSLFNFPPPPILTNEDQAFARDMNRQLNNYLPLWEKLDSLILLYPTDYRCSLEWRKQAEQKMIAAGRTGMSDAQIEEFVNYFWRSLHPELFIQPLSQCAALVDLVVEIHPDHTFGRVYQPNR

SEQ ID NO: 29836 - protein, 495 aa, Zea mays
MAMLVLWLAWLLVSLIAVYFLDLYVHARRGLPPGPRPLPLIGSLHLLGDQPHRSLARLAKFHGPLMSLRLGAVTTVVISSPDVAREFLQKQDAVFANRFVPHAIGDHVKNSVPWLPHSGRWRALRKIMATELFAPHRLEALQHLRRQKVEELVGHVRLLALQGRAVDVGSVAFTTSLNLLSRTIFSCDLTNLDDHTGSAKEFQEVVTEIMEVAASPNLSDLFPALACADLQGLRRRLAKLFARLHQVFDVEVDRRLCERDAGDRRKNDFLDLLLDTDGGTAALDRDSLLSLFTDLFAAGSDTSSSTVEWALTELLRNPVPMAKTCDELLAATGAARNIEESEIEQLPYLQAVVKETFRLHPPVPLLLPRRAGAATRAMGHTIPKGARVLVNVWAMGRDGDVWPDPEKFMPERFLGRPTDFRGGDLELIPFGAGRRICPGMPLASRMVHLVLASLLNQFRWRLPAEVERDGTDEMAESFGVTLKKASPLCAIATPV

SEQ ID NO: 29837 - protein, 481 aa, Papaver somniferum
SLVAVVITTFLYLIFRDSSPKGLPPGPKPWPIVGNLLQLGEKPHSQFAQLAETYGDLFSLKLGSETVVVASTPLAASEILKTHDRVLSGRYVFQSFRVKEHVENSIVWSECNETWKKLRKVCRTDLFTQKMIESQAEVRESKAMEMVEYLKKNVGNEVKIAEVVFGTLVNIFGNLIFSQNIFKLGDESSGSVEMKEHLWRMLELGNSTNPADYFPFLGKFDLFGQSKDVADCLQGIYSVWGAMLKESKIAKQHNNSKKNDFVEILLDSGLDDQQINALLMEIFGAGTETSASTIEWALSELTKNPQVTANMRLELLSVVGKRPVKESDIPNMPYLQAFVKETLRLHPATPLLLPRRALETCKVLNYTIPKECQIMVNAWGIGRDPKRWTDPLKFSPERFLNSSIDFKGNDFELIPFGAGRRICPGVPLATQFISLIVSSLVQNFDWGLPKGMDPSQLIMEEKFGLTLQKEPPLYIVPKTRD

SEQ ID NO: 29838 - protein, 361 aa, Medicago truncatula
MKKDPTNLFILFGILLLSITKTQSQATNDNPTNPNFNQEFNPSFAIIIVILVAALFLMGFFSIYIRRCSDSPSSNNLLLPITNGRRAVARGLDPSVIETFPILEYSEVKIHKIGKDVLECAVCLMEFEDTETLRLIPKCDHVFHPECIDEWLSSHTTCPVCRANLVPQPGDSVHGVPESQQQDVEAQNDAVQLPTESDSVLLAPEVISLNKTLNRNRTRGSQSNRPRRFPRSHSTGHSLIQPGENTDRFTLKLPNKVRKQIMSRQLQRARSLITLPRESSSRHGYRTGGEGSNRGKSLRRLDLSFKSDRWIFNRAPSFLARALSFRSPKPKVNNSDDDEGTSSAAAPIMPSSAVDSARPQI

SEQ ID NO: 29839 - protein, 479 aa, Leuconostoc mesenteroides subsp. mesenteroides ATCC 8293
MSEHKGHIQRNLKTRHVSMIALGGSIGTGLFVASGATVAQAGPLGAIVAYLAIGVMVYFLMTSLGEMATYSPTSGSFSDYAGKYVDPALGFAMGWNYWFNWAITLAVDIVAVGLVAEFWFPNTPGWIFSAIALLLIFLINIFSVGTFGEAEFWLSMIKVVTIIAFLIVGLATIFGVIHSDINVMKNLSVGNHGFVGGPQAILSVFVVAGFSFQGTELIGITAGEAEDPDKSVPKAINQVFWRILLFYILAIFVISALVYYKDPRLLSSSTQNIAVSPFTIVFKNAGIAFAASLMNAVILTSIVSSANSGSYASTRMLYAMARKGDAPKIFAKLSTRGVPVAALVLTTAIGLLAFIANTKGGSVAYTWLVNASGLTGFIAWVGIAISHYRFRRAYVAQGKSLSDLKYKAKWFPFGPLFALVISIGVIIGQDPDSFAHLNWEKIFVTYLSVPLFVILYFWYKVSHKTKLIALKDVDLKQYK

SEQ ID NO: 29840 - protein, 288 aa, Escherichia coli O157:H7 EDL933
MDVTAKYELIGLMAYPIRHSLSPEMQNKALEKAGLPFTYMAFEVDNDSFPGAIEGLKALKMRGTGVSMPNKQLACEYVDELTPAAKLVGAINTIVNDDGYLRGYNTDGTGHIRAIKESGFDIKGKTMVLLGAGGASTAIGAQGAIEGLKEIKLFNRRDKFFDKALAFAQRVNENTDCVVTVTDLADQQAFAEALASADILTNGTKVGMKPLENKSLVNDISLLHPGLLVTECVYNPHMTKLLQQAQQAGCKTIDGYGMLLWQGAEQFTLWTGKDFPLEYVKQVMGFGA

SEQ ID NO: 29841 - protein, 1056 aa, Pyrococcus furiosus DSM 3638
MKIDVSKVIVIGSGAIKIGEAAEFDYSGSQALKALREEGIESVLVNPNVATIQTSYELADKVYLLPLKTEFIEKVIEKEKPDGILVGFGGQTALSLGVSLYKKGILDKYNVKVLGTPIEGIERALDREKFQKTMKKVGLPVPPSDAAKTPEEAIEIAESIGFPVIVRVSFNLGGRGSFIARSREEFEKYIIRAFAQSEIRKVLVEKYLNGWKEIEFEVVRDKAGNSVAVVCLENVDPMGVHTGESIVVGPSQTLTNREYQMLRDAAIRVADAIELIGEGNVQLALSPNSEEYYVIETNPRMSRSSALASKVTGYPLAYIATKLAIGYTLDELRNTVTGITTAAFEPSLDYVAVKIPRWDFKKFEEVNKSIGSEMKSIGEVMAIGRNLHEAFQKAIRMLDIGDELIGKYYLEDEPLENVLERLKKKEPYLLMHIAKALRLGATVEDIHKITKVDKFFIYVIEDLVKIAEELRKNPTEELIREAKRLGFSDWEIELLTKRKVKKKWKPVVKNIDTLAGEFPAKTNYLYVTYDGVENDIPKPKKPSILVLGAGVFRIGVSVEFDWAVVNFVNAIRKRGIEAAILNYNPETVSTDWDMSDRLYFEEITLERVLDIYEFERPIGVVAFAGGQLANSLAKKLENAGVKLLGTSGKSVDKAENRAKFSKLLEKLGIPQPEWISAESIDEAIKLAKKIEYPVIVRPSYVLSGTAMKVAWNEKELIDFLKEAASVSPEHPVLISKFIPGTEAEIDAVSDGKKVVGVTLEHIEGAGVHSGDSTMVTPWRTLSERNVKRIWEITYELAKELEIKGPFNVQFVIDKKPYVLELNLRTSRSMPFSSKSRGVNLMELSAQAVLDGELKIGVEGKYYEIPPVAYGVKSPQFSWAQLQGAYPFLGPEMRSTGEVAALGTHYEDALLKSWLSVKPNELPKTSALIYGWEKKNILKETAKILENLGITTYSIGGDIGEINISKQEAVNMIKEGKIDIIMTTGYAKDKDYEIRRLAADLNVPLVLDANLALELAKAIEWKTKTQEEFEIKELREYWIRKIEENVEEYAASVVLRR

SEQ ID NO: 29842 - protein, 344 aa, Oryza sativa (indica cultivar-group)
MSSAASASAAGGAGEEGAAAAAQPQQEGPVVTCKGMNGLDKVVLREVRGSSAEVYLYGGHVTSWKDEHGEELLFVSNKAIFKPPKAIRGGIPICFPQFSNFGNLDPHGFARNRTWSVENDPPPFPVPTSNKAYVDLILTHTEEDLKIWPHSYEFRLRVALGPGGDLMLTSRIRNTNADGKPFSFTFAYHTYFSISDISEVRVEGLETLDYLDNLQERNRYTEQGDAIVFESELDRIYLGTPSKIAIIDHEKKRTFVVRKGGLPDAVVWNPWDKKAKAMSDFGDDEYKRMVCVEAAAIEKPITLKPGEEWTGKLELSAVPSSYYSGQLDPDRVLQDSSVPEDSIS

SEQ ID NO: 29843 - protein, 356 aa, Nostoc sp. PCC 7120
MQKWKTSCTLVISLILWNNFPMADAVNQQIVLKSRPFGEPQESDFALVESPIPQPGEGEVLSRTIYLSLDPYMRGRLSANASYAASTELNSVIVGGTVSQVIKSHHLEFQAGDFVLSNHGWQTYAVAKGETLRKLDPNQAPLSYNLGVLGMPGLTAYAALLDIGQPKAGETVVISAASGAVGAVAGQIAKIKGARVVGIVGSDEKRDYIVNELGFDVGINRRTQEVSSALKEAAPDGIDVYFDNTAGEILEAVLQQINLGARIPLVGLISQYNASSPPPGPNLLPLLIKRALIKGFLVSDYQYRFPDFVRDVAGWLQSGQLKYKEDVVVGLENAPRAFIGLLRGDNFGKLIVKVSQ

SEQ ID NO: 29844 - protein, 110 aa, Sandersonia aurantiaca
MATLGAPRDVPAGGENSADVEELARFAVAEHNKKENALLEFGRVVKAKEQVVAGTLHHLTVEAIDAGNKKLYEAKVWVKPWLNFKELQEFRHAGDSPSVTPADLGAKRGD

SEQ ID NO: 29845 - protein, 648 aa, Magnetospirillum magnetotacticum MS-1
RLMALSLHGEAEALVEHSSRHAQFLSKLAGADDFVDAMSEPPLVATDMFANCTGAAIVYLNERREIATRLIGQTPPPDDVLRLMEWLRAYSAGSVVSTDCISSIFPAFASHAKEASGVLATFIGDNRDQALLWFRPEVIREINWGGRPEKTMDSTGTTYLPRRSFERWVEQKHGHSARWLSWEIQVAGALATAMTKVILRQNRRIKTLNGEVERFLWVTSHHLRESPRRILIGCQQIRRHLRDHLDGGGEVILEQMRDTAEGMDLRLKGLLAYSEFGHSQIAPRPLQLADALAPVLAQMDEEIRSVGAVVRVLGDLPEVLGDQRGIQFVFQSLIDNALQFRSPDRGAEVNIWAERCEDVWTISVGDNGIGIEPEYHERVFNLFETLRPAEQSRGIGLGLSLCHRIIEQLGGRISLTSIADRGTTVQFALPAAAKAEHQAAPERNLRGVDTLALLRHATRDLHAEIERHPLMLPLSEGRVTPQQYRNALAVIYGFYRPSEELLYAKFPHLAETMGIRPKLPALVHDLVALGFSDMEVAALPLSPAIPTVESWGEGLGMVYVLEGATLGGQVVMRRISHCLGVLSGLATSFHNFHGDGAGPHWRQFQTRMAEQLDANPAAQQKAAECAVTTFESLGNWFTTAERTWATSN

SEQ ID NO: 29846 - protein, 111 aa, Trichodesmium erythraeum IMS101
MKKIITVCLLIFILINIIKIPTVLATEITQGAEVFQIHCAGCHAKGGNIVKWWKNLKIRTLKRNKLDSVEAIAYLVKNGKNNMSAYKDRLTEIEIQTVSAYVLKQAENRWN

SEQ ID NO: 29847 - protein, 697 aa, Debaryomyces hansenii CBS767
MSGQANVLSNSVTPLIDRILANPLTFILGKQIELDNFEKPASYIVLSKSSKKGDSSESSKALTQEKEPKSPEMRKPRSMAEAVAVYTGKKFLTKAEKKAAKKRKVTQPLVDSEEEDVGEVIGGDIKMAESDSDSISDSQYESASEFQSDSNVELPFAEFKSESDVKSSSELRSDSELKTESELKSDSESTSESPAGGEEDDEGNDDDDDDDNKDYSLEDNESFSESDSGSASDVEDSSNDEEDLEALKHDLKQELQHDPRDISSKDPSLSGSDDDDEEKEEENLDKNTTPPTSPEDEPEKPPATVNASDDLHVLPLNKFYLINEVSSDRGSNNSTRIYKNWRELSKRKPVGLLNHGVTCYMNSAIQSLIHIPAVQHYLTDINSGKHNKTLKPRSVSHVLAELSKRMWALDDNTSKAKQPKYVNPKRIIQRLDDINCMMSEWQQEDSHEYFMSLMSRLQEDSTPKGVKLNQSIIYDIFGGLLHQSVTCKNCNYVSDTKQEFYDLSLGLNRKKNKDVTENSGPQRYTIEKSIQEFFSSELIKLDRKDKSSGYDCENCKQKSNACKISTIDRSPETLTVHLKRFKFNGNSSSKVKQSISYPNYLDLTKFTTLKTPTKYQLVSVIVHEGRSILSGHYIAHCLQPDGTWSTYDDEYINKINEKEALSDPSAYVLVYTKLTPRLMKRSNEGNDNLVNAKKLKR

SEQ ID NO: 29848 - protein, 92 aa, Oryza sativa
MTVVESVKNAVGLGETSATRKEMSEARLPMQYRDSCAHLLIPLNRCRQAEYYLPWKCEDERHSYEKCQYEEFKKRVAKMDELRASKDGARSN

SEQ ID NO: 29849 - protein, 336 aa, Arabidopsis thaliana
MSNYAAGLGKPGSGKRRIRDLLNQPDNRVCADCGASDPKWASANIGVFICLKCCGVHRSLGTHISKVLSVTLDEWSDEEVDSMIEIGGNASANSIYEAFLPDTCSKPGPDVNHDQRMRFIRAKYELQEFLKPSLRITSGKGSTKSSAFLTSSLSRKIMDSFRTNSSSQTMFQEGMVEFIGLLKVTIKKGTNLAIRDMMSSDPYVVLNLGKQKLQTTVMNSNLNPVWNQELMLSVPESYGPVKLQVYDYDTFSADDIMGEADIDIQPLITSAMAFGDPEMFGDMQIGKWLKSHDNPLIDDSIINIVDGKVKQEVQIKLQNVESGELELEMEWLPLDQ

SEQ ID NO: 29850 - protein, 150 aa, Glycine max
MPRGTLEVVLISAKGIDDNDFLSSIDPYVILTYRAQEKKSTVQEDAGSKPQWNESFLFTVSDSASELNLKIMDKDNFSQDDCLGVATIHLDPVFEAGSIPETAYQGVVKDEEYCGEIKVALTFTVEKNEEQDYAEPEESYGGWKESSGEF

SEQ ID NO: 29851 - protein, 132 aa, Solibacter usitatus Ellin6076
MKNIFVGNLDFNASEEGVRSLFERYGQVNSARIMTDRETGRSRGFAFVEMENEGEADQAISALNGYTLDGRALNVNEARPKPDRGFGGGGGGGRGFGGGGGGGRPGGGGGGGGRRPGGGGGGGGGNRREPRW

SEQ ID NO: 29852 - protein, 359 aa, Coprinopsis cinerea okayama7#130
MLTSSQWEWASTASRMKGDIDIVFSSAKDQLTGASVAIKKIMKPFSTPVLAKRTYRELKLLKHIQHENIISLSDVFISPLEDLYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAVDIWSTGCIFAEMLEGKPLFPGKDHVNQFSIITELLGTPPDDVIETICSENTLRFVQSLPKRQRVPFSQKLRTTDPDALDLLERMLVFDPRKRINASESLAHAYVAPYHDPTDEPEAEEKFDWSFNDADLPIDTWKVMMYSEILDFHQVDQGQGLGIPEGALAGPEDGGYSNGHA

SEQ ID NO: 29853 - protein, 207 aa, Brassica napus
  misc_feature (151)..(151): Xaa can be any naturally occurring amino acid
  unsure (1)..(207): unsure at all Xaa locations
MSSRSIYRTLRPVLSSSVLSSGLGTGHGIKGHVISHLPTIRFLSSDTSSSATGNRLPGNPLRTADGKVISTYWGIPPTKITKPDGSAWKWNCFQPWDSYKPDVSIDVTKHHKPANFADKFAYWTVQSLKIPVQLFFQRKHMCHAMLLETVXAAVPGMVGGMLLHLKSLRRFEHSGGWIKALLGEAENERMHLMTFIELSQPKWYERA

SEQ ID NO: 29854 - protein, 450 aa, Lactobacillus brevis
MKVTVVGCTHAGTFAIKQILAEHPDAEVTVYERNDVISFLSCGIALYLGGKVADPQGLFYSSPEELQKLGANVQMNHNVLAIDPDQKTVTVEDLTSHAQTTESYDKLVMTSGSWPIVPKIPGIDSDRVKLCKNWAHAQALIEDAKEAKRITVIGAGYIGAELAEAYSTTGHDVTLIDAMDRVMPKYFDADFTDVIEQDYRDHGVQLALSETVESFTDSATGLTIKTDKNSYETDLAILCIGFRPNTDLLKGKVDMAPNGAIITDDYMRSSNPDIFAAGDSAAVHYNPTHQNAYIPLATNAVRQGILVGKNLVKPTVKYMGTQSSSGLALYDRTIVSTGLTLAAAKQQGVNAEQVIVEDNYRPEFMPSTEPVLMSLVFDPDTHRILGGALMSKYDVSQSANTLSVCIQNENTIDDLAMVDMLFQPNFDRPFNYLNILAQAAQAKVAQSVNA

SEQ ID NO: 29855 - protein, 395 aa, Oryza sativa (japonica cultivar-group)
MQKRQCKSSGVMCVPCDVKHQLLYSFKSVKILCQTARIVQVGAKVAFRQLLNRTRRRTHRAQFTAEISTPYPMGISHPLSDDFDASPVLSPPPPPSSCCPPAHDDHYLEHQISDIKRANSLMTDSQMFAHKMLLIPLPGRPMPSSVRLNGSGQKMKRAWAPNNQQNRDVTDSLDSSNYNSSKQQMSLAMSTLQSYYGLTPQNGAMTDAGTEMSLYSKGSLERINSETLVTSSRLPDTHNTDRSRNSEDTSNGFSATNGASGAKINGTAKAKQDGSIRRRQKVEADQVSNTTDTQDDVFTDPIKMTKSLLPRPISSIRQNMDTSNPESSLKSNGSFLSGFRSVRKSPSTPNFADAENGISMWSSSAWTFNHESFTRPLLDGLPKPTAPRRTKAALD

SEQ ID NO: 29856 - protein, 416 aa, Photobacterium profundum SS9
MDYFNYQPNGQLWAEDIALTELAERYGTPLYVYSRATLERHWNAFDQAVIDHPHLICYAVKANSNIGVLNVLARLGSGFDIVSQGELERVITAGGDPAKVVFSGVGKTAVEMKRALELGIKCFNVESEPELERLNQVASELGLVAPISLRINPDVDAQTHPYISTGLRDNKFGIFFERAVEVYRLAHSLPNLNVVGMDCHIGSQLTNIDPFIDATDRLLALIDTLKAEGIVIKHLDVGGGLGVTYNEEQPPLPSEYASALLARLGEHSDLELIFEPGRAIAANAGVLLTRVEFLKHTDYKNFAIVDAAMNDLIRPTLYQAWQNIVPVVPREGEAKTYDLVGPICETGDFIGKDRELCLAPGDLLAVRSAGAYGFVMSSNYNTRTRAAEIMVDGNTAHVVREREKLAELWQSEHLLP

SEQ ID NO: 29857 - protein, 584 aa, Listeria monocytogenes str. 1/2a F6854
MMTELHEVAGGRVEPTAIQYDLRRLFNRTKVNLVTDNVTHVDHDKKVVTTEHGSYPFDYLVLGMGGEPNDFGTPGVGENGFTLWSWEDSVKLRNHIEETVTKASREQDVEKRKAMLTFVVCGSGFTGIEMVGELLEWKDRLAKDNKIDASEIKLVVVEAAPTILNMLERRDADKAERYMVKKGIEIMKNAAIVEVKPESIVLKSGEELPTSTLIWTAGVRANSDTKDYGMESARAGRLKVNQYMEAEGLKDVYVVGDLAYFEDEEGKPTPQIVEGAEQTALTAAKSIIVEMSGTGEKEPFQGKYHGVMVSIGAKYGVAHLGGMHLSGWFAILMKHMVNLYYFFGIRSGYYMWQYIMHEFFHIKDHRNIFRGWTSRYGNVLWVLPLRVYLGWFWIDEALSKIYGETTWDKVSITNLKPLFNGIGSDSWLTATTSKMPFEWLQTAATSGASQAAGDAAGAAATNVTTPILSHMPGWFQWIMELLMPNLDVALVMQKVVPFVELAIGLAMVVGLFTWLVSIGSAGFLVMFTLSAMLGWDKFWALPASIALLNGAGRTFGLDYWAVPWFQKHLGHWWYGKPRSVYRDK

SEQ ID NO: 29858 - protein, 215 aa, Debaryomyces hansenii CBS767
MRSIKSVVIGDGGVGKTCLLISYTTNTFPNDYIPTVFDNYSATAMFNGEPIKLGLWDTAGQAEYDRLRPLSYPQTEIFLCCFSIVSPESLENVKAKWIPEILHHSPKDILVLLVGTKADLRDDLLVLDKLDDGNQKPTTAAQGERLAKELGLVGYKECSAATQMGVKEVFDFAIKSVVSPPEGNQGRNGGTNNAATNMRNSQARKVKKAKKCTIL

SEQ ID NO: 29859 - protein, 513 aa, Ashbya gossypii ATCC 10895
MLATAQVRTLRALVRCYSSLPLTVQVRLPNGNSYEQPTGLFIDGKFVPSHQAKTFEVIDPGTEEEITHVYEAREEDVDAAVAAAKRAFLPWSRADPEVRAQCLFKLADLIEKHQETLANIESLDNGKSLLCSRGDVALVARYLRTCGGWADKIYGNVMETGPDHFSYTRREPLGVCGQIIPWNFPLLMWSWKIGPALATGNTVVLKPAESTPLSALYVCNLANEAGIPKGVMNIVPGFGKIVGEHLCTHPDVKKVAFTGSTATGRHIMRTCAETVKKVTLELGGKSPNIVFADADIDKAVKNIGFGIFYNAGEVCCAGSRVYVQDSVYDEVLEKFKQFSENLKVGNPFEEGVFQGAQTSQMQVDKILSYVDIGVKEGARIVAGGERLGRKGFFIKPTIFADVNENMRVVKDEIFGPVVTVSKFSTVDEVIAMANNSQYGLAAGIHTTDINKAIDVSNQIKAGTVWVNTYNDFHPNVPFGGFGQSGIGSEMGVQALDNYTQTKAVRMAIDHVKV

SEQ ID NO: 29860 - protein, 326 aa, Listeria monocytogenes str. 1/2a F6854
MQLHAMWDEYPALSKDLQEVLQTIEKNIQIRDKHVEQNVKDLIHAGGKLLRPAFALLSAQAGPDYDKDRAVSIAAALEVLHMATLIHDDVVDDSPLRRGIPTIHSKYGRNYAVYTGDYLFCICFKILSAHASSVENIEFNSKNIEKILMGELDQMRTSYKMNVTVREYLTRISGKTAQLFALSCYSGATGSKATRMTVAKCYNIGHYLGMAFQIIDDVLDYTSTDEGLGKPVLNDMKQGIYSLPLIYAMKGHLAEFEPLLSQKLDMTDDASEQVLALISKYKGVEQAFKLAKKYTNKALREIKKLPAGAYREDMYRLTKNILDRDI

SEQ ID NO: 29861 - protein, 171 aa, Bacillus clausii KSM-K16
MDYKQYITIVEDWPQEGIRFKDITTLMQNGTAYKRAVEELAVYAKEKQADVIVGPEARGFVVGCPIATELEIGFVPVRKKGKLPREVIEANYGLEYGKDCLTIHKDSIQPGQRVVITDDLLATGGTIEATAKMVEQLGGKVVGIAFLIELAYIGGRDKLKQYDLFSLMSYE

SEQ ID NO: 29862 - protein, 540 aa, Anabaena variabilis ATCC 29413
MNTAVTLLTEQAPQPIEEFGQLERQIIIILDFGSQYSELIARRIRETQVYSEVLSYRTSAEHLRQLNPKGIILSGGPSSVYSDRAPHCDPEIWNLGVPILGVCYGMQLMVNQLGGEVAKADRGEYGKASLHIDDPTDLLTNVEDGTTMWMSHGDSVTKMPPGFEVLAHTDNTPCAAVADHDKKLYGVQFHPEVVHSIGGLALIRNFVYHICECEPTWTTAAFVEEAIREVRAKVGDKRVLLALSGGVDSSTLAFLMHKAIGDQLTCVFIDQGFMRKYEPERLVKLFQEQFHIPVEYVNARDRFLDIMVGVTDPEEKRRRIGHEFIQVFEETSRNLGPFDYLAQGTLYPDVIESADTNVDPQTGERVAVKIKSHHNVGGLPKDLRFKLVEPLRKLFKDEVRKVGRSVGLPEEIVQRQPFPGPGLAIRILGEVTADRLNILRDADLIVRQEINQRGLYNEYWQAFAVLLPIRSVGVMGDQRTYAYPIVLRIVKSEDGMTADWARVPYDVLEAISNRIVNEVKGVNRVVFDITSKPPGTIEWE

SEQ ID NO: 29863 - protein, 511 aa, Liquidambar styraciflua
MDSSLHEALQPLPMTLFFIIPLLLLLGLVSRLRQRLPYPPGPKGLPVIGNMLMMDQLTHRGLAKLAKQYGGLFHLKMGFLHMVAVSTPDMARQVLQVQDNIFSNRPATIAISYLTYDRADMAFAHYGPFWRQMRKLCVMKLFSRKRAESWESVRDEVDSAVRVVASNIGSTVNIGELVFALTKNITYRAAFGTISHEDQDEFVAILQEFSQLFGAFNIADFIPWLKWVPQGINVRLNKARGALDGFIDKIIDDHIQKGSKNSEEVDTDMVDDLLAFYGEEAKVSESDDLQNSIKLTKDNIKAIMDVMFGGTETVASAIEWAMTELMKSPEDLKKVQQELAVVVGLDRRVEEKDFEKLTYLKCVLKEVLRLHPPIPLLLHETAEDAEVGGYYIPAKSRVMINACAIGRDKNSWADPDTFRPSRFLKDGVPDFKGNNFEFIPFGSGRRSCPGMQLGLYALETTVAHLLHCFTWELPDGMKPSELEMNDVFGLTAPRAIRLTAVPSPRLLCPLY

SEQ ID NO: 29864 - protein, 227 aa, Thermus thermophilus
  misc_feature (24)..(24): Xaa can be any naturally occurring amino acid
  misc_feature (101)..(101): Xaa can be any naturally occurring amino acid
  misc_feature (163)..(163): Xaa can be any naturally occurring amino acid
  misc_feature (210)..(210): Xaa can be any naturally occurring amino acid
  unsure (1)..(227): unsure at all Xaa locations
MERPLESYKKEAAHAAIAYVQDGXVVGLGTGSTARYAVLELARRLREGELKGVVGVPTSRATEELAKREGIPLVDLPPEGVDLAIDGADEIAPGLALIKGXGGALLREKIVERVAKEFIVIADHTKKVPVLGRGPVPVEIVPFGYRATLKAIADLGGEPELRXDGDEFYFTDGGHLIADCRFGPIGDPLGLHRALLEIPGVVETGLFVGXATRALVAGPFGVEELLP

SEQ ID NO: 29865 - protein, 795 aa, Escherichia coli O157:H7 EDL933
MKFSELWLREWVNPAIDSDALANQITMAGLEVDGVEPVAGSFHGVVVGEVVECAQHPNADKLRVTKVNVGGDRLLDIVCGAPNCRQGLRVAVATIGAVLPGDFKIKAAKLRGEPSEGMLCSFSELGISDDHNGIIELPADAPIGTDIREYLKLDDNTIEISVTPNRADCLGIIGVARDVAVLNQLPLVEPEIVPVGATIDDTLPITVEAPEACPRYLGRVVKGINVKAPTPLWMKEKLRRCGIRSIDAVVDVTNYVLLELGQPMHAFDKDRIEGGIVVRMAKEGETLVLLDGTEAKLNADTLVIADHNKALAMGGIFGGEHSGVNDETQNVLLECAFFSPLSITGRARRHGLHTDASHRYERGVDPALQYKAMERATRLLIDICGGEAGPVIDITNEATLPKRATITLRRSKLDRLIGHHIADEQVTDILRRLGCEVTEGKDEWQAVAPSWRFDMEIEEDLVEEVARVYGYNNIPDEPVQASLIMGTHREADLSLKRVKTLLNDKGYQEVITYSFVDPKVQQMIHPGVEALLLPSPISVEMSAMRLSLWTGLLATVVYNQNRQQNRVRIFESGLRFVPDTQAPLGIRQDLMLAGVICGNRYEEHWNLAKETVDFYDLKGDLESVLDLTGKLNEVEFRAEANPALHPGQSAAIYLKGERIGFVGVVHPELERKLDLNGRTLVFELEWNKLADRVVPQAREISRFPANRRDIAVVVAENVPAADILSECKKVGVNQVVGVNLFDVYRGKGVAEGYKSLAISLILQDTSRTLEEEEIAATVAKCVEALKERFQASLRD

SEQ ID NO: 29866 - protein, 206 aa, Propionibacterium acnes KPA171202
MTHRRAHIYRETSESTVDVAIDLDGAGESTISTGVGFYDHMLTTLSKHSGIDMTITTTGDVEIDGHHSIEDTAIALGQALAQALGDKCGITRFGDAVVPLDEALAQCVVDVAGRPWVACSGEPEGQAYVRIGGSGVSYQGSMTYHVMHSLAFNAGLCVHLRLLAGRDPHHICEAEFKALARALRIAIAPDPRNAGRVPSTKGALNV

SEQ ID NO: 29867 - protein, 478 aa, Zea mays
MADHQPQVEVLTESVRVNGTKAEATLVGGELVWRPAAGGNGEGQERRLELESEVLGFQMDGKQLKFATFAASGGGNGKGGGGDGNRRRGEVVVEMENEATAVRWGVVISDRLASLGRPKKLFIIVNPYGGKRSGPSIFQNEVLPLIEASGVLYTMQETKHRLHAQEIAHSLDLRKYDGIICVSGDGVMVEVVNGLLQREDWEAAIKVPLGIIPAGTGNGMARSLLHAAEGKARFFSVLMLTWGLVADVDIESEKYRWMGSARLDFYLLLRILNLRRYNGRILFVPAPGYEEVGDPVDQATGYETNGFSTGFQDDGRTGSNGETCGYVGPSIKEAEAGLRWRSLNGPFVSVWLGNVPFASEDAMAAPKAEFADGYLDAAIIKDCPRWDVLGLVFQMKDGSYVNSPCVEYFKVKAIRIEPGLRVGSSTEGGIIDSDGEVIARGDESDSRAGDDEPGHLMAYGPPIQLTVDQGLATIFSPR

SEQ ID NO: 29868 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGKVVDYQTGPIIWGEPGTNGQHAFYQLIHQGTKMVPCDFIAPAITHNPLFDHHQKLLFKFFAQTEALAFGKSREVVEQEYRDQGKDPAT

SEQ ID NO: 29869 - protein, 232 aa, Zea mays
MITQSDFGKPRAVAVTALFSIQTLTGTCQREYESRAAVNTVVLHPNQKELISGDQNGNIRVWDLAANSCSCELVPEVDTAVRSLTVMWDGSMVVAANNRGTCYVWRLLKGTQTITCFEPLHKLQAHDGYILKCLLSPEFCDPNRYLATASSDRTVKIWNVDGFKLERTLVGHQRWVWDCVFSVDGAYLITASSDTTARLWTMSTGEAIRVYQGHHKATVCCALHDGAESAPS

SEQ ID NO: 29870 - protein, 464 aa, Oryza sativa (japonica cultivar-group)
MSSSVGGGGGQQFRYTQTPSKVLHLRNLPWECAEEELVELCNPFGRIVNTKCGVGANRNQAFVEFTDINQAISMVSYFASSSEPAQIRGKTVYIQYSNRQEIVNNKSPGETAGNVLLVTIEGVQANDVTIDVIHLVFSAFGFVHKIATFEKAAGFQALIQYTDAATASAAREALDGRSIPRYLLPEHVTSCCLRISFSAHKDLNIKFQSHRSRDYTNPYLPVNSSAIDTLQPAVGADGRKVEAEGNVLLASIENMQYAVTVDVLHTVFSAFGTVQKIAIFEKNGGTQALIQYPDVTTASVAKEALEGHCIYDGGYCKLHLSYSRHTDLNVKAHSDKSRDYTIPQGAMQAVPQPPGVPTTSAGWQGNPQAGGAYAPPGAAAPNHGTTGQVPNWNPGNSGYAPAPGAYPGQMYSSPMQYGASGGFSAPAAPPQELHTSQQMPPPQYGNQPGPAGAPGTGQPHPYYR

SEQ ID NO: 29871 - protein, 645 aa, Glycine max
VDPRVRKASPLSLEQFISITAPLLDLEKEAEISSSIATGASRNLDTAQKRGSTILNLKCVDVQTGLMGKSLIEFQSTKGDVLPAHKFGTHDVVVLKLNKADLGSPALGQGVVYRLKDSSITIAFDDIPEDGLNSPLRLEKVANEVTYRRMKDALIQLSKGVHKGPASDLIPVLFGERPPTVSKKDVSSTPFNKNLDHSQKEAVSKALSSKNVFLLHGPPGTGKTTTVVEIILQEVKRGSKILACAASNIAVDNIVERLVPHRVKLVRVGHPARLLPQVLDSALDAQVLRGDNSGLANDIRKEMKALNGKLLKTKDRNTRKDIQRELRTLSKEERKRQQLAVTDVLKSADVILTTLIGAFSKKLDSTSFDLVIIDEAAQALEIACWIPILKGSRCILAGDHLQLPPTIQSVEAEKKGLGRTLFERLAEMYGDEITSMLTIQYRMHELIMDWSSKELYNSKIKAHPSVTAHMLYDLEGVKRTNSTEPTLLLIDTAGCDMEEKKDEEDSTFNEGEAEVTVTHAKRLVQSGVLPSDIGIITPYAAQVVLLKMLKNKEDQLKDVEISTVDGFQGREKEAIIISMVRSNSKKEVGFLSDRRRMNVAVTRSRRQCCLVCDTETVSGDGFLKRLIEYFEEHGEYLSASEYQNE

SEQ ID NO: 29872 - protein, 539 aa, Haloarcula marismortui ATCC 43049
MHKPLLTTDFLDRAREYYGDKEAIVATTGERFTYDEFGERADGFSAAMAARGIEKGDRVAVLDPNTHYQLEAAYGTMQLGAVHTPLNYRLVPDDFEYILSDAEVDAVYADYEYADKIEPIRDEVPTDIFVTNDTDAVDGDWESFDEIIEEAGTDYERPEMDEDDLITINYTSGTTGDPKGVCRTHRTETLHAYIVALHQEISDDDVYLWTLPMFHVNGWGHIFSVTGMGAKHVCTRGVDAEGIFDAVRTEDVSYLCGAPTVLNILADRYAAHDGEIETTGANDVRIATAGSAPPEAVIRTVEDDFGWYLKHVYGATETGPLVTTSDARRFFEDGSNARFSVKKRQGIGYLGTDVRVVDEDGNDVPHDDETLGEVVVRGNQVMDRYWNKPEQTEEAFSDRVEGYYHMGDLATVDEDGMVAIRDRKKDIIISGGENISSIELEDTLYEHDAVSDVAVIPAPSDEWGETPKAFVVPNSGDPDNPGVTAEDLRTFTREQLATYKVVRRVEFVEELPTTATGKVQKYELREQEWEDEDEMVGQG

SEQ ID NO: 29873 - protein, 392 aa, Candida albicans SC5314
MGFSLSNFTSDPFAISTVSFGIMAWVVAIAGAASSKQENFPHFSWWGISYQIVIILIIFVLYANNNIELYKFTLVGLVSIAFIYTTNSTNNLIYNSNSAGNLCCAAGCILLSILNLIWILYFGGHPESPTNQFIDSFSLRGQGHEQLGSGSHNHNANNANNNIPIGAGNAIIGKGEMSPYDDRFAASGVNQPTSESLRLASGPQMGNGPFTTTGAIINPNLQQPLSGSIGGSAHHTPTNINNNNNNNTGYMTSSHLTGLENFSSPHVPGSGAGAGLGVGAGRDLTHNSNSLNNSNGGGGGSGGGPASANNSNNTNKRNTIYTDSETGTGITFRYKAKALYSYDANPDDINEISFVKDEILEVDDIDGKWWQARRANGQVGICPSNYVKLLDT

SEQ ID NO: 29874 - protein, 74 aa, Triticum aestivum
  misc_feature (5)..(5): Xaa can be any naturally occurring amino acid
  unsure (1)..(74): unsure at all Xaa locations
VSSCXVPALKPSDIGGGSGNKDEAKQAGGYLQRVFSLFPQKAYDVDTGIRFVQYAGLAWSVVDLVPVIFTHLNL

SEQ ID NO: 29875 - protein, 1036 aa, Oryza sativa (indica cultivar-group)
MERVLKSARESGSLNLSNRSLREVPKEVYNNLDTGAQDEKWWEGVDLQKLILAHNNLEVLREDLRNLSSLVVLNISHNNISSLPAAIGDLPLLKSLDVSSNQINALPEEIGFATALVKVDCSNNCLTDLPVSLARCLELSELNASNNTISVLPDELAGCSKLFRLNLEGNKLVTLSDKMFMSWTMLTEMNAEITLIPPSIKDCSSLAEFYMGNNLLTSIPEDIGMLSNLGILDLHSNQLKEYPVGACRLKLSFLDLSNNSLSGLPAELDHRADSFFPWGICFENLACSMQVCYYLNELSKLWTLTYASACYIQGTMTTLRKLLLTGNPMRTLRSSLVSGPTTALLKYLRSRLSSDEGASGSGSTPTKDDQIAAARRLSLSSKELDLSGLGVTSVPPAAWETNDVMKLDLSKNSIEDLPNELSLCSSLQSLILSNNKIKRWPGTVFSSLASLSLLKLDNNPLAEILATDLEALSKLEVLDLSGSASSLPEPSAVSKLPHLKELYLRRMKLHGFPDSLLGLKLLRILDLSQNYLTSVPEGIKDLTSLIELDLSDNNITTLPPELGLLEPNLQVLKLDGNPLRRVIDVKCWYLNANGLTPSLVPGKDRLSDLPDDVVLNILERLDTSDAMKTCILSKNMRATLPDMLSRIAVDVAAFSRPNHRRFTLREVVRTNGAVADLTAAVLEFRRPEIPVHHLALRFYLRYYDCISIAGTVARAMAARKLAAGAAVEFSILTEKRCGRPRLLRRPVPHLVHRLPGRLRRPHPPPAGEPLVEHNHLVEHEISHGNFETIELVHVPKLQTMKCQGWISYRDPLFFGYTPLLQSLSLVYTGMSWKNSIRLSHFLSNAPSLHQLNLNFQSEKIWVEPEGWKRLAPVLGELRHVTLVDLPEGCDIAWTMFIVEAAPRLESLSIRVWDHCCKMERDETTRQENGYCDKSNVEWQPSVANLEHRNLAKLTIVGFQPDEHFVGFIRRVMESAVNLEEISLYDRVVGRCCSYLDPKTKSKVVPSRYPRTMKEQVLLRKEMTKGMDLSHVIHFRS

SEQ ID NO: 29876 - protein, 387 aa, Oryza sativa (indica cultivar-group)
MAPSRPLMRGIRPPRVFPTRGGRTSPLALALAALLLASALLLTLIAFGVFSLPVSAPNAATTDSAAAGGDAEPADPRPPRTRARRDLSEGLGERGAQWTEVISWEPRAFVYHNFLSKEECDYLIGLAKPHMVKSTVVDSTTGKSKDSRVRTSSGMFLQRGRDKVIRAIEKRIADYTFIPMEHGEGLQVLHYEVGQKYEPHFDYFLDEYNTKNGGQRMATLLMYLSDVEEGGETIFPDANVNSSSLPWYNELSECARKGLAVKPKMGDALLFWSMKPDATLDPLSLHDTLLVFYMLQAVPLQISLWSEQGVVLSSKETNGHQPSGCMSSNPEEKESLVVWNRQNTLGGIMLDEVIDTQVVVEVTLSDQVQACWSKKKMMPHSVVDGTI

SEQ ID NO: 29877 - protein, 419 aa, Picrophilus torridus DSM 9790
MIENFQYKGNSLFLDDVELKSLAHQFGTPLIVLSEKRINNNYLKIKSAFSKHFRHFKVHYALKANSNPAVISILRRLGAGADAANPNEAEIAMYSGISPDNIIMTGNNLSYNDLKRALEMNIKINFDDVNQMNILKNELPDIISFRINPGYGNGEFTGIKTAGPSSKFGIPVNEALNGYRTALNAGVKKFGIHMMAGSNNLDPGYFYELSGIFAGIIKTINNELGISFDFIDIGGGFGVPYKNEAALDINETARLIAMALDGIMDSNPDAEIIIEPGRYLVADAGIALATVTDLKNYGRSIAGTDLGMNILIRPALYGAVHEIICINKNDDKLFNYDITGQICENTDFTGLNVKLPGLEPGDILGIMNAGAYVSSMSSNYNSLSRAAEVLISDDNVHLIKKRDDIRDIINNTFIPGHLL

SEQ ID NO: 29878 - protein, 586 aa, Nicotiana tabacum
MPMVDDPLYPIPVLIDDLKTDEKQLRLNSIRRLSTIARALGEEKTRKELIPFLSENNDDDEVLLAMAEELGVFIPYVGGVEHAHVLLPPLETLCTVEETCVRDKPVESLCRIGSQMRESGLVDWFVPLVKRLAAGEWFTARVSACGLFHIAYSSAPEMLKAELRSIYSQLCQDDMPMVRRSATTNLGKFAATVESTYFKSDITSIFDDLTQDDQDSVRLLAVEGCAALGKLLEPQDCVAHILPVIVNFSQDKSWRVRYMVANQLYELCEAVGPEPTRTDLVPAYVRLLRDNEAEVRIAAAGKVTKFCRILSPELAIQHILPCVKELSSDSSQYVRSALASVIMGMAPVLGKDATIEHLLPIFLSLLKDEFPDVRLNIISKLDQVNQVIGIDLLSQSLLPAIVELAEDRHWRVRLAIIEYIPLLASQLGIGFFDDKLGALCMQWLQDKVYSIRDAAANNLKRLAEEFGPEWAMQHIIPQVLDMTTSPHYLYRMTILRAISLLAPVMGSEITCSKLLPVVITATKDRVPNIKFNVAKVLQSLIPIVDHSVVEKTIRPSLVELAEDPDVDVRFYANQALQSIDNAMMSG

SEQ ID NO: 29879 - protein, 237 aa, Leuconostoc mesenteroides subsp. mesenteroides ATCC 8293
MAKLVLIRHGQSEWNALNLFNGWIDTKLSEKGIAQAKEAGDLLAAEGIQFDQAYTSVLTRAIQTLHLALEEAGQLFIPEAKSWRLNERHYGALQGQNKAEAAEKWGDEQVHIWRRSYDVLPPLLDSYDETMTVQGNTYPAFDRRYADVPEGELPLGENLKITLERVLPFWESDISKDLKAGKNVVIAAHGNSLRALVKHLENISDDDILNVEIANGQPLVYDLADDLSVVSKKTLTK

SEQ ID NO: 29880 - protein, 168 aa, Zea mays
MLAEALGCSFIEADDYHSEANKAKMSAGVPLSDADRAPWLESVRDAIRGRLDGGEDVAVSCSALRLGYRDVLRAADRAYEPGRYAACRVRFVCLRAPAEVLAERVLRRSVEGEHFMPASLLRSQLDLLRVDPAEGVAEADATARPDDIVRDTVALFRDELAVSSGVPA

SEQ ID NO: 29881 - protein, 261 aa, Mycobacterium avium 104
MSRKPLIAGNWKMNLNHFEAIALVQKIAFALPDKYYDKVDVTVLPPFTDLRSVQTLVDGDKLRLSYGAQDLSQHDSGAYTGDISGAFLAKLGCTFVVVGHSERRTYHNEDDALVAAKAAAALKHELTPIICIGEHLEVREAGNHVIHCEEQLRGSLAGLSAEQIGKVVIAYEPVWAIGTGRVASASDAQEVCAAIRKELASLASAQIADSVRVLYGGSVNAKNVGELIAQDDIDGGLVGGASLDGEQFATLAAIAAGGPLP

SEQ ID NO: 29882 - protein, 177 aa, Propionibacterium acnes KPA171202
MTYRKDLIASLIRDVPDFPEPGVTFKDITPLLANPNGYAAAISELVDTASRDVDVVLGMEARGFMFAGPVALSLGAGFVPVRKPGKLPGDVYSQSFVLEYGSATLTVHQDAVQPGSKVLIVDDVLATAGTVRATASLVEQLGAELVGVSVLIELSALGGREKLDRAGIGPVNAVLTI

SEQ ID NO: 29883 - protein, 729 aa, Arabidopsis thaliana
MRSVVLVALAAAIGNMLQGWDNATIAGAVIYIKKEFHLEKEPKIEGLIVAMSLIGATLITTFSGPVSDKVGRRSMLILSSVLYFLSSIVMFWSPNVYVLLFARLLDGFGIGLAVTLVPIYISETAPSEIRGLLNTFPQFCGSGGMFLSYCLVFGMSLQESPSWRLMLGVLSIPSIAYFVLAAFFLPESPRWLVSKGRMDEARQVLQRLRGREDVSGELALLVEGLGVGKDTSIEEYVIGPDNEENEGGNELPRKDQIKLYGPEDGQSWMAKPVKGQSSLALASRQGSMLPRGGSLMDPLVTLFGSIHENLPSENMNASSRSMLFPNMGSILGMMGRQESQWDPERNNEDSSDQDENLNSPLLSPQTTEPDDYHQRTVGTMHRRQSSLFMANVGETATATSIGGGWQLAWKYNDKVGADGKRVNGGLQRMYIHEETANNNTNNIPFSRRGSLLSFHPEGDGHDQVNGYVQAAALVSQASMMPGGKGETAMLPKEVKDGPGWRELKEPGVKRALMVGVGLQILQQFAGINGVMYYTPQILEETGVSSLLTNLGISAESASLLISALTTLLMLPCILVSMRSLMLSTIPILILSLVTLVIGSLVNLGGSINALISTASVTVYLSCFVMGFGAIPNILCSEIFPTSVRGLCITICALTFWICDIIVTYTLPVMLKSIGIAGVFGIYAIVCAVAWVFVYLKVPETKGMPLEVISEFFSVGAKQQDAAASFLSDG

SEQ ID NO: 29884 - protein, 326 aa, Escherichia coli
KTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLSKFFAQTEALAFGKSREVVEQEYCDQGKDPAT

SEQ ID NO: 29885 - protein, 349 aa, Sauromatum guttatum
MMSSRLVGTALCRQLSHVPVPQYLPALRPTADTASSLLHGCSAAAPAQRAGLWPPSWFSPPRHASTLSAPAQDGGKEKAAGTAGKVPPGEDGGAEKEAVVSYWAVPPSKVSKEDGSEWRWTCFRPWETYQADLSIDLHKHHVPTTILDKLALRTVKALRWPTDIFFQRRYACRAMMLETVAAVPGMVGGVLLHLKSLRRFEHSGGWIRALLEEAENERMHLMTFMEVAQPRWYERALVLAVQGVFFNAYFLGYLLSPKFAHRVVGYLEEEAIHSYTEFLKDIDSGAIQDCPAPAIALDYWRLPQGSTLRDVVTVVRADEAHHRDVNHFASDVHYQDLELKTTPAPLGYH

SEQ ID NO: 29886 - protein, 76 aa, Oryza sativa
KNLGEVLKAAGASYKNVVKTNVFLQDMNDFAAMNEVYAEVFTDRHPARSTVQVAGLPKNAKVEIEAIAVLGDIKDE

SEQ ID NO: 29887 - protein, 529 aa, Arabidopsis thaliana
MEASISFLGSTKPNISLFNPSSNVLPRRDFPLPALKLKKVSVLPRILHQKRLIRAQCSDGFKPEEDDGFVLEDVPHLTKFLPDLPSYPNPLKESQAYAIVKRTFVSSEDVVAQNIVVQKGSKRGVHFRRAGPRERVYFRSDEVKACIVTCGGLCPGINTVIREIVCGLNNMYGVNNILGIQGGYRGFYSKNTMNLTPKVVNDIHKRGGTFLQTSRGGHDTAKIVDNIQDRGINQVYIIGGGGTQKGAEKIYEEVERRGLQVAVSGIPKTIDNDIAVIDKSFGFDTAVEEAQRAINAAHVEVESVENGVGIVKLMGRYSGFIAMIATLANRDVDCCLIPESPFFLEGKGGLFEFIEERLKENRHMVIVIAEGAGQDYVAQSMRASETKDASGNRLLLDVGLWLTQQIKDHFTNVRKMMINMKYIDPTYMIRAIPSNASDNVYCTLLAQSAVHGAMAGYSGFTVGPVNSRHAYIPISVTEVTNTVKLTDRMWARLLASTNQPSFLTGEGALQNVIDMETQEKIDNMKISSI

SEQ ID NO: 29888 - protein, 471 aa, Arabidopsis thaliana
MAMSDLPNDLVEEIISRVPVKSIRAVSSTCKNWNTLSNDHSFTRKLFGKTITTKENECLVVMMMDSKVYLMSVNLHRIHKENDDNNIKSSIMHKAKLISLNDDDILNNTYIIFHCNGLLLLLGFTDDGIKLVVTNPHLGQTRWIKPRKANYQFCDKYAIGYEKKKNNSLRTNKMLLFHKESFCFRIYWFEIYNFNSASWNVFYFTRDWELPYSQGVSLKGNTYWFAREINIRGERIDDPPDFLICFDFTTERFGPRLHLPFHSHSDDTVILSSVREEQLAVLIKRFDLWRMEIWVTTKIEPKEVSWNKLFLAVDMIPLITAFQFCNVSFFIDEKKNVVVVLGKDVLNTRNIANIIGNDGYFKQVDLGESTNKYCYPLVCSYVPSSVQIKQATRVMHHHHIVLRAVVRAVRDSDRERKLNNGREHKISRRTRIHERILFRMLKLDEEAIGIRSRSVPRDRYQQGFASSPCRA

SEQ ID NO: 29889 - protein, 365 aa, Candida albicans SC5314
MLTASLYKQLPVLTTTATSTYSFIRLSSTLATPPHSTTTTSPSSPAFHQPNHPQQFANPNTSVFDVSTRIYTQEGIDNNNDTKFLTKAPYPHPVFPQDECENVTVTHRETKTLGDKISFRSIQFMRQCFDLVTGYAVPKTNNPEEFKGTRWEMTEGKWLTRCIFLESVAGVPGSVAGFLRHLHSLRMLRRDKAWIETLLDEAYNERMHLLTFIKIGKPSWFTRSIIYVGQGVFTNVFFLLYLLNPRYCHRFVGYLEEEAVRTYSHLLDELAVPGKLPAFETMKIPEVAVQYWPELTPKSSFKDLILRIRADEAKHREVNHTFANLEQKTDRNPFALKIEGLNKPQPNHGINVMRPTGWEKQDLQL

SEQ ID NO: 29890 - protein, 239 aa, Triticum aestivum
  misc_feature (228)..(228): Xaa can be any naturally occurring amino acid
  unsure (1)..(239): unsure at all Xaa locations
MEEHREERCWEDLLPDALGLVFRNLSLQEMLTVVPRVSKSWSRVVSGPYCWQEIDIQEWSQQQNKPDQLTRMAHTLVTRSGDSFRRISVSGLPNDSLFTFIANHARSLKTLELPRSEISDCIVEDVAQRLSNVTFLDVSSCTKIGARALEAFGKNCKSLVGLRRVMHPIDVAGKVCQHDEARAIACSMPKLRHLEIGYMLIATNAVVEIASRCRDLSFLDLRGCWGVXDKLLQDKYPGL

SEQ ID NO: 29891 - protein, 310 aa, Escherichia coli CFT073
MLDANKLQQAVDQAYTQFHSLNGGQNADYIPFLANVPGQLAAVAIVTSDGNVYSAGDSDYRFALESISKVCTLALALEDVGPQAVQDKVGADPTGLPFNSVIALELHGGKPLSPLVNAGAIATTSLINAENTEQRWQRILHIQQQLAGEQVALSDEVNQSEQTTNFHNRAIAWLLYSAGYLYCDAMEACDVYTRQCSTLINTIELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 29892 - protein, 512 aa, Debaryomyces hansenii CBS767
MEWQNPTKYKRSSVSMGMPYSQGGYGLSYTSPQQQQRTQFYSGRHALLPPSSNGNNRGLANEGGSGVLDRHSYYFSPDPLYCSDWTYLNGGEMDCIALSSYKEGFSNKILVVHGVGYGREATCAGNGDMDDDDVTMGSPTSSAYQDDAIEGFDFHKVAEVSVDYPVTNLQWDPSMLRMGNGVSERLGASLEVLRLYKVDHEALDKNSDYKLTQTHILANNTATASSSTSSSAQSNTGASGSASEDMNTFPPVTSFDWNKVDPNLIITSSVDTTCTVWDLNRSSLTADPSSDLGAATDTATVKTQLIAHDSEVFDVKFIHNSTNVFASVGNDGSMRVFDLRSLEHSTIIYEPSHPPTSALTLTTPHHNSRALLKLSASNIDQNYLATIGVNSNQVIIIDMRMPGLPVAALDGSLGGANTAAINSIQWHPSSNYLLTGGDDCQALVWDCNNIRHPGAPKTPSSASSHPPEFTSLVESPVLAYSDDLEVNNVCWRRDQGDWMGVVSGKGFQAVLI

SEQ ID NO: 29893 - protein, 451 aa, Photobacterium profundum SS9
MAKHFDYICIGGGSGGIASANRAAMHGAKVALIEAKALGGTCVNVGCVPKKVMWHGAQIAEAIHLYSKDYGFDVDVKSFNWSTLVKNREAYIGRIHQAYDNVLGKNKIEVINGFAKFVNDKTIEVNGEQLTADHILIAVGGEPTIPNIPGAEHGIDSNGFFGLNEQPKRTAVIGAGYIAVEIAGVLSALGTDTHLFVRKESPLRSFDPLIVETLVEVMNAEGPTLHTHSVPKEIIKEADGSTTLHFENGESHNTDLLIWAIGRNPTTDKINLASTGVETNSRGYIKVDEYQQTNVAGIYCVGDIMEGGVELTPVAVKAGRQLSERLFNGKTEAKMDYKLIPTVVFSHPPIGTIGLTEPEAIAQYGEDNVKVYTSGFTAMYTAVTSHRQPCKMKLVCAGPEETVVGLHGIGFTVDEMIQGFGIAIKMGATKADFDSVVAIHPTGSEEFVTMR

SEQ ID NO: 29894 - protein, 349 aa, Synechococcus elongatus PCC 6301
MTTVLAVETSCDETAVAIVKDRHILSSIVSSQIDLHRRYGGVVPEMAARQHLETVNPAIALALSEAGLDWSAIDGIAATVAPGLVGALLVGTMAAKTLALLHNKPFLGVHHLEGHIFAAYLQEPSLEPPFLSLLVSGGHTSLIRVDGCGQYRTLGQTRDDAAGEAFDKVARLMGLGYPGGPVIDRLAANGNPKAFPLPEGQISLPGGGYHPYDCSFSGLKTAMLRLCDRLRAESEDLPIADLAASFQATVARSLTKRAIAAALDEGLTTIAVGGGVAANRGLREQLGKAAAEHGITTLFPPLSLCTDNAAMIACAAAAHLAVGDRSDLSLTVRSRLPLEAVAELYQRSA

SEQ ID NO: 29895 - protein, 382 aa, Medicago truncatula
MDEVPVIEENETKSEAHLTSAAAFVEGGIQDACDDSCSICLEEFIDSDPSTVTSCKHEFHLQCILEWCQRSSQCPMCWQSISLKDPTGQELLEAVERERNIRFNPTRNATIFHHPTLGDFELQHLPVGANDADLEERILQHFAAAAAMGRARHIARREGQRNRSSAQGRPQYMVFSAHPNSPPMAPASSSPPQRGDGEQTPATGEEPPQLTLVPPVQTDQVSASGSGSAALATDNLGLSYNSRRSPNQSSPSSQDRAGPSELQSFSESLKSKLNAVSTRYKESISKSTRGWKERWFSRTSPMSDLGSEVKREVNAGIATVSRMMERLETRDNNRSSSDTAPSNLADGPIQGSSDQHLTDTERDSPLRDNNSKTSCTAGSSSN

SEQ ID NO: 29896 - protein, 540 aa, Mycobacterium avium 104
MTAIVEPSVTTGPIAGSSKVYRELDGVPGARVPFRRVHLSTGDHFDLYDTSGPYTDPDATIDLTAGLPARPGRVRDRGTQLQRARAGEITAEMAFIAAREGMPAELVRDEVARGRAVIPANHNHPEIEPMIIGKAFATKVNANIGNSAVTSSIAEEVDKMVWATRWGADTIMDLSTGKNIHETREWILRNSPVPVGTVPIYQALEKVKGDPTLLTWEIYRDTVIEQCEQGVDYMTVHAGVLLRYVPLTAKRVTGIVSRGGSIMAAWCLAHHRESFLYTNFDELCEIFARYDVTFSLGDGLRPGSIADANDAAQFAELRTLGELTKIAKSHGVQVMIEGPGHVPMHKIVENVRLEEEWCEEAPFYTLGPLATDIAPAYDHITSAIGAAIIAQAGTAMLCYVTPKEHLGLPDRKDVKDGVIAYKIAAHAGDLAKGHPHAQERDNALSQARFEFRWNDQFALSLDPDTAREYHDETLPAEPAKTAHFCSMCGPKFCSMRITQDVRDYAAKHGLDSEEAIEAAMADKSREFAEHGNRVYLPLAQ

SEQ ID NO: 29897 - protein, 106 aa, Xanthomonas axonopodis pv. citri str. 306
MPVMERIQAEVEQHPIVLFMKGTPQFPMCEFSSRAVQALVAAGADQLRTVNVLEEPEVRANLPRYSNWPTFPQLFIHGELIGGCDITLELFEAGELKRIVSEAYQP

SEQ ID NO: 29898 - protein, 521 aa, Arabidopsis thaliana
MKSNKFSCKTRAETLEWITAIIDFLKPFSFLINAHVVNFFKDKQWEAVNEEWMSCLKDEKPENILLIPSGGVQDHWPASLKKFVHTLRSLSFPREQADLQAILADVDMVPLSTVLSQGMNLKKKHEVEVLSSVVSSVVKSVGAPTVVDVGAGQGYLAQVLSFQYKHSVVAIDSSSHHGKVTDARAARIKKHFAAQMRKSGSGNKCPDVPMTITCRVLSTEMLKALTDVHLEKDETDSSGSALNEEGQSRSQSSSDANRSCSLVLAGLHACGDLSVTMLRTFMECEEVKALVSIGCCYNLLSEKSSEDSCSKCGYPMSAGLRSLGFSLGKNARDLACQSAERWSSLGEDAGLQNFELHSFRAAFQMVLSKHYPEVLATSPSIGRQGKAFRRQQQRKSLETPAAVDTTRKDTVDKKPMRQTSLNSDMCSSFEKFCLSAFSRLNLEHPRDLDLNATWNEADAFTELIGPYWSIRAALGPVLETLILLDRLMFLQEQGDSIKVVMLPIFDPTISPRNVAIIARRL

SEQ ID NO: 29899 - protein, 387 aa, Oryza sativa (japonica cultivar-group)
MAAEADARKVCGLPERVQLHGAMLALQFGYAGFHVVSRFALNMGISKLVFPVYRNIIALILLVPFAYFLEKKDRPQLTLSFVVQFFLLALCGITANQGFYLLGLDNTSPTFASAIQNSVPAITFAMAAALRIERVRLDRRDGVAKVLGTLACVAGASVITLYKGPTIFGPKLQLQAVAEVPFKAAIAGEGKNWTLGCVYLIGHCLSWSGWLVLQAPVLKKYPARLSVTSYTCFFGVIQFLIIAAFMERDADAWAFHSGSELFTILYAGFIASGVAFAVQIWCIDRGGPVFVAVYQPVQTLVVAIMASLTLGESFYLGGIIGAVFIIAGLYLVLWGKSHERARLAKDAAAIATDRDAAPCRIIAAGKQSSSVTQPLLLPTSSSSDNAV

SEQ ID NO: 29900 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLSKFFAQTEALAFGKSREVVEQEYRDQGKDPAT

SEQ ID NO: 29901 - protein, 324 aa, Arabidopsis thaliana
MGYEKFTWVIKNFSSLQSKYINSDKFVIGGCKWFLKGYQNANYLSLFLMVATSKTLPCGWRRYTRFRLTVVNQLSDELSQQRETETWFDQNVVLSGNRHMISLTKLNAKKGGFLVNNEVKIVVEVDVLQVIGKLDVSEGSQEVTQPLKRIRLNDDGVSVKQSIDVNGFQVLPSQVESVKRIFERHPNMALEFRAKNQHVRTSCMNVLLSLIDTLCQSLQDISIDDLGQAEKALRYLKDSDFKVDWLERKLEEVKEKKMEEQIGKSRMQELEEELKIFKQKCSDIEAQLEKEKQKCSDIEALLEKEKAKSLAAARAPPLTLDDVV

SEQ ID NO: 29902 - protein, 725 aa, Rhodopseudomonas palustris [sequence omitted]

SEQ ID NO: 29903 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLFKFFAQTEALAFGKSREVVEQEYCDQGKDPAT

SEQ ID NO: 29904 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALVGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLFKFFAQTEALAFGKSREVVEQEYCDQGKDPAT

SEQ ID NO: 29905 - protein, 448 aa, Arabidopsis thaliana
MSSVSTASLNCLPDELLVHVLSSLETKQAASTSVLSKRWRTLFAVRRNLDFDDSIISHPEVGEQNMDDVQESFRDFVDKRLAFQGSVPINKFSLIYGDKHDDVRVDRWINTALEHGVSELHLCLTSVTRRLHRFPSNVFRSTTLVKLTLGTNLFIVYFPSDTCLPVLKILVLDSIWFDRIKFSNVLLAGCPALEDLTIDQKSFPGLPNVVSSKTVKSLSIVYKYSADFDWFRTVALDTPNLVTLLYSTYARHRYRHCNLESLVNATLDLHFLENCDEAFEPNVTDLMIAVRNVQMLHLTSSATEVISQCCKGGLPMFKNLLVLVFLGNTERVWKVFLPLLLEHSPNLTKLCLESLFLILQGLYHGTDEDEFDEIHIPRSNKVNMLRIIQCQGTENELKHISHFLLKMECLQLVQVNFSETIVDSKKVQLTEDLMKLPSASSRLTMQVI

SEQ ID NO: 29906 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGKVVDYQTGPIIWGEPGTNGQHAFYQLIHQGTKMVPCDFIAPAITHNPLFDHHQKLLFKFFAQTEALAFGKSREVVEQEYCDQGKDPAT

SEQ ID NO: 29907 - protein, 157 aa, Brassica napus
  misc_feature (8)..(8): Xaa can be any naturally occurring amino acid
  misc_feature (35)..(35): Xaa can be any naturally occurring amino acid
  misc_feature (131)..(131): Xaa can be any naturally occurring amino acid
  unsure (1)..(157): unsure at all Xaa locations
YSSPKKKXDYLYCGSSLYGNLSPQRVREWITYHVXFFGERSHFVLHDAGGIHDEVFEVLRPWIELGRVTVHDIREQERFDGYYHNQFMVVNDCLHRYRFAAKWMFFFDVDEFIYVPEKETIKSVMESLEEXSQFTIEQMPMSSKICYSGDGPARTYR

SEQ ID NO: 29908 - protein, 422 aa, Rickettsia conorii str. Malish 7
MSSCDLIAGSRKNTKDWTPWSSELGDSRKNTMTNNTKTITLNIGPQHPATHGVLRLILEMDGEVVNNADPHIGLLHRGTEKLIEHKTYLQAIPYFDRLDYVSPMCQEHAFALAVESLLECEVPRRAQFIRVLFSELTRILNHTLNIGSQALDIGATTPLLWLFEEREKIMEFYEHVSGSRMHSNYFRPGGVAADLPEGLLEDIDKFIEQFPPKLHDIESLLNENRLWKQRLVDIGVASQKEAMDWGFSGPMLRGSGIAWDLRKSNPYDVYDEMDFKVPIGKNGDCYDRYFVRMLEMYESIKIIKQCIEKMPKGAIKTDDPKLTPPTRAKMKESMEAMIHHFKLYTEGYDVPAGETYKAVEAPKGEFGVYLYSQGGNRPYRCRIKAPGFAHLQGLDFMSKGHLMADVITIIATLDIVFGEIDR

SEQ ID NO: 29909 - protein, 136 aa, Dehalococcoides ethenogenes 195
MEETVNNQETPETSEEETADEETVAVENTAAGKVLPSFGPGDTIKVHARIKEGDKERIQMFQGVVLKVKQAADGGNFTVRRISYGVGVERTFPFLSPNVTKVEVIKRGRVRRARLFYLRKLSGKAARIKEVKQTPS

SEQ ID NO: 29910 - protein, 130 aa, Ralstonia metallidurans CH34
MNIIEQIEKEEIARLTANKTIPAFAPGDTVIVNVNVVEGNRKRVQAYEGVVIAKRNRGLNSSFIVRKISSGEGVERTFQLYSPLIAGIEVKRRGDVRRAKLYYLRERSGKSARIKEKLVMKAKPAAVAAE

SEQ ID NO: 29911 - protein, 272 aa, uncultured archaeon
MMKVKDVMSSPVITEDEDTSVTIIARDMELSEIGSVVITREDKPVGIVTDRDISIKICAKMGTPGEVTAKGIMTSPLITIGPEAPVETACELLAETDIRRLPVMENDKLVGIISVRNILTGAPEYVQRFYPAEGELVPEQLEVGDVMTLEVITVDEDTVVSKISKDMEESEIGSVVITRGGKPVGMVTDRDIASKVIMEDKKASEIKAKDIMSSPLITIGPDASVEKACGIMAAKDIRRMPVMDEDKLVGIISVRNILTRSPGHVYKFYPGE

SEQ ID NO: 29912 - protein, 836 aa, Oryza sativa (japonica cultivar-group)
MSHPHATAPKRPGHFSSSSAAASSPTSPAQPHMKKAKFPGSSSSSSSAAAPGVTEKNGLHVDPTAAAARTGGRTNGEEDAEMVLADQEELAAPSASAPAGVAANLFRKKATLPQPSAARKPLRIKIGQPKLPTNFEEDTWAILKDAITAIFLKQKLSCDVEKLYQAAGDLCLHKLGANLYERIKKECEVHISAKISALVGQSPDLVVFLSLVQRTWQDFCDQMLIIRGIALLLDVKYVKNVANICSVWDMGLKLFRKHLSLSPEIEHKTVTGLLRLIESERLGEAIDRTLLSHLLKMFTALGMYSESFEKPFLECTSEFYATEGVKYLQQSDIPDYLKHVETRLQEEHERCILYLEANTRKPLITATEKQLLQRHTSAILEKGFTMLMEANRVKDLSRMYTLFQRVDAIELLKQALSSYIRGTGQGIIMDEEKDKELVPFLLEFKASLDRILEESFAKNEAFSNTIKESFEHLINLRQNRPAELIAKFLDEKLRAGNKGTSEEELEGILDKVLVLFRFIQGKDVFEAFYKKDLAKRLLLGKSASIDAEKSMITKLKTECGSQFTNKLEGMFKDIELSKEINESFKQSSQARTKLPSGIEMSVHVLTTGYWPTYPPMDVKLPHELNVYQDIFKEFYLSKYSGRRLMWQNSLGHCVLKAEFPKGKKELAVSLFQSVVLMLFNDAQKLSFLDIKESTGIEDKELRRTLQSLACGKVRVLQKMPKGRDVEDKDEFVFNEEFSAPLYRIKVNAIQMKETVEENTSTTERVFQDRQYQVDAAIVRIMKTRKTLSHTLLITELFQQLKFPIKPSDIKKRIESLIDREYLERDRSNPQIYNYLA

SEQ ID NO: 29913 - protein, 363 aa, Vibrio vulnificus CMCP6
MTDKTYKIAVLPGDGIGPEVMAQAHKVLDAIEKKHAIHFEREEHDVGGIAIDNHGCPLPQSTVTACEESDAVLFGSVGGPKWEHLPPNDQPERGALLPLRKHFQLFCNLRPAQIHSGLEAFSPLRADISGRGFDIVVVRELTGGIYFGQPKGREGEGANEKAYDTEIYHRFEIERIAKIAFESARLRRKKVCSIDKANVLQSSILWREVVEELAKDYPDVELSHMYIDNATMQLIKDPAQFDVMLCSNIFGDIISDECAMITGSMGMLPSASLNESKFGLYEPAGGSAPDIAGKNIANPVAQILSAALMLRYSLGEEAAAQDIENAVSQALAAGELTADLAGDKPALSTAEMGDKIAQYILNS

SEQ ID NO: 29914 - protein, 593 aa, Arabidopsis thaliana
  misc_feature (315)..(315): Xaa can be any naturally occurring amino acid
  unsure (1)..(593): unsure at all Xaa locations
MDKHHHQHLLLQHHQHLHHHQKLSLAKSSRQSCSEWIFRDVPSDITIEVNGGNFALHKFPLVSRSGRIRRIVAEHRDSDISKVELLNLPGGAETFELAAKFCYGINFEITSSNVAQLFCVSDYLEMTEEYSKDNLASRTEEYLESIVCKNLEMCVQVLKQSEILLPLADELNIIGRCIDAIASKACAEQIASSFSRLEYSSSGRLHMSRQVKSSGDGGDWWIEDLSVLRIDLYQRVMNAMKCRGVRPESIGASLVSYAERELTKRSEHEQTIVETIVTLLPVENLVVPISFLFGLLRRAVILDTSVSCRLDLERXGDTLFDIDTVHRILVNFSQQGGDDSEDEESVFECDSPHSPSQTAMFKVTKLVDSYLAEIAPDANLDLSKFLLIAEALPPHARTLHDGLYRAIDLYLKAHQGLSDSDKKKLSKLIDFQKLSQEAGAHAAQNERLPLQSIVQVLYFEQLKLRSSLCSSYSDEEPKPKQQQQQSWRINSGALSATMSPKDNYASLRRENRELKLELARLRMRLNDLEKEHICMKRDMQRSHSRKFMSSFSKKMGKLSFFGHSSSRGSSSPSKQSFRTDSKVLMERTCASTD

SEQ ID NO: 29915 - protein, 512 aa, Synechococcus elongatus PCC 6301
MAQATATTEKLNKFEKLKLEKDGLAVRDQIQHFASIGWEAMDPGDREHRLKWLGIFWRPVTPGRFMARLRIPSGILQSQQLNALANFLQRYGDQASIDITTRQNLQLRGLLLEDTPEFLERLHAVGLTSVQSGMDNVRNITGSPVAGLDAAELFDTRSLIQALQDDLTAAGQGNSEFTNLPRKFNIAIEGGRDNSIHAEINDLAFTPAYQDGTLGFNVWVGGFFSSTRVAPAIPLNAWVPADHSVIRLSRAILEVFRDNGSRGNRQKTRLMWLIDEWGIERFRQVVSEAYGAPLAAAAPELMDWEKRDFLGVHPQKQAGLNFVGLHVPVGRLTTEDLYELARLADTYGQGEVRLTVEQNVILTHIPDAQLPTLLAEPLLTRFSPQPAPLSRGTVSCTGSQYCNFALIETKQRAIAIAQSLEAELDLPRPVRIHWTGCPNSCGQPQVADIGLMGAKVRKDGQMVEGVDIFLGGKVGYDAHLGEKAMTGVACEDLPDVLRQLLIERFGAQARSH

SEQ ID NO: 29916 - protein, 527 aa, Oryza sativa (japonica cultivar-group)
MDKAYIAVFSIAILFLLVDYFRCRRRRGSGSNNGENKGMLQLPPSPPAIPFFGHLHLIDKPLHAALSRLAERHGPVFSLRLGSRNAVVVSSPECARECFTDNDVCFANRPQFPSQMPATFYGAGFGFANYGAHWRNLRRIATVHLLSAHRVRGMAGVVSGEIRPMVQRMYRAAAAAGVGVARVQLKRRLFELSLSVLMEAIAQTKTTRPEADDADTDMSVEAQEFKNVLDELNPLLGAANLWDYLPALRVFDVLGVKRKIATLANRRDAFVRRLIDAERQRMDNGVDGGDDGEKKSVISVLLSLQKTEPEVYKDIVIVNLCAALFAAGTETTAMTIEWAMSLLLNHPKILKKAKAEIDASVGNSRLINGDDMPHLSYLQCIINETLRLYPVAPLLIPHESSADCKVNGYHIPSGTMLLVNVIAIQRDPMVWKEPNEFKPERFENGESEGLFMIPFGMGRRKCPGETMALQTIGLVLGALIQCFDWDRVDGAEVDMTQGSGLTNPRAVPLEAMCKPREAMSDVFRELL

SEQ ID NO: 29917 - protein, 119 aa, Glycine max
SWPVESLPDVMPRSAKVKSVATLETVREIGVYIQRFHNLDLFKQGWYRIKITVRWEDSENMSFGIPASVVQYEAPDMDPSSIYGVWRIDDTDNSFSTQSFRIKYARQDVHLYMMNVFNL

SEQ ID NO: 29918 - protein, 268 aa, Propionibacterium acnes KPA171202
MRCAVIGHPVAHSLSPAIHRAAYQVLGLEWSYQAIDVEPGGLRAFIEGLDGSWRGLSVTMPHKADLVELGETDATVDMLGAANTWVCRDGTTIVRNTDVTGAEAALRARGVTDVEKVVMLGAGATARSVLAAAIGMGAGEAVVMSRSRERSTKILKLADGLGIRVAWLPFESEPPRCNLIVSTVPAGSLIRRAEDLAARANAVFDVVYDPWPTPLAVAGKIAGATVIDGLDLLAGQAVGQVQLMTGYPVPMDVLRSTAQNGLAEHARL

SEQ ID NO: 29919 - protein, 540 aa, Prochlorococcus marinus str. MIT 9303
MSSSSSGNSRHFGRVAPVVLAILDGWGHREELEHNSIRSAETPIMDALWHAYPHTLIEASGAAVGLPDNQMGNSEVGHLTIGAGRVIRQELVRISETVQTGRLGQTPALIALAERLRKSDGTLHLLGLCSDGGVHSHINHLCGLLHWAAAAGLNKVALHLITDGRDTPTQSASNYLHQIEDAINASGVGELASLCGRYWAMDRDHRWERTIRAYEVLTDPNQSISRVTAEDVLSASYANGTTDEFLEPTRLSNNYFKDGDGLVMFNFRPDRARQLVQSLTLPDFDGFPRANQPSLDVVTFTQYEHDLPVAVAFPAESLDDLLGQVVSEHGLRQYRTAETEKYPHVTYFMNGGIEQPLAGEERHLVPSPRVATYDLAPAMSADTLTESCVKAIESGVYSLVIINYANPDMVGHTGVMGAAQEAISTVDRCIGRLLDSTGRMGGTLLITADHGNAELMQGSDGQAWTAHTTNPVPVILVEGEKRKLSGYGNDIQLRAGGGLADIAPTLLQLLDLPKPDAMSGLTLIQAIESPTPSARLPQPV

SEQ ID NO: 29920 - protein, 303 aa, Rosa hybrid cultivar
TKLVCKMPSRLINWQVQFFGREWDFMDLYHLTLFLGVPFVCLLAPFQFTWGALWVAISLYLVSGMGVTISYHRNLAHQSFKVPKWLEYSLAYCAVLSLQGSPLEWVSTHRYHHQFTEKLRDPHSPNKGFWFSHLNWLFDYHSRFGSYDGQLMKNVGDLECQLYYRFLHYTYFLHSVLLGVALYVAGGLPFVIWGMGVRVVVISQVTFSINSICHTWGKQIWDTGDASKNNWLFGLLAFGEGWHNNHHAFEYSARQGLERWQIDTSWYVIKFFQVVGLATHVKLPTEIQKKRKALAKNSIMKDK

SEQ ID NO: 29921 - protein, 430 aa, Staphylococcus epidermidis RP62A
MFERTVQPVLDVKDKPKPAQWAFLSLQHLFAMFGSTVLVPFLTHLPISAALLASGIGTLLYILITKAKIPAYLGSSFAFITPIITGLSTHSLGDMLVALFMSGLMYVIIGIFIKLSGTHWLMHLLPPVVVGPVIMVIGLSLAPTAVNMAMFENSAEMKGYNLSYLIVALITLAVTIIVQGFFKGFLSLIPVLIGIIVGYIVSIFMGIVKFAPIAQAKWIDFPHIYLPFKDYTPSFHLGLILVMIPVVFVTVSEHIGHQMVINKIVGRNFFENPGLDKSIIGDGVSTMFASMIGGPPSTTYGENIGVLAITKIYSIYVIGGAAVIAIILAFIGKFTALISSIPTPVMGGVSILLFGIIAASGLRMLVESQVDFSSNRNLVIASVVLVVGIGNLLINLKGIGINLQIEGMALSALSGIILNLILPKEKNQIN

SEQ ID NO: 29922 - protein, 232 aa, Zea mays
MDATLLLLPANCTAAASGRMRPRLPAGPHVASPGPSARPRTSIRASAVSAALAVRGLPQHASVAGQSTGSYRVGDVMTKREELHVVKPTTSVDDALEMLVKHRISGFPVIDDDWNLVGVVSDYDLLALDTISGAGPAEADIFPEVDSTWKTFHEIQKLLSKTNGKVIADVMTPAPLVVRETTNLEDAARLLLVTKYRRLPVVDSSGKLVGIITRGNVVQAALEIKKKVEGTL

SEQ ID NO: 29923 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQELLSKFFAQTEALAFGKSREVVEQEYCDQGKDPAT

SEQ ID NO: 29924 - protein, 1057 aa, Staphylococcus epidermidis RP62A
MPKRDDIQTILVVGSGPIIIGQAAEFDYAGTQACLALKEEGYRVILVNSNPATIMTDKEIADKVYIEPLTHDFIARIIRKEQPDALLPTLGGQTGLNMAIQLHDSGVLEANNVKLLGTELESIQQAEDREMFRTLMNDLNVPVPESDIVNTVEQAFEFKEQVGYPLIVRPAFTMGGTGGGICHNDAELKEVVSNGLHYSPATQCLIEKSIAGYKEIEYEVMRDKNDNAIVVCNMENIDPVGIHTGDSIVVAPSQTLSDVEYQMLRDVSLKVIRALGIEGGCNVQLALDPHSLNYYIIEVNPRVSRSSALASKATGYPIAKLAAKIAVGLTLDEMLNPITGTSYAAFEPTLDYVISKIPRFPFDKFEKGERELGTQMKATGEVMAIGRTYEESLLKAIRSLEYGVHHLGLPNGESYELDYIKERIGHQDDERLFFIGEAIRRGTSLEELHNMTKIDYFFLNKFQNIIDIEHELKNHQGDLEYLKYAKDYGFSDKVIAHRWDMEEKDIYELRMSQNIKPVYKMVDTCAAEFESTTPYYYGTYEDENESIVTDKEKILVLGSGPIRIGQGVEFDYATVHAVWAIQNAGYEAIIVNNNPETVSTDFSISDKLYFEPLTEEDVMNIINLEQPKGVVVQFGGQTAINLADKLAQHGVKILGTSLEDLNRAEDRKEFEALLREISVPQPQGKTATSPKEALKNAREIGYPVVVRPSYVLGGRAMEIVDNDQELENYMTQAVKASPEHPVLVDRYLTGKEIEVDAISDGETVVIPGIMEHIERAGVHSGDSIAVYPPQTLTQDEINTLEDYTIKLAKGLNIKGLINIQFVIAHDGVYVLEVNPRSSRTVPFLSKITDIQMAQLAMRAIMGETLAEMGYKQGIQPYSEGVYVKAPVFSFNKLKNVDITLGPEMKSTGEVMGKDLTLEKALYKGLTGSGFEVKDHGTVLMTVSDKDKDEIVKIAHRLNEIGYKILATRGTAQKLKDHNIPVEVVGKIGGEDDLLTRIQNGEVQIVINTMTKGKEIERDGFQIRRTTVENGVPCLTSLDTASALTNVIESMTFTMRNV

SEQ ID NO: 29925 - protein, 495 aa, Eschscholzia californica
MEEMKFLIMNNPWVLFATSATLLISIFLFFRRKSPNMAWPEGPKTLPIIGNMHLLGGTALQVVLYNLAKVHGRVMTIWIGSWRPVIVVSDIEQAWEVLVNKSSDYSARDMPDITKIVTADWRTISTSDSGPHWSNLRKGLQNIAISPNNLAAQFQFQEKDIIKMIQILEQEAKDNNGIVKPLDHLKKATIRLISRLVFGRDFEEDKYVEDMHHAIEELIRISGYARLAEAFYYAKYLPSHRKAVRYVEELKQIVKNLIRPFLSVNPPTNTYLHFLRSQNYDEEVVIFAIFETYLLGVDSTSSTTAWALAYLVREPSVQDRLHQELDHFAKQNDRKILKVEDMNKLQYLQAVIKETMRMKPIAPLAIPHKACKDTSLMGNKINKGTRVMVNLYALHHNKNVFNDPFKFMPERFLKVDNQDAKGKAMEQSLLPFSAGMRICAGMELGKLQFSFALANLIFAFKWSCVDDGVLPDMSDELGFVLLMKTPLKARINPRN

SEQ ID NO: 29926 - protein, 197 aa, Heliobacterium chlorum
AGGIAEMAELGPEVRKKTDKLDAVGNTTAAVAKGFAIGSAALTALALFTAFAEEVVKSPGVSSALHGSHFVLNLLEPKIIIGLFIGGTVPFLFCAFAMEAVGKAAFEMIGEVRRQFREIPGLMEGKAKPDYARCVDISTRAAIRQMIAPGLLAVITPLIVGFGFGAQALGGMLAGVTVAGVLLAIFMANAGGAWDHA

SEQ ID NO: 29927 - protein, 188 aa, Brassica napus
  misc_feature (91)..(91): Xaa can be any naturally occurring amino acid
  unsure (1)..(188): unsure at all Xaa locations
MSCSSSSGSEEDDEGFDSYRKGGYHAVRIGDQFSGGRYIAQRKLGWGQFSTVWLAYDTHTSNYVALKIQKSAQHFSQAALHEIELLQAAAXDGDPANTKCVVRLIDDFKHAGPNGQHLCMVLEFLGDSLLRLIKYNRYKAMELNKVREICKCILTGLDYLHRELGMIHSDLKPENILLCSTIDAAKDP

SEQ ID NO: 29928 - protein, 197 aa, Allochromatium vinosum
AGGIAEMSGLPEDVRKTTDALDAVGNTTKAVTKGYAIGSAGLAALVLFADYTHNLEVAGKMQVFSLSDPAVIIGLFIGGLVPYLFGAMAMEAVGRAAGSVVIEVRRQFREIKGIMEGTAKPDYSRAVDLLTKAAIKEMVVPSLLPILVPVAVAIGMNILMGDGAGIRALGGMLIGTIVTGLFVAISMCTGGGAWDNA

SEQ ID NO: 29929 - protein, 817 aa, Oryza sativa (japonica cultivar-group)
MAATPTTSASAAATTRLFLPTRRHLHETASVPAPSRTIARRYSGGVRSLGPPRAAAGELGGGAGGTITGKGAVRIVSIVGDGSISPLKDTPWEEVMRHTANRMKWVDEGFEMLVFTDKSIGHDELRKELAQCDMLVNVAITSQETVQWLINNSEDIPNIICFQSSPTLENKLGGRYVQYTGRQDMFCKLTNIGETGGMKESAEVLKAVSNAWERHNSDDIRFCLLVVVNAYIRPVDMLQNLRAKGLSTLSCMIRNCGPQILNCLFDPNCRKALQCLNSCSPTDQVCNYRCIASYESPHLEAFSLCVLQKNNCLDLNAEIPSKPSVPPLTMFREQMLSHELAEDMFVGWLDNLEWSWRVVAGQNPAYDQFPCQYQLFYRGKAKGSFWYEPIFQVRTLEGELVWRRRKYRVRRALIPGTFYFSVLDNGVVSKEFWTIVDVSDDFSWGLFHYHGAAQAAGLAYTGAVLVSPDGSCPDLDDPRLASALDKCGIKKWELYMVDNCSCTGAPLGTPGDAKLHYQIAPGKESDPPQQFALFTVQDWSCGPVEVIEKKQRARMAGLYERPSETYTKKRPRYPDAWFSKLAALTAGHHRAWDAGCGTGQASISIAEHYDSVVATDASEGQIRHAVAHPKVRYLHTPVDLSEDDLVAMVGGEGSLDLVVVATSIHWFDIPLFYAVANRVLKRPGGVLAVWGYNYEIHPFEDKLHGQLYPAMRPYMDPRTRLAMDRYRDLPFPFEPVGVGREGEPADVDIEVDMTLDDLVGFLKTGSVVTTAREKGVDLEAVTKDVMKGVEAEWGDPAVARKLVFKAFMLAGKPKVLN

SEQ ID NO: 29930 - protein, 495 aa, Eschscholzia californica
MEEMKILMMNNPWILTATATTLLISIFLFFTRKSSKMVWPAGPKTLPIIGNMHLLGGTALQVVLHNLAKVHGSVMTIWIGSWRPVIVVSDIERAWEVLVNKSSDYSARDMPDITKIISADWKTISTSDSGPHWTNLRKGLQNVALSPHNLAAQFQFQEKDMTKMIQTLEEEARNNNGIVKPLDHMKKATLRLISRLVFGQDFNNDKYVDDMHLAIEELIRVSGYARLAEAFYYAKYLPSHKKAVREVEEAQRRVQNLVSPFLSLNPPTNTYLHFLRSQKYDDEVIIFAIFEAYLLGVDSTSLTTAWALAFLIREPNVQEKLYQELESFASKNDRRILKVEDINKLQYLQAVIKETMRMKPIAPLAIPHKACRDTSLMGKKIDKGTRVMVNIFALHHNKNVFNDPFKFMPERFMKVDSQDANGKAMEQSLLPFSAGMRICAGMELGKLQFSFALANLAYAFKWSCVADGVLPDMSDQLGFVLLMKTPLEARINRRN

SEQ ID NO: 29931 - protein, 326 aa, Escherichia coli
KTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLSKFFAQTEALAFGKSREVVEQEYRDQGKDPAT

SEQ ID NO: 29932 - protein, 729 aa, Synechococcus elongatus PCC 6301
MFDLSKFLPVITPLMIDTAKTLCPYCGVGCGLEAVPPAQPGRATVRDREGTPIWQIRGDRQHPSSQGMVCVKGATVAESVSKSRLKYPMFRASLDDPFTEISWDEALDRLCDRIQQTQADYGKDGICFYGSGQFQTEDYYIAQKLVKGCLGTNNFDTNSRLCMSSAVSAYSLCLGSDGPPACYEDLDLADCLLIVGSNTAECHPILFNRYRKRHKQGGTNLIVVDPRCTPTAEVADLHLALKPGSDVALLNGLGWLLYQMGYVKKDFIANQTEGFEDWLAIIEDYPPQRTAELTGLAVAELVRAADLIASAQRWLSLWSMGVNQSIQGTAKATSLINLHLLTRQIGLPGCGPFSLTGRPNAMGGRETGGLAHLLPGYRKVIDPQHRADVETIWGLPMGSISPQPGRTAWQMIEGLEQGAVGFLWVAATNPAVSLPDVKRAQAALKRSPFTVLQDAYHPTETTTYAHLLLPAAQWSEKTGTMTNSERRVTLCQAFRQPPGEARADWQIFAEVGRRLGFAFDYTDAAAVFAEYVQVTAGRLCDLSGLSHELLAQAGPQQWPFPAGAEPTTESKRLYTKHHFAYADGRARFQPFHHLGVAEPPDDRYPLVLTVGRLYGHWHTQTRTGRIDKINKLHPSAFVEIHPRDADRYNISEGQAVVIRSRRGEGCFPAKVTTAISPGVLFVPMHWGALWGDRTEANALTHPAACPISGEPELKACAVQIEAASSTFTI

SEQ ID NO: 29933 - protein, 585 aa, Aspergillus oryzae
MLSPPHLKPAVPSASLLRYLRSQSENTHVFISACGTSRKPQVHNQPSRMLALRNTSSWANIKPLRCRAALETNLLSVSTISRSRGSSRCRASLGQSPSPITVFSRATHTKSRPLLRRLFDLRRSKAAAEAKLNRAGSPALVDEGAEGLNFGRGLAAKASNELRLRCTEFDNNGNVTLVNGEFRKSELIAKYGLLPRDLRKIDSSTLPHILVRPSAILINLLHLRVLIKADRVLVFDAYGSTDSYMQSLFVYDLEGKLRQKQSQGAQALPYEFRALEAVLISVTAGLEEEFNGVREPVVRVLRALEEDIDRDKLRHLLIYSKKLGSFEQKARLVRDAIDDLLEADDDLAAMYLTERAEGVQRQEHDHQEVEMLLESYHKVCDEIVQESGNLVTGIRNTEEVVKAILDANRNSLMLLDLKFSIGTLGLATGTLFSALYGMNLKNFIEESDFGFGGVSVICFAITAVVCVYGLAKLRKLQRVRMWGEAGVGGSPMVSLPTRNSALTAHRSNWRADSIEPVWGSLPGEGRAERIRRLKDSAAAAAAKSAATEPTAQRAAASWNAAKSQPKQSGESATNEAAANIGGDSA

SEQ ID NO: 29934 - protein, 461 aa, Coccidioides immitis RS
MGTATAQSGLSSSVMHRDLHAAPKRAVGAEGNYVILEDGQRLLDSTGGAAVSCLGHANEQVKEAIKKQMDQLSYCHTMFFATDVFEELAAFLKESTGGKMSRLFVVSSGSEAMEAAMKLSRQYFLELPTPEPKRTRFIARQHSFHGVTLGSLSMGGHVFRRELFEPLLLPNISHVSPCNAYRGKRDGESDADYVGRLAAELDAEFQRVGPETVCAFVAEPVVGAALGCVPSVPGYFAAMKAVCDRYGALLIMDEVMSGMGRSGTLHAWEQEGVAPDIQTIGKGLGGGYAPVSGVLIGNKVVEVMDKGTGAFRHGQTYQGHPIGCAAALAVQKVIKEQNLLQNVREMGALLESKLREYIGDHPNVGNIRGKGLFWGIEFVKDKATKEPFDPKLAVGARVQNTALTPKYSFSIYAGGGTMDGKRGDHVLLAPAYNITANEVDMIARLTAAVIVEVFNEVSAST

SEQ ID NO: 29935 - protein, 451 aa, Trichodesmium erythraeum IMS101
MSDKKPNLEKDIFKYLKKKGTKFVRILFCDNANIIRSKAFHIDQLPEHFDTGVSITVAQQAFTVMSDVVIPETGLAPVGEAWLVPDWSTLHILPYAPTHASVVSDMFKDGSPWSLCPRRFLKQAIATAEKVGLQIKAAFENEFYLLKSTSDGIAPTDNTVFASTFGMDINRLVIDDIAESLIAQKIQVEKYYPESGPGQQEISIRYTDALQAADRQISFRETVRGVALKYGLTASFLPKIFANKAGSGCHLHLSLWEGEQNIVPDSDEIGKISKTARCFIAGILKHLPALMALTTPSVNSYRRIRPHFWSGAFRTWGLDNREAAVRVPSNFAPPSPTHFELKTVDASANPYLALGSVIVAGLDGINCGLDVGEPVSVDPGNMMQAEREARGIDALPSSLAEAIAHLNNNDVLKNALGSELAQAFIAVRQAEWEEMKNMEIEEEVKILLSRY

SEQ ID NO: 29936 - protein, 282 aa, Vibrio vulnificus CMCP6
MVGNVFCLFWARASARALGYQGNAHTTAAAFIEFIHTATLLHDDVVDESDMRRGKATANAAFGNAASVLVGDFIYTRSFQMMTELGSMKILKLMSDAVNIIAEGEVLQLMNCNDPDTTEESYMQVIYSKTARLFEAATQIGAILNDAPAEVETALQNYGKYLGTAFQLIDDVMDYTSDGEEMGKNVGDDLAEGKPTLPLLHAMRHTNAENAQMIREAIENANGMERLDDILAVMQQAGSLTYTEAKAMEEADKAIAELQVLPESEYKQALIALAHMAVKRSK

SEQ ID NO: 29937 - protein, 327 aa, Acholeplasma laidlawii
MAIITLLEAINQAIDQAMEKDESIVVFGEDAGFEGGVFRVTAGLQKKYGETRVFDTPIAESAIVGSAVGMAINGLKPIAEIQFDGFIFPGYTDLVTHAARMRNRSRGQFTVPMVLRLPHGGGIRALEHHSEALEVLFGSIPGLKVVTPSTPYDAKGLLLAAINDPDPVVFLEPKRIYRAGKQEVPAEMYEIPIGKAKVVKQGTDMTVVAWGSIVREVEKAVKLVEAEGISVEIIDLRTISPIDEETILNSVKKTGKFMVVTEAVKSYGPAAELITMVNEKAFFHLEAAPVRFTGFDITVPLARGEHYHFPQPEKIAAYIRKLAKARP

SEQ ID NO: 29938 - protein, 162 aa, Xanthomonas axonopodis pv. citri str. 306
MNKITHYFKSLLLLELLGGLWLTLKYTFKPKYTVLYPMEKFPQSPRFRGLHALRRYPNGEERCIACKLCEAVCPALAITIDSAKREDGTRRTTRYDIDLFKCIFCGFCEESCPVDSIVETHILEYHFEKRGENIVNKPQLLAIGDRLETEIAERRAADAAFR

SEQ ID NO: 29939 - protein, 265 aa, Triticum aestivum
MHPTRWELSHMVDLQAARTSDFERPPGQVRYLVLDPTRNVHSILPKKSAWTNSYWDECVSLPTVVPRGPVALLGLGAGTAAHMMLEVWPWIQLIGWEIDPTVIELSRDYFGMSTLEKTTELGGSLSVHIGDALSPSATVEGGFAGIVVDLFADGKVLPQLQEAETWLEIAKKLMPDGRIMVNCGAGDTAISLAADADVSSWVQNPTIKALCSAFPGQLNWKRLSEKESVNYVALTGPLPDLEEWSTSVPSELSLRVKQWVPCELA

SEQ ID NO: 29940 - protein, 374 aa, Cryptococcus neoformans var. neoformans B-3501A
MSPVRVPSHGDGWASTPQTKQVYYIASIPADGIGPEVVEAAITVLKAIAKKRGTFQLDFTNFDWSSETYKKTGRYVPDNHLDILRKFDAILFGAVGAPDVPDHISLWGLRLAICQPLQQYANVRRTRVLPGTESPLRNCKPGQLDWVIVRENSEGEYAGHGGRSHNGYNHEVATEISIFTRVGVERIARFAFQLAQSRPRKKLTYVTKSNAQRNGMVMWDEVVNEVAKEFPDVELDHMLVDAMTVRMVLHPESLDTIVATNLHADILSDLAAALAGSIGIAPTANLDPSRQNPSMFEPIHGSAFDITGKGIANPVATFWTAVEMLEWLGEKEAGQQLMEAVEAVCVDGIKTKDLGGSATTKEVTDAVVKRILQG

SEQ ID NO: 29941 - protein, 234 aa, Brassica napus
  misc_feature (206)..(206): Xaa can be any naturally occurring amino acid
  unsure (1)..(234): unsure at all Xaa locations
MADKHQNDFIDEGDDFKTPQPLEKKKKKKKKKTTTIETESQRSVDITVKQISEKADRISPIVAYFSSGYDPSAQSRESPKVAVYQTASRKRTRVVVSPPGSNVEFVGSSHNGEQIARQTCVSVLGVLDKETQTLRILPIAHQKVLRLDTRVKGNEAGDSEAAEEDGEEEKADPSLHTFWTKRAILDDKKRKARILRDDPEAQKALXGKLDKVEVNTSALENTSAGCCTQIPPQN

SEQ ID NO: 29942 - protein, 435 aa, Xanthomonas axonopodis pv. citri str. 306
MSEFRQATDAFASNPVESKQEIRNYTMNFGPQHPAAHGVLRLILEMDGETVVRADPHIGLLHRGTEKLAESKPFNQSVPYMDRLDYVSMMCNEHAYVRAIESLMGIQAPERAQYIRTMFDEITRIKNHLMWVGSNALDLGAMAVMLYAFREREELMDVYEAVSGARMHAAYYRPGGVYRDLPDRMPQYKESRWHKGGALKKRNAGREGTMLDFLEEFTNTFPARVDEYETLLTDNRIWKQRTVDVGIISPDLARAWGMTGPMLRGSGIEWDLRKKQPYAKYDAVDFDIPVGTNGDCYDRYLVRVAEMRESNRIIKQCVKWLKANPGPVMVTNFKVAPPSREGMKDDMEALIHHFKLFSEGYCVPAGETYSAVEAPKGEFGCYLMSDGANKPFRVHLRAPGFAHLSSMDAVVRGYLLADVVAMIGTYDLVFGEVDR

SEQ ID NO: 29943 - protein, 181 aa, Arabidopsis thaliana
MSGITYQILFLLLLASVSLSPVRCLGYGASSEERTLAMIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHSIRALCGKNSQKNCVHGSDSTSSAEREIKFFFKDVVSGDIATQQHDEL

SEQ ID NO: 29944 - protein, 101 aa, Zea mays
PGGGYCATWDATNPLSWGIKYGWTAFWGPAGPPGQAGFGQCFLVATTATGGSIPVRVVDQCSNGGLDLDYDPGFKPIDPNGQGFQAGPLPVNYQLVNWGGN

SEQ ID NO: 29945 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGKVVDYQTGPIIWGEPGTNGQHAFYQLIHQGTKMVPCDFIAPAITHNPLFDHHQKLLSKFFAQTEALAFGKSREVVEQEYRDQGKDPAT

SEQ ID NO: 29946 - protein, 94 aa, Zea mays
GRVGGRVGRHRMVLRDNIQGVTKPAIRRLARRGGVKRISGLIYEETRGVLKIFLENVIRDAVTYTEHARRKTVTAMDVVYALKRQGRTLYGFGG

SEQ ID NO: 29947 - protein, 103 aa, Zea mays
  misc_feature (37)..(37): Xaa can be any naturally occurring amino acid
  unsure (1)..(103): unsure at all Xaa locations
MSGRGKGGKGLGKGGAKRHREGLRDNIQGITKPAIRXLGRRGGVKRISGLIYEETRGVLKIFLENVIRDAVTYTEHARRKTVTAMGRGYALKRQGRTLYGFGG

SEQ ID NO: 29948 - protein, 170 aa, Vibrio angustum S14
MAGQSIIVMGVCGCGKSTIGEGIAHSLNAKFIDGDDLHPRANIQKMASGTPLNDTDREPWLERIRDAAYSIENKNEVGIIVCSALKKKYRDQIREGNKNVSFIFLDGDRELILERMRARKGHFMRDTMLTSQLETLERPVDEMDVFTVSIDGSINEIIEDAVQQLREANL

SEQ ID NO: 29949 - protein, 163 aa, Methylobacillus flagellatus KT
MISKIKELFASFMLLELVKGMALTGRYFFARKVTVQFPEERTPISPRFRGLHALRRYPNGEERCIACKLCEAVCPAMAITIESEQREDNTRRTTRYDIDLTKCIFCGFCEESCPVDSIVETRIFDYHGEKRGDLIYTKPMLLAVGDKYEEQIAADRAADARYR

SEQ ID NO: 29950 - protein, 376 aa, uncultured archaeon
MEERGISKHELKLFLKEQKQRDLTYRKVLSSMCTYPHEIAVYAHNLFLDSNLGDSGLFPGTKEIEDELIRMIGALLGNENAHGYISAGGTESNIQAIRAIRNRKRKEGLQQMNIIVPKTAHFSFDKIEDLLSLEVKKAGLDDELRVDVNLVEDLIDDNTISIVGIAGTTEFGQIDPIKELADLAHNSDIFLHVDAAFGGFVIPFLDAEYLFDFSLDAVSSISIDPHKMGLSTIPAGCILFRDVSYLADLAVNTPYLTTNEQCSLIGTRSGAPVAATYAVLKYLGRNGLRAIVDECMQLTRMLVHGAKEMGIYPVIEPVMNVVTLRFPDVERVAKALEARGWQVSTTRAPKALRLVIMPHVTEDTIEMFLNDLENAK

SEQ ID NO: 29951 - protein, 302 aa, Spirochaeta aurantia
RIGRNVLRAALGVPGLRIVAVNDLTDSATLAHLLKHDSILGNLSVPVTAGPGVITVDGQDIKVFAERDPGLIPWSSVGVDVVIEATGRFAEKDKAEVHITKGGAKRVIISAPAKGDDLTIVMGVNHQNYDPAKHRVVSNGSCTTNGLAPAALVLHEAFGIEHGLMNTTHAYTNSQVLHDQPEKDLRGARAASLSIVPYSSGAAKAIGKVIPSLDGKLTGYSLRVPVPVVSIVDLTVTVSKDVTVEEVNAAFRKAAESGPLQGILGYSEEPLVSSDYQGDPRSSIVDALSTLVIGKRMVKILA

SEQ ID NO: 29952 - protein, 302 aa, Spirochaeta stenostrepta
RIGRTVLRAALGNPGIEIVAVNDLTDASVLAHLLAHDSIYGALPAKVEAVNGAILVNGKRIAVYAEREPGNIPWAKEGVDLVVESTGRFTERAKAEAHITSGGAKRVIISAPAKGDDLTIVMGVNEGRYDPALHHVVSNGSCTTNALAPLARVLHDTFRIEHGQMMTTHAYTNSQALHDQPEKDLRGARAAAVSIIPYSTGAAKAIGKVIPELDGLLAGFSLRVPVPVVSIVDLTVRVGRDTTAAEVNAAFRAASEAGPLRGILGYSEEPLVSADYRGDDRSSILDALSTLVTGGRMVKVLS

SEQ ID NO: 29953 - protein, 1620 aa, Polaromonas sp. JS666
MKITYLCAEGVLDVEQGAFREIEKGLPANWFGFAGFQLLQRGSTDPRDLDLVIFTTNRIFLVELKNWRDEIEYSNRQWMHKGNFVKSPVDKTRQTAKVLEQCLKAKLSNTYIPFIESLVVLCHPTCRLKNFPDEERRFVMSLPDFVKNLGRADEYRKKFPEKPLTWQYPSANPIPDRNKYERFFSLSNPQILERRTEYQGFLQVSSLADYVHPRIIWSEFRAEHGENRRSKALIRKWNFSNLAGGNSTAAERASIGLRELRLNEMLRTELPELHVDLLEPVGSASPEDVTTNFVEAYRLPAQVERLAELIARKSDMDDDERRSLVKSVLARFAKLHSVGIAHRDITTKTLWVVEPSRIILSSFAAARIPEGRTVGVNRVELESGSIRLPEDDANEGKTAAHSAFARDVFLLGVLSFEILEGTRLENLDNVPLYEEKNALKSPMLNDWFQTSINWDPEKRYQSASEALDALNTALATDVEASVADVDISVYKTDASPMTLLPKEILSSLPDKNVYISEKNGQKVLVKCWPNLRFDVKHPSRNRKLLEFLQTARSLRQSAFNAAPEVVDFGVSPFGLILVTKWAPGEGFNEWFERCSSHKERAEVALSLLNSVRRLHALGITHGDIKGANIAVSLSEDGEVHVVLLDVLDLTADGDSCVTVDDLPPHLEGGSALQRDLYLTVSLTLKLLSDVDFPATFSEASRAKELTEVNIPIDLLAETLQKELHPPKNIHPAFVISVWRTKSEQGRFHELEGDNGSFPVGVQPVPAERRVIFFVTGLREQVIIKYDLQDERVIEISLKEIGHDLYVSNARRSAFRLHAQIGIDFAAVSDASELVELLYSRYRSTRDDNDLEESLPAGVEAKSPYDVLEAHDAGETRISAKALWQALAESDELNATRITVRAGVQKVPHEKYSWLVPYELEEGVLDFSEGEKIELHERGTDPMKGTEAWFRVGLISPDIGKDVLRVLPTSNRLKITEGKTFFVRGSFETSASERRVAAMRRVLGGGASIPKIQEYFDPHLSVQPYQFPMAALNLIDSLGLNDQQRDALLQSFKNGPISLLQGPPGTGKTKFISSFVHLALSRGLAKNILLVSQSHEAVNNALEKVSDLAASNEVGLSMVRVGSATMVSKKLRSVHEDARRQIYREKFDAEIRERIRTVGYQLGLPSAYVNDASDVFMTLGQLLSRIEFLQQADNPNRDADEGMRSAQIRRLKERFCEIASSRFDLEVSTESNLRDAMEGFLSKVAATNGSPSPEKCQKLERLFWLSKEFSDVLRSPHSNFTSFLSRTARVVAGTCVGVGKHMLGIVDHVYDWVIVDEAARASPMELVVAMQAGRRVLLVGDHLQLPPMYPKAVEEKTSQLLGIGRADFRKINNFQRAFSSEYGRSVGRTLLKQYRMASSINRVVSNCFYEGALTVDREAPIAAYEKLPEYLAKEVVWIDTADQGRASFHKELPGGYGALVNEVEANIVVSVVREIAMSKEFVEAIRIKVHQSDSAPIGIITMYAAQRDLIRRKLDQADWAGDIRDLFTVGTVDSYQGKENCIIILSVVRNDTSSVVGFLSEPERINVALSRAQDRLIVVGSTTMWSGRAGTPLKKVLDEVMLMSKDGQAQLVQSRALKGGV

SEQ ID NO: 29954 - protein, 643 aa, Oryza sativa (indica cultivar-group)
MRGAVVAAAAAAVGNMLQGWDNATIAGALLYMRRDLPALQAHPALQGLVVATSLIGATIVTTFSGPLSDSRGRRPMLIASALLYSLAGLLMLWSPNVPILLLARLVDGFAIGLAVTLVPVYISETAPPDTRGLLNTLPQLTGSTGMFLSYCMVFLITLAPIPNWRLMLGVLLLPALLYLLLTIFFLSESPRWLVSKGRMKEARTVLQMLRGRQDVSAEMALLVEGLTTGRDTAIEEYVVGPTDEASGLAPGSMFGSAVTLASRQGSMLDHLKDPVVALLDSLHDMNPPAGGTTDVPNLGSMIGVHDRPPIDWDEENSGDDDGDIAAPLLTMEGEAATSTVGIGGGWQLAWKWTEGVAADGTRQSTVKRMYLHEEQAEGVHAAALVSQSALCTKKEAEAEVEGGWREVLEPGGVRHALVCGVAIQILQQFSGISGVLLYTPQILEQAGVGVLLSRLGLRDDSASILISGVTTLLMLPSIGVAMRLMDVSGRRSLLLWTIPLLVASLAVLVAASVAPMAAAAHAAVCTGSVVVYLCCFVMGFGPIPNILCAEIFPTRVRGLCIAICSLAFWLADIAVTYTLPVMLASLGLAGLFAIYAAVCCVALVFVALRVPETKGLPLEVIIDFFNVGAKGTLPNLHDDDDHY

SEQ ID NO: 29955 - protein, 813 aa, Bacillus clausii KSM-K16
MNKEKVVLIGNGMAGIRTLEEIIKREPSRFQFTVFGAEPHPNYNRILLSSVLQGDASVSDIVLNDYDWYERNQIELFTGDAVVRVDCRKKEVWSASGIKRTYDRLIFATGSDPFMLPLPGAEKEGVIAFRNIADCESMINAAKSYQKAVVIGAGLLGLEAARGLLNLKMDVDVIHIADHLMDRQLDSDAGKMLKAELEQQGMQFHLNKKTVKINGHKRVKGISFSDQTSIKADLVVMAVGIRPNVQLAKQSGLKVNQAIVVNDYMETSEEDVYAVGECAEHRGIVYGLVAPLYEQGKVLAEHICTNTSNEVSGYKGSIVSTKLKVSGVNVFSAGAFRDQDETKSIRIHDEFAGVYKKLVVKNNQVVGAVLFGDTNDANRILSLIRSGEDISAISKAALFPSETNDSSPSVVATMADEETICGCNGVSKGEIVCAIKEQGLSTVAEIRQCTNASRSCGGCKPEVAELLALTTGTDIMAKPEPLCGCTELTHEAVVASIREMGLSYVREVISVLGWKSEEGCSKCRPALNYYLGLISPLDYTDDAHSRFVNERVHANIQKDGTFSVVPRMYGGVTNPEQLRKIADVAEKYNVPLLKVTGGQRIDLLGVEKEKLPNVWRDLGMRSGYAYGKTLRTVKTCVGEDFCRFGTQDSISLGIEIEKKYEGLNTPHKVKMAVSACPRNCAESGIKDVGIVGVEGAWEIYVGGNGGVDLRSAELLCKVETNEEVMETISAFLQYYREQATYLERTSHWIERVGLESIKKVIFDDSIERAALIERMEMALSRHKDPWTEIVESEEKQNQLFEKKKIAVKQGGGM

SEQ ID NO: 29956 - protein, 742 aa, Bacillus clausii KSM-K16
MGSESRQRLVLIGNGMAGVRVVEEVLKLAPRQFAITILSEEDRPSYNRILLSSVLQGKQTLHSIGIHPFQWYVDHGIELRLGEEATRIDPVAQKVYTDKGELAYDKLVIATGSEPFVLPVPGVEKEGVFVFRTIRDCERLTEWSTRYQKAAVIGGGLLGLEAAQGLAHLGVDVSVIHLSDRIMERQLDETAARLLKQSLESKGIHFLLQKQTAEISGEERVTGLLFHDGTTLSADFVVMAAGVQPNIAIAKESNIPTKRGIVVDDRLRTDVSGVYAVGECAEHNGISYGLVAPLYEQAKVLARELCGLPGLYYNGTVLATQLKISGVNVFSAGETTCSGTCTVLKTLNEITGQYKKLLFKEDCLAGAVLFGNTRQSDQLLQLIRANTPLSDDEKTQLLTEDGTAFERELASLPASHLICNCNAVSKGDIMSAMAAGQHTIAQIKAGTKAASSCGGCEVRVAAMLESFKHGQLQATVDIAERKPLCPCTSLTEQQVAQSIAEKRLVVFSDMSEKLGWKNKNGCRVCREVSAYYAGLFFPGGAPKERNGKQENDGSYTITLPHIAGRLSTDQLKQFALMAEELQVPRIDFSARNQVQLKGLTEKQLPYVFEQLDMPPAVLAGKRLQVAIDDSHYNWPEGRHLAERLLDLFNCVPFPAETEVCVTLAARRHELAAIRLSRSPLNWEVAIGSELFCSNDSVEGTFQLVCALLQYFRQSAQYSENIHAWLVRKGAVHVREVVFDAAC

SEQ ID NO: 29957 - protein, 719 aa, Bacillus clausii KSM-K16
MQSGYLQEKRQPPNRKIVYNSQCPFCSVQCKMQLIERKHGQETSYDVVGIENPTSKGRLCVKGLNAHQHAFHPDRLTQPLAKVNGKWLPISWDEALKQIAENVQAIQQEDGHDAMAVYGSASITNEEAYLLGKFARVALKTRHIDYNGRLCMSAAASAATTAFGIDRGLTNSLEDVLFAECLMLVGTNLAECQPTLMPYIEQAKKNGAFLIVVDPRETATAQLADLHIKLKPGTDAALANGLLKCILEGGYEDAAFIQKRVEGFAEVKAHIAKLKLENIAEQTGVSGDVITKAAETFAKARTGMIFTARGVEQQTNGSMAVRNFLNVLIATGKLGKHSCGFAAVTGQSNGQGAREHGQKADQLPGYRSIENEEHRAHIAAIWGISPEQLPRKGVSAFEMMKKADKGEITGMFLMCSNPVVSHPQADFVKNALKKLKFLVAVDLFVSETAQLADLILPSTSYLEDEGTMTNVEGRVTLREASMPPYGEARHDWQIICNIAAVLGKGTDFSYSCAEDIFTELRMASKGGIADYYGITYERLRKEKGIFWPCPSLEHPGTPLLFTDCFYRPNKKALMTVVPNDAPVPKEKPSRDYPLYLTTGRVLAHYLTGVQTRNSASLMARNFESFVEMHPETAKKHGIADRTLIKLTTKQGSMIVRCHFTETIREDTVFVPFHWSGKQNVNRIITGNLDPDCRMPAFKVSAVRAEPLVVHEQMEGVLGT

SEQ ID NO: 29958 - protein, 405 aa, Leuconostoc mesenteroides subsp. mesenteroides ATCC 8293
MAKLTVSDLELSGKKVLMRVDFNVPIKAGVIGNDNRIVAALPTIKYVLENNGRAILFSHLGRIKSEDDKKELSLAPVAARLGELLGKDVKFVPQTRGEELESAINALQDGEVLMVENTRFEDVVDGEVVKNESKNNPELGKYWASLGDDLFINDAFGTAHRAHASNVGIASNVSQAAAGFLMEKEIKFLGDAVANPVRPFVAIIGGAKVSDKIEIVKSLLNKADKVIVGGGMAYTFDAAKGNKIGNSLFEADKVELAKELMAEAGDKLVLPIDSIAADAFSNDAKTEVVDAEDGIPDGYMGLDIGPKSVKLLQDTLSDAKTVVWNGPMGVFEMSNFAKGTLAIGEELVKVTENGGTTIVGGGDSTAAVQQLGVADKLTHISTGGGASLEYLEGKELPGIASISEK

SEQ ID NO: 29959 - protein, 111 aa, Pseudomonas putida KT2440
MDIIETIKEQIANNTILLYMKGSPNAPQCGFSARASQAVMGCGEKFAYVDILQNPEIRANLPKYANWPTFPQLWVAGELVGGSDIMLEMFEKGELQTLIKDAAAKAKASEA

SEQ ID NO: 29960 - protein, 447 aa, Escherichia coli O157:H7 EDL933
MDQTYSLESFLNHVQKRDPNQTEFAQAVREVMTTLWPFLEQNPKYRQMSLLERLVEPERVIQFRVVWVDDRNQVQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKSSRDGRVADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 29961 - protein, 251 aa, Xanthomonas axonopodis pv. citri str. 306
MRRKIVAGNWKLHGSRAFATELVAKVAAHMPLEGVEVVILPPLPYLGDLIEDFEAHHLSFGAQDVSSNEKGAYTGEVSASMLVDVGAGYGLVGHSERRQYHQESSELVARKFAAALHAGLIPVLCVGESLEQREAGQTEAILRAQLDPVLALVGSAGFAGAVLAYEPIWAIGTGRTATPEQAQAVHAFLRGEVAKADARIADSLPILYGGSVKPDNAGELFAQPDVDGGLVGGASLVAEDFLAIARAAAAC

SEQ ID NO: 29962 - protein, 544 aa, Acholeplasma laidlawii
MYEFKFADIGEGIHEGTVLQWNFKVGDKVKEGETLVIVETDKVNAELPSPVDGTIVSLGAKEGEEIHVGQIIVTIDDGTGTPAAAPAPAQVSAPTPAPAAAPQVAAPAASGDIYDFKFADIGEGIHEGTILQWNFKVGDKVKEGETLVVVETDKVNAELPSPVDGTILKLGKAEGEVIHVGETVVLIGQNGATLEQAQAPKAEAPVSEPKKGAGVVGEIEVSDDIIGGSEEVHVVATTGKVLASPVARKLASDLGVDIATIKGSGEQGRVMKDDVQNSKAPAEAQAPVQQTQAPAQAAASVAPSFAAAGKPQGDVEVVKITRLRKAVSNAMTRSKSIIPETVLMDEINVDALVNFRNEAKGLAESKGIKLTYMAFIAKAVLIALKEFPMFNASFNHDTDEVYIKKFINLGMAVDTPDGLIVPNIKNADRLSVFELASQVRSLADDTIARKISMDQQTGGTFTITNFGSAGIAFGTPVINYPELAILGIGKIDRKPWVVGNEIKIAHTLPLSLAVDHRIIDGADGGRFLMRVKELLTNPTLLLLS

SEQ ID NO: 29963 - protein, 558 aa, Desulfitobacterium hafniense Y51
MAFKSDIEIAQESTMLPVAELAEKLNIAEEYVESYGKYKAKIDYNLLKEKGNTPDGKLILVTAINPTPAGEGKTTTTVGLGDALTHLGKKVVIALREPSLGPVFGVKGGAAGGGYAQVVPMEDINLHFTGDLHAIGAANNLIAALLDNHIYQGNALDIDVRRITWKRCMDMNDRQLRYINDGLGGKANGMPREDGFDITVASEIMAILCLSSDLDDLKQRVERIIVGYNRKGEPVTAGQLKAQGAVAALLKDALKPNLVQTLEHTPSFIHGGPFANIAHGCNSVMATKMALKLGDYVVTEAGFGADLGAEKFLDIKCRLSGLEPDAVVIVATVRALKSHGGVAKADLNQENLAALKEGLPNLLKHVENITVNFGLPAVVAINRFPTDTLAEVQLVEEECKKLGVNVALSEVWEKGGAGGVELAEEVLKLMDSPKNFTFAYDIDLGLKEKITAIATKIYGADGVDFIGSSTKDIEGIESIGYRNIPVCMAKTQYSLSDDQKKLGRPTGFRISIRSVKVSAGAGFAVALTGDIMTMPGLPKVPAAESIDVDNTGRISGLF

SEQ ID NO: 29964 - protein, 352 aa, Oryza sativa
  misc_feature (261)..(261): Xaa can be any naturally occurring amino acid
  misc_feature (290)..(290): Xaa can be any naturally occurring amino acid
  unsure (1)..(352): unsure at all Xaa locations
MALAAIYSLFIINKSGGLIYYKDYGSAGRTDTNDSLRLASLWHSMHAISQQLSPTPGCEGIDLLQAHNFDLHCFQSLTGTKFFAVCETGAQNIETLLKVIYELYTDFVLKNPFYEMEMPIRCELFDLNLAQVRLPPPHGLTSQGSPNRFRRGYHHLTRLNGYRKVVAFVSFVNHQAALSAMSALNGTVFDPDTGDRLHIELAKSSSRKRHGDGGVYRVVDKRLKRKERAADHENAGDGGNDDDAWGEDDNGGNDVVVIDDXVLPFVHSSGQPGLKQHRGQSLSDLLLIRXDQPDKLSSDIPPCSTLFVANLGHSCTEEELKEVLSKQPGFHLLKMRRRGGMPVAFADFTLCV

SEQ ID NO: 29965 - protein, 195 aa, Vibrio angustum S14
MNISRRQLFKLCAGAVATTSIASLATIPQKAWAQAREFKLTAAKETRNTCSYCSVGCGTLLYSTGAANGNIKQKVFHVEGDPDHPVSRGALCPKGAGLAGFVNSEQRLKFPEYRAPGSDKWQRISWDEAFTRIAKLMKQDRDENLVKTNEQGTTVNRWLTTGMLCASAESNENGWLTQKFARGLGMVPVDTQARI

SEQ ID NO: 29966 - protein, 404 aa, Glycine max
  misc_feature (305)..(305): Xaa can be any naturally occurring amino acid
  unsure (1)..(404): unsure at all Xaa locations
MASATLSVAKPALQANGKGFSEFSGLRSSSGFLPFSRKSSEDFHSVIAFQTYAVGSSGGYKKGVTEAKLKVAINGFGRIGRNFLRCWHGRKDSPLDVIAINDTGGVKQASHLLKYDSILGTFDADVKPVGSDIISVDGKEIKVVSDRNPANLPWKDLGIDLVIEGTGVFVDREGAGKHIQAGAKKVLITAPGKGDIPTYVVGVNEYDYSPDEPIISNASCTTNCLAPFVKVLDQKFGIIKGTMTTTHSYTGDQRLLDASHRDLRRARAAALNIVPTSTGAAKAVALVLPTLKGKLNGIALRVPTXPNVSVVDLVVQVSKKTFAEEVNAAFRESADNELQGILSVCDEPLVSVDFRCTDVSSTVDSSLTMVMGDDMVKVIAWYDNEWGYSQRVVDLADIVANKWK

SEQ ID NO: 29967 - protein, 792 aa, Vibrio angustum S14
MTNNWVDIKNANVILVMGGNAAEAHPVGFRWAIEAQKTNNAEIIVVDPRFTRTAAVADHYAPIRSGADIAFLLGAIRYLIASSQVNHEYVKAYTNASFIVRDDYAFHDGLFSGYDAEKRQYDRSSWFYKLDDNGYAMKDESLQHPRCVWNLLKEHVSRYTPDVVSNITGTPVDMFEHVCKALGSTAADNRVATILYATGWTQHSKGAENIRCMAMIQLLLGNMGMAGGGVNALRGHSNIQGITDLGLLAQNLPGYLKLPSDKDVDLATHLKHHTPVALEADQTNYWQHYPSFFVSLLKSFYGKNATAENNFGYDMMPKWDQGYDMLRVFDMMKKGEMNGYICQGFNPVGSMSNKQKTLDALSKLKYLVVIDPLATETSTFWQNKPNVNEVDTKNIQTEVFRLPCACFAEEDGTIVSSARWLQWHWKAADMPGEAKGDAEILAGIFMKMRNMYQQHGGTYPDPILSLDWNYAIPDAPNTKELAQELNGKDDNGNQLSSFAQLKADGSTTAGCWLYTGSWTPAGNQTARRDNSDPSGLGLAPNWAWSWPANRRVLYNRASTRPDGTPWDKSRTLVEWNGSKWVGPDVPDFNAKLPPSSNAGPFIMQPEGVGRLFALDKMAEGPFPEHYEPFETPIGTNPLHKNVVSNPAARIFKDDLAQLGQKEQFPFVGTTYRLTEHFHTWTSHSHFNAVLQPEQFVEIGEGLAKERGIKNADMVRVTSKRGFIEAKAYVSKRITPLHVNGQAVHTVGIPIHWGYEGDTKPGYLANALSPCVGDANSQTPEYKAFLVNVEKVK

SEQ ID NO: 29968 - protein, 396 aa, Cystobacter fuscus
MNLANRLKVIKPSPTLALNTKAKELAAQGVDVVSFAAGEPDFDTPDFIKQAAIEALNKGFTKYTACAGIPELREAICAKLQRDNHLTYKPDQVLVSVGAKHSLYNIFQALLNEGDEVIILSPYWVSYPEMVQLAGGKPVIVHTREEDGFAPDPDAIRKALSPRTKALIINSPSNPSGVVFSRDTLAKIADAVRGHECLLVSDDIYEKLLYTGEFANIGNVAPDLLPRLVVVNGMSKAFSMTGWRLGYTAGPKWLIAGMQMVQDQSTSNASSFSQKAAVAALKGPDSIFEPMVKEYRARRDMVVELLNSFDGVRCRTPEGAFYVLPNISGLYGRSYKGTPLQGSIQVSEILLNDFRIAAVPGAPFGVDENIRLSFATSREQLQKGLERFREFTASVR

SEQ ID NO: 29969 - protein, 417 aa, Methylobacillus flagellatus KT
MAEIRNYTMNFGPQHPAAHGVLRLVLELDGEVIQRADPHIGLLHRGTEKLAENRTYLQSVPYMDRLDYVSMMVNEHAYVMAIEKLLGLEVPLRAQYIRVMFDEITRILNHLLWLGAHALDVGAMTVFLYAFREREDLFDCYEAVSGARMHAAYYRPGGVYRDLPDRMPQYEESTVRSKEDVKQLNENRQGSLLDFIEDFTNRFPAYVDEYETLLTDNRIWKQRTVGIGVVSPERAMALGMTGPMLRGSGVAWDLRKKQPYEVYDRLDFDIPIGVNGDCYDRYLVRIEEFRQSNRIIKQCIDWLRKNPGPVISDNTKVAPPPREEMKHDMEALIHHFKLFTEGFHVPAGEAYAAVEHPKGEFGIYLISDGANKPYRLKIRAPGFAHLAALDEMTRGHMIADLVAIIGTQDIVFGEIDR

SEQ ID NO: 29970 - protein, 767 aa, Rickettsia conorii str. Malish 7
MDEMNKINYAEALEYHEKDKPGKIAISATKSLVTQQDLSLAYSPGVAAPCLEIAKNLEDVYKYTARGNLVAVISNGTAVLGLGNLGAAASKPVMEGKAVLFKKFADIDAIDLEVNTEDPEEFINAVKYLSYSFGGINLEDIKAPECFIIEEKLKSLMDIPVFHDDQHGTAIITAAGLINAAYLTNRKLEDLKIVVNGAGAAAIACIDLLIALGADKSKIIVCDTKGVVYKGRLEGMNKWKELYASDTKFRTLAESLNNADVFIGLSVKGAVTKDMVSRMASNPIIFAMANPDPEITPEDIQLVRDDAIIATGRSDYNNQINNVMGFPYIFRGALDIRAKTINTEMKIAAAKAIADLARRPVPEEVYKAYSGRKMVFGKEYIIPVPFDPRLITVVAAAVAVAAIESGVARVKDFSIGKYKKELGSRLNPTANYMNFLAEKIHNAPLKRIVFAEGEEEEVISAALMMRDKKYGHPIIIGRVERIEVMLKKIGQDISLDGIQIMNAALSDSLEKYTDYLYKRLQRKGYLYRDCAKLVKTDKNIFAACMLACGDGDALLTGVTQSYIDSLEDIMKVISPKTNRSILGYSIMIAKDNNIIIADNCITEYPNSWELAQIATQTAEIAKNMGITPRVALLSFSTFGNSSKAKTARIREAVNILDNFSKDKEELSGMKVDFEYDGEMSVKVALDGDLRKLYKFCRLSGSANVLIMPGLNSAAISTELLQEFSSNSFIGPITNGFEKPVQILQAAATANEILKIATFACVEAINEV

SEQ ID NO: 29971 - protein, 1075 aa, Cystobacter fuscus
MPKRNDIRKVLVIGSGPIVIGQASEFDYSGTQAIKALREEGVEVVLLNSNPATVMTDPEFAHRTYIEPITVEVAERILAQERPDSVLPTMGGQTALNLAKALAEQGILDKYGVRLIGASLEAINKAEDRQLFKAAMQKIGVALPRSGYASNMQEALALIDDIGFPTIIRPSFTLGGTGGGIAYNREEFEAICRSGLKASPNSTILVEESVLGWKEYELEVVRDSADNVIIICSIENLDPMGVHTGDSITVAPAQTLTDREYQRLREASLRIIREIGVDTGGSNIQFGVNPADGRIVVIEMNPRVSRSSALASKATGYPIAKVAAKLALGYTLDELRNDITRDTPASFEPTLDYVVVKIPRFNFEKFPHADRTLTTSMRAVGEVMAMGRTFREAYLKAMRSMETGHTGLEAPELPTEKEERRKVLRDYVRVARPERPRYVAQAFREGMSVEEVHELSTIDPWFLRHIQGLVREAQAIQELGKLDALPDEVLRAAKVDGFSDKYLAQLLGCTEAEVRARRHAKGIRPVYKRVDTCAAEFEAYTPYLYSTYEEEDEAPPTARQKVLILGSGPIRIGQGIEFDYCCVHAAFALREAGYETVMVNCNPETVSTDYDTSDRLYFEPLTIEDVLEVSQREKPVGAIVQFGGQTPLRLSVPLEKAGLPILGTSPDAIDRAEDRERFAQLIEKLGLTQPENGVARSHEEAYRVAQRIGYPVMVRPSYVLGGRAMEVVYDQQSLERYMREAVSASPEHPVLIDRFLKEAIEVDLDLVADRTGAVLVGGVLEHVEEAGVHSGDAACTLPPHSLSPDLVERMKDQAMALAKELGVVGLMNVQFAIQGKKIYILEVNPRASRTVPFISKATGMPLAKIASLCMVGKTLAELGATKEPEFKHVAVKESVFPFARFAGVDVILGPEMKSTGEVMGIAADFPSAFAKSQQAAGVKLPRSGKIFISVRNDDKPAVVDLARRLRALGFKLVTTGGTHDYLANKGIETEKVLKVAEGRPHIVDKIVDGQIVLVINTTFGKQEISDSFSIRREALMHSVPYFTTVQAARMAVGAMESLIHTEQTVKPLQDYLGAK

SEQ ID NO: 29972 - protein, 197 aa, Methylobacillus flagellatus KT
MTRLEQLKQHLQDVFGNSITRLQECRNEVTIECQAPCLLEVANLLRDHKLLKFEQLIDLCGVDYADYGEGSWSGLRYATVYHFLSVSLNQRLRLRVFAPDDDFPVLPTVVDIWPVANWFERESFDLFGIMYEGHPDLRRLLTDYGFVGHPFRKDFPMIGNVEMRYDPERQRVVYQPVTIDPRNNVPRVIREEGFHHG

SEQ ID NO: 29973 - protein, 250 aa, Methylobacillus flagellatus KT
MRRKLVVGNWKMNGNLAQNKRLLEALVRGLQDVEHVDIAVCVPYPYLFQAQKILSGTNIAWGAQNVAKHENGAYTGEVSAAMLKEFGASYVIVGHSERSDAYCESNANIAEKFAIAKHYGITPIFCVGETLQERESGVMEYAIANQLDAVLSVSGGALLDQAVIAYEPVWAIGTNRTATPEQARAAHSFIRERIAAMHPGAAESVRIIYGGSVNPRNAAQLLSMPDIDGGLIGRCSLDADDFERICRAAC

SEQ ID NO: 29974 - protein, 223 aa, Triticum aestivum
  misc_feature (200)..(200): Xaa can be any naturally occurring amino acid
  unsure (1)..(223): unsure at all Xaa locations
MSGAALVAIAASIGNLLQGWDNATIAGAVLYIKKEFQLENNPTVEGLIVAMSLIGATIITTFSGPVSDWVGRRPMLILSSLLYFLSGLIMLWSPNVYVLLLARLVDGFGIGLAVTLVPLYISETAPSEIRGRLNTLPQFSGSGGMFLSYCMVFGMSLLPSPDWRIMLGVLSVPSLFFFILTVFYLPESPRWLVSKGRMAXAKKVLQRLRGKEDVSGEMALLVE

SEQ ID NO: 29975 - protein, 356 aa, Prochlorococcus marinus str. NATL2A
MSIILSLETSCDESAAALVSNEKGKIDLLANEIASQIDEHANWGGVVPEIASRRHLENLPFLIEEVFAKSKLQIKDIDAVAATVTPGLAGSLLVGSITARTLANLHQIPFLGIHHLEGHLSSIYLSEKHPKPPFLVLLVSGGHTELIKVDVKHKYQRLGRSHDDAAGEAFDKVARLLGLSYPGGPAIQKIAKSGDPKKFLFPKGRVSKPEGGFYPYDFSFSGLKTAVFRQIEKIRSENKKLPIEDIAASFEYIVAEVLVERSFKCALDQGLNSLVLVGGVAANVRLREMMLAKASENSIDITLAPMEFCTDNAAMIGAAALLRLSSESFKSSMELGVSARWPLEKSDLLYDPIPPF

SEQ ID NO: 29976 - protein, 389 aa, Medicago truncatula
MSSSSHKKRRLRKSSKVDRISDLPDSILCHILYFLPTKLAATTSVLSKRWKLLWLSVLAFDFDSSRFKTSDLFLRVVYSTIYRRDIALPIHSFHLKSRSWDIQKDVNQFVYLVGQRGILNLCLDLSKICRYIIELPTTILSSGTLKVLKLRNLIVGDNSQVDLHLPSLKTLHLNRVDFECHEHLMKILLSCPILEDLETKLCCVMDFQSRFSDEFAAFPNLIKARITEFYIPLSMVCKAKTLHIEVPMFTNCKHLPMFESLTYLKLSLSFKVWYPKWKWLMRMLKLSPKLQNLIIKDNEDLEEKIDECWKDPPNIPECLSSQLKTCRIRVFKGTQYDLQFAIYIMENSKVLETMRINSIRSLDINEKYQLLAKLSSSTRGSTTCKLLFN

SEQ ID NO: 29977 - protein, 342 aa, Aspergillus oryzae
MSLYQNIALNGSFALHGLRHPLDMYSSLGPTLSEATFGLLGYSFEPSRDIGDLSGKVLFVTGGNAGLGKETVLQLAQHNPSRIYLAARDATKAREAISSIQDIISASVDIRHIQLDLSSFQSTRDAAEKFCSECDRLDILILNAGTMANPPELTKEGFEIQFGTNHIGHFLLTKLLLPTLKKTVGSPASDVRIVTLSSVGSHAAPSLDVMTSTSALLDSHTLVRYSASKAANILFASELARRYPEILSVSVHPGVVSSELYRHTGAMNAISKFGVGLLSTVFRSIRTGAMNQLWAAGTKREQLVNGAYYVPIGVRGSSRFTDDADMARKLWEWTENQIAEKS

SEQ ID NO: 29978 - protein, 293 aa, Trichodesmium erythraeum IMS101
MKKINKLAIVGGTHGNEFTGIYLVKKFEEFPELISRRNFDTQTLLANPQGFELVKRYIDTDLNRCFKVEDLENNTSLNYEESRAKFINQMLGPKGNPKFDFILDLHTTTANMGLTIILVNYHPFNLKIATYLSSVEPNLKIYTCFNPEVENTFINSICERGFAIEVGPIAQGILQADLFYKTEKLVQISLDFIEHFNEGKLDHINRDIVIYKHLKVVDYPKTKDGEIVAMIHPQLQGRDYQKLSPGEPMFLTFDNQTIYYQEESPVWPVFINEAAYYEKGIAMCLTKKESIRV

SEQ ID NO: 29979 - protein, 315 aa, Triticum aestivum
  misc_feature (177)..(177): Xaa can be any naturally occurring amino acid
  misc_feature (248)..(249): Xaa can be any naturally occurring amino acid
  misc_feature (275)..(275): Xaa can be any naturally occurring amino acid
  unsure (1)..(315): unsure at all Xaa locations
MTPLHAAPPPLSASAAVSSSAPPALLAKAYHPKAAALCSLTVTAATPSRKAFLACPDHSPAAGRSLTPARGAPASSPALISAVQDLYEFICSGPLVERIGYTQERIAESIDRWLWCGSQVSRLFRIDELRLTDAEKSRIYHFYIPVFLWCEDQVADHRSKYNDGDEIPPLVIGVSAXPQGSGKTTLVFALEYLFRVSGRNSATLSIDDFYLTAAEQGKLRETHAGNALLEFRGNAGNHDLPVPQLTHXXSHLIKLTKGRSEDESFPGYDKSAFGXGRGDRGLPLRTWPEGLKGLPRVLSSFKGMDSFGFKTSFPN

SEQ ID NO: 29980 - protein, 420 aa, Yarrowia lipolytica CLIB122
MTLEETLASAKTAGDKGNLVEAEKLYREILDQKAGTNEKSIQIQESALINLGTLYASNNKPQDLADLIHTSLTVMSGFAKSKTAKIIRNLIDLFAKVPSDCIDLQIATTQKCIEWAVSEKRNFLRQSLQTRLVSLFLEKKTYYDALNLINTLLKELKKLDDKMVLVEVQLLEAKAYHALRNIPKSRASLTSARTSANAVYCPPLTQAALDTMSGILQADDKDYKTAFSYFYEAFEGYVGQENPKAGTVLKYMLLCKIMLNLADDVETILNNKSAQAYQGRDVDVMKAVAVAYANRSLKEFEHVLELYKEEVQADPVIRVHFNDLYDSLLEQNLLKVIEPFSCVEINHIAEIIGLDTRQVEGKLSQMILDKGIKGVLDQGNGWLFIYDEPQTDKTYDSALETVKHMSTVVDLLYEKASSLN

SEQ ID NO: 29981 - protein, 323 aa, Vibrio vulnificus CMCP6
MTLSFDYRAVAKQVLATEIRGLEQLSQYFDEQFEQACELILNNAGKVVVMGMGKSGHIGKKIAASLASTGTSSFFVHPGEASHGDLGMIERGDIVLAISNSGESSEILALFPVLKRLGIRIISMTGKPSSTMAKLADYHLQITVPEEACPLGLAPTTSTTATLVMGDAIAVALLQARGFTAEDFALSHPGGALGRKLLLKLNDIMHTGEQLPRVSPNALVRDALLEISQKGLGMTAIVDHDNLLLGIFTDGDLRRILDKRVDIHSAQIGEVMTKHPTVANPSMLAVEGLNLMQQKKINGLMLCQDGKLVGALNMHDLLKAGVM

SEQ ID NO: 29982 - protein, 192 aa, Brassica napus
PRVRNIDVSFNGEDDEPLEPDDSSKITMLSKFLTGLSTVSHMTISADTLNVIHDYCEMEQLPKFSNLSYLEACFQDTKWEMLPALLESCPNLHSVVLEFDCLTKTEQVDLSLVPQCFKSSLEFVQLKTIDGVDMRKNETPLIGTPSKMKLAKYFLKNGAALKKLTLRESFCTFINQIKSIPRLSKGCEVVMD

SEQ ID NO: 29983 - protein, 588 aa, Ustilago maydis 521
MTRRQKCGPERMVRMGRDPRRGQAATASRKQATATACAESSLTEKGESAVIRLTNVDEALWVRHLVVIGSDGSSDVLISNVTRAGSASSVVDDVDERGQRSGPWIAMDVKCRCPNANAFLRLGRKKVDCLSKYPKNRWQIAVAANRPSHETVTSHESRVHRAAMLNFAKTALRARAVPATSLLRRNAAGSSFRFQSTTVSHDPMTGEPTGLKHLDASALVVTKSNAPRVPPPSQSLVFGANFSDHMLSVPWNSATGWDAPKIHPYAPLQLDPSAVIFHYAPSLFEGMKAYKDVNGKVRLFRPDMNMKRMNTSAARIALPTFEGEQLITLIKKLVALDKSWIPSEPGHSLYIRPALIGTEAALGVHPTKDALLFVICSPVGPYYKTGFKPVALEADPNKVRAWPGGTGQYKLGGNYAPGILPQLEAAERGYQQNLWLFGDQHLLTEVGTMNLFVALKKKDGKGIELVTPPLNGMILPGVTRDSILHIAKDHVNGKYALESLPKDLEVNEREISIHEVIEAEKSGALVEMFGAGTAAVVSPVDRVGYKGKDIHIPAGDGIGPIAKAMLERITDIQLGKVEHEWSVVVDDL

SEQ ID NO: 29984 - protein, 117 aa, Vibrio parahaemolyticus RIMD 2210633
MSNIIKALEEEQMKSGLPKFAPGDTVVVQVKVKEGDRERLQAFEGVVIAIRNRGLHSAFTVRKISNGEGVERTFQTHSPIVDSIEVKRRGAVRRAKLYYLRERSGKSARIKEKLAKK

SEQ ID NO: 29985 - protein, 121 aa, Oryza sativa (japonica cultivar-group)
MNSRRDFRSHRAALFDGIEEGAIRSSAYSSQIHEHENDQAMDSLHDRVSVLKRLTGDIHEEVENHNRMLDRMGNDMDASRGFLSGTVDKFKMVFETKASRRMATMVASFISVFFLIYYLTK

SEQ ID NO: 29986 - protein, 246 aa, Gibberella zeae PH-1
MEKDETGEKKTGPSATTTLVEKYGKCQEVVGRGAFGIVRISHKKIGGSNEKLFAVKEFRRRPEETEKKYSKRLTAEFCISSSLRHPNVIHTLDLLKDAKGDYCEVMEFCAGGDLYTLVLSSGKLEVQEADCFFKQMMRGVEYLHEMGVAHRDLKPENLLLTTRGALKITDFGNGECFRMAWETDAHMVSGLCGSAPYIAPEEYTDKEFDARAVDVWACGVIFMAMRTGRHLWRLAKKDEDELAVAT

SEQ ID NO: 29987 - protein, 340 aa, Oryza sativa (japonica cultivar-group)
MSLQVPNVQELALTCNRPDQQIPDRYIRPEAGTEEVICGQGINTAIPVIDLAKLLNPQSSQEECAKLRSACQHWGFFQLVNHGVPDDVISDVRRDLTEFFKLPLEAKEAYAKPPDKYEGYGQHFVVSEKQKLDWGDLLHLRLRPTESRDLRNSMERYSLETAKVARCLLEFLAMDMGVDPESLLEVFRGQPQNMRVNYYPPCRQTGKVLGLSPHCDATSLTLLLHVNDMQGLQIRKDGKWLTIEALDGAFVVNVGDMLEILSNGRYRSVEHRAVVHPEKERISAAVFHQACRDATVGPLPELVTKDGGRPVYKSMAYEDFMKRFFSAKLDGRANVEGMKI

SEQ ID NO: 29988 - protein, 211 aa, Photorhabdus luminescens subsp. laumondii TTO1
MKKITRIGIGGPVGSGKTAVIEVITPILIQRGIKPLIITNDIVTTEDAKQVKRTLKGILDEEKILGVETGACPHTAVREDPSMNIAAVEEMEARFPDSDVVLIESGGDNLTLTFSPALADFYIYVIDVAEGEKIPRKNGPGLVQADILVINKIDLAPYVGASLAVMEHDTQVVRGQRPYILTNCKTGEGVETLVNMIMRDFLFTHSLQATQ

SEQ ID NO: 29989 - protein, 404 aa, Oryza sativa (japonica cultivar-group)
MLEHIEELEVDDEDSNYNFCSAAADDTANTIKLLSKRYINATSDQDQVKNSHALAETCNDPDQQIPERYIRADANADEVISGDDCTAAIPTVDLSKLLDPLSSDEETEKLGSACQQWGFFQLINHGVSEDVIRDARKDIAEFFRLPMETKKAYSQLPSGIEGYGQAFVVSHEQKLDWADMFYLVLRPGESRNMALWPAHPPSFRNSIDRYSSETARVARCLLEFMAKDMGVRPGSLLERFQDQPQGIRMNDYPPCREAGKVVGLSPHTDAACLTLLLQVNDVPGLQIRSPGGRWLAVGAPPDDGAFIVNVGDILEIMSNGKYRSVEHRAVVRPDRERVSAAVFHQPCQDAVVGPLPELVGEGGGDNARYTSMGYLDFMKRYYSAKLDGRNHLDGLRIKLSSSKG

SEQ ID NO: 29990 - protein, 347 aa, Escherichia coli O157:H7 EDL933
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGTLVEPAAVGMHAAMLADVKPGKKIIILGAGCIGLMTLQACKCLGATEIAVVDVLEKRLAMAEQLGATVVINGAKEDTIARCQQFTEDMGADIVFETAGSAVTVKQAPYLVMRGGKIMIVGTVPGASAINFLKINREVTIQTVFRYANRYPVTIEAISSGRFDVKSMVTHIYDYRDVQQAFEESVNNKRDIIKGVIKISD

SEQ ID NO: 29991 - protein, 588 aa, Lentinula edodes
MDSDDIAPIAILMDELRSEDVQLRLNAIHSIPTIALALGPDRARDELVPFLQDSIDDEDEVLLALAEELGRSFEQYIGGSEYAHLLLAPLENLSSVEETLVRDKAAESITKIAAVLSNAQIEEYCIPLLKRLSGAEWFTSRTSSAALYPAVYDRVPTAIQDDLRKGYAALGSDDTPMVRRAAAKWLGPLLLKFSDPHILSDALPIYRRLESDDQDSVRLLTVEDLIAIAGKLKQSEIKEQLLKQIRHSIGDKSWRVRYMAATHFNELAKAVGKEITREELIGQYVQLLKDNEAEVRTAASSQIPGFSELLEKEVILARIVPCVRDLSQDSSQHVRAALAMQISGLAPLLGRESTIEHLLPLFLQLLKDDFPEVRLNIISKLEIVNNVIGIELLSENLLPAIVELAEDKSWRVRQAIIEYIPPLAKQLGKPFFDEQLGNLCMSWLGDTVYSIREAAIVNLKNLTDVFGVDWSRSAIVPKVMGMGQHPNYLFRMTTVQAITIIMPSLNLDIVRSEIIESLLQLASDPIPNIRFNVAKSLEVLLSAYGNTPEGEAFVQQRILPVLEQQKNDQDADVRYFAARALQKVAVVT

SEQ ID NO: 29992 - protein, 364 aa, Staphylococcus epidermidis RP62A
MITAEKKKKNKFLPNFEKQSIYSLRYDEMQQWLIDHGQQKFRAKQIFEWLYQKRVNTIDEMTNLSKELRQILKDHFAMTTLTTVVKQESKDGTIKFLFELQDGYTIETVLMRHEYGNSVCVTTQVGCRIGCTFCASTLGGLKRNLEAGEIVSQVLTVQKALDETNERVSQIVIMGIGEPFENYDEMMDFLRIVNDDNSLNIGARHITVSTSGIIPRIYDFAEEDIQINFAVSLHGAKDEIRSRLMPINRAYNVDKLMEAIRYYQEKTNRRVTFEYGLFGGVNDQLEHARDLAHLIKDLNCHVNLIPVNHVPERNYVKTPKDDIFKFEKELKRLGINATIRREQGSDIDAACGQLRAKERQVETR

SEQ ID NO: 29993 - protein, 1475 aa, Botryotinia fuckeliana
MEKDREETLSLGTTTNTARASTDDSETQRENVRNANPNGFVSTDRGIDVKNAESEFAQLQRELSGISTKSKALSRTRSRAQAADEKDVEKSAESIAETEGEQFNLENTLRGNRQAEADSGIRPKHIGVVWDGLTVRGTGGVSNFVKTFPDAFVSFFNVVETAMNIFGVGKKGREVKILQDFRGVMKPGEMVLVLGRPGSGCTTFLKVIANQRFGYTGVDGEILYGPFSAEEFSKKYRGEAVYNQEDDVHHPTLTVGQTLGFALDTKTPGKRPHGMSKADFKEKVIDTLLRMFNISHTRNTIVGNAFVRGVSGGERKRVSIAEMMITSGTVCAWDNSTRGLDASTALDYAKSLRVMTNIYKTTTFVSLYQASENIYKQFDKVLVIDDGREVYFGPTSEARAYFEGLGFKEKPRQTTPDYLTGCTDEFEREYATGRSAADSPNSPETLAQAFLNSKFSTHLSEEMAAYKQQVATDKQAHDDFEVAIADSKRKGASKSSVYAVPYHLQIWALMQRQYLIKWQDKFSLVVSWITSITVAIVLGTVWLNLPKTSAGAFTRGGLLFIALLFNAFQAFSELASTMMGRPIVNKHRSYTFHRPSALWIAQIIVDTAFAAAQILLFSIIVYFMCGLVRDAGAFFTFYLIILSGYLAMTLFFRTVGCLCPDFDYAIKFAATIITFFVITSGYLIQYQSEKVWIRWIYWINALGLGFSALMENEFSRLNLTCSGAYLVPYGPGYDNLDHRVCTLAGSVAGSDIVVGGDYITQGYEYKPSELWRNFGIIIVLIAGFLFTNATLGEWVSFGAGGNAAKVYQKPNKEREELNKALAAKRDQRRSAKSDEEGSEININSKAILTWEGLNYDVPTPAGELRLLNNIYGYVRPGELTALMGSSGAGKTTLLDVLASRKNIGVISGDVLVDGVKPGNAFQRGTSYAEQLDVHEGTATVREALRFSADLRQPFHVPQAEKYAYVEEIISLLEMEDMADAIIGDPENGLAVEQRKRVTIGVELAAKPELLLFLDEPTSGLDSQSAFNIVRFLKKLANAGQAILCTIHQPNAALFENFDRLLLLKRGGRCVYFGDIGKDAHVLLDYFHKHGAVCPPDANPAEWMLDAVGAGQTPGIGDRDWADIFAESPELANIKDRISQMKTERLAEVGGTTNDDGREFATPLMHQLRVVQARTNLAFWRSPNYGFTRLFNHVIIAIITGLAYLNLDDSKSSLQYRVFVIFQVTVLPALILAQVEPKYALSRMIYYREASSKMYSQFAFASSLVVAEMPYSILCAVGFFLPLYYMPGFQTSSSRAGYQFFMILITELFSVTLGQMVAALTPSPFISALVNPFIIITFSLFCGVTIPKPQIPKFWRAWLYQLDPFTRLIGGMVVTELQGREVKCTSSELSRFTAPAGQTCGEYMDNFFSSGGIGYIVNNATSACEYCAYKFGEQFYEPLALEYGNRWRDLGIFLAFIGSNLIILFLASRYFNFNRR

SEQ ID NO: 29994 - protein, 884 aa, Methylobacillus flagellatus KT
MALTPDIDPQETQEWLDAISSVLENEGTERAHFLLETLIDKARRSGAYLPYNATTAYVNTIPVHLQAKHPGDAAMERRIRALIRWNAIMTVLRANEKSPGVGGHIASFQSAATLYDTGFNHFFRAANERFGGDLIYFQGHSSPGVYARAFLEGRITEEQLSNFRMESNGNGLSSYPHPWLMPDFWQFPTVSMGLGPIAGIYQARFLKYLHNRGIADTADRKVWVFCGDGEMDEPESMGAISLAAREKLDNLIFVINCNLQRLDGPVRGNGKVIQEFEAAFRGSGWNVIKVLWGSYWDPLLAMDKDGLLKKRMEECVDGEYQNFKAKGGAYTREHFFGKYPELKEMVAAMSDEDIWRLNRGGHDPHKVYAAYHAAVNHKGQPTVVLAKTVKGYGMGDEGEGQNTTHQQKSMSIETLKKFRDRFDLPLTDEQVENLSFYRPADDSPEMQYLQARREAMGGFIPARRRKGNELTVPALSAFENMLGSTGEREISTTMAFVRILSTLVRDKQIGKYVVPIVPDEARTFGMEGMFRQLGIYSSVGQLYEPQDADQVMFYKESKDGQILEEGINEAGSFSSWLAAATSYSVSGVQMIPFYIFYSMFGFQRIGDLAWAAGDSRARGFLLGATAGRTTLNGEGLQHEDGHSHLLSATIPNCISYDPTFAYELAVIIQEGLRRMVQNQEDVYYYITLMNENYTHPALPKGAEEGILKGMYQFSKSKSKGPKVQLLGSGVILREVIAAAELLEKDWGVSADIWSVTSFTELRREGLEVERWNLLNPDKPQKESYVTKLLKKAEGPVIASTDYMKAFADQIRNFIPQRYIALGTDGYGRSDSREALRSFFEVDRYHVVLAALKALADEGKLPATKAAEAVKQYKLDPNKPNPATV

SEQ ID NO: 29995 - protein, 162 aa, Prochlorococcus marinus str. NATL2A
MSVDSKEPSSQEVKIEDESNASEDSEVKTASETKSKGKKISIQNLSPAEIIKTFEDAQLGKDLPDVYVGDTVRVGVRISEGNKERVQPYEGVVIAKRHGGIHQTITVRRIFQGIGVERIFLVHSPQVASIKVERRGKVRRAKLFYLRERVGKATRVKQRFDR

SEQ ID NO: 29996 - protein, 221 aa, Lactobacillus acidophilus NCFM
MLKGLIFDLDGVLTDSARFHLTAWNNLAKELGITLTNEQLDSLRGISRMDSLNLILKYGGQEDKYTEAEKEKFAAEKNAKFVEQVETMTPKDILPGIPELLSDAKKQNLKMVIASASKNAPKILTRLGIMDEFDGIVDPATLHHGKPDPEIYIKAQELVGLKANEVISFEDAQAGVEAIKAAHQFAVGIGNKKLLKEADYIVPTTADLKLSEIEKVFEEKE

SEQ ID NO: 29997 - protein, 588 aa, Methylobacillus flagellatus KT
MSKIIEVLVPDIGNFDSVDVIEVLVKAGDTIAKEDALITLESDKASMDIPSSHAGVVKEVKVKVGDKVAKGSLILLLEEAGTDQASTTADAAPAAKEESKPVPAATPAAPEPATGDSDINTEVVVLGSGPGGYTAAFRAADLGKQVVLIERYSTLGGVCLNVGCIPSKALLHTAKVITEAEETSLHGVSFGKPKIDLEALRAWKANDVVGKLTAGLAQMAKQRGVTVVQGVGKFTSPHQIAVTAADGKVTTVGFQNAIIAAGSQATKFPGAPEDERIMDSTGALALADVPKRLLVIGGGIIGLEMGTVYEALGSKVSVVEFMDGLIPGADRDLIRPLQKRMEKRFERIMLSTKVANIEAKKDGIHVSFEGENAPKEIEVYDRVLVSIGRRPNGKNIGAENAGVAVDDRGFITVDKQMRTNVPHIFAIGDIVGQPMLAHKATHEAKVAAEVIAGHKVEFQAMVIPSVAYTDPEVAWAGVTETEAKAKGLEIEKASFPWAASGRALSIARSEGATKLIFDKETHRVIGAGIVGTNAGELLAEAVLAIEMGADAHDLGLTIHAHPTLSETICFAAEIKEGTITDMLPPKKR

SEQ ID NO: 29998 - protein, 663 aa, Aspergillus oryzae
MCGLTAFLTVGGIPGCVHYANNCPGLEKQLEESLDLVNHRGPDARGRWFSTDHRVGLGHVRLSIVDLSSAGNQPFHDSEGAIHAVVNGELYDHEEHRTELAQEYDFKSNSDCEIVIALYRHYGISFLNKLRGEFALVLYDANRKLFLTARDRYGIKSLYYTMVGNRLLVATEMKSFLPFGWKPEWDVTAIREGAWMNGSQMLFKGVQRYMVSQNFNPPERTVYPHSEEEVIERVRELMLDAVRVRLRADVGLGIYLSGGLDSSAIAGMAVKLVQEGTKLGNDTSGERSKIDCFTVQFEKDSGFDESDIARRTAEWLGVGYHPVYLDEEAIAARLEDTVWYSEIPAANVNGMGRLAVAEAAHAMGKKVILTGEDSDEHFSGYSDLLPNFLLEPDYSWPQSLAKQSDFAEAWKVMEERNQILAMGMDEVAGPTKRMLNNTTLCARLSTFTTLPYSSWTDQLALRSPATAFAENFGVQVLHKMMEKWHPLHSTQYQWMKSVLANYILRYIGDNVDMVHQIETRPPFLDHYVTEYANNIPPSLKIKYDPESKTFREKNILREAMKPFVTEEIYNRTKHPFVGPFTYQEDGPVHKSLKRLLTEENVNQLGFFDNDRVQSNLVKAFRDKDGVCFQRALAVAQYVVLGQRFGVKKAQDPGCSETSSGPYV

SEQ ID NO: 29999 - protein, 1070 aa, Methanosarcina acetivorans C2A
MPKREDIKKVLLIGSGPITIGQAAEFDFSGSQACRSLKEEGVQVVLVNSNPATIMTDPEMADSVYIEPLDARIVEKIIEKERPDGIIAGIGGQTGLNITSELAEMGVFEKYGVQILGTPVEAIKNTEDRELFKETMLRIGEKVPQSRAVHTLKEAEEVVEELGLPLIVRPAYTLGGAGGGIARTKEELLEITERGLRRSRISQVLIEESVLGWAEVEYEVMRDANDTCIVICNMENIDPMGVHTGESAVVAPSQTLTDAEHQMLRSASIKIIRALKIEGGCNIQYALKEGDYRIVEVNPRVSRSSALASKATGYPIARVTAKIAIGMALDEIINSVTKNTPASFEPALDYVITKIPRWPFDKFVTADKTLTTAMKSTGEIMAIGRTMEESLLKAFKSLDIDSQLGNKRWDEHEVKTLLKTPTSERLFVIFHALERGMSVKEIAELTSINPFFISKIKKIVEMEKRIRTEELTSELLREVKKLGFPDTRLAELTGKTREQISDLRHDAGILATFKMVDTCAAEFQAATPYYYSTYEDTCETNPTDRKKILILGAGPIRIGQGIEFDYCTVHAVTALREEGIETHIINNNPETVSTDFDTSDKLFFEPLTMEYVMNVIERERPDGVLVQFGGQTSVNLALPLKKELKRRTDLDTMIMGTDPEDMDLAEDREKFYVLMQKFGILQPEGGYATSQHEAIEVAQRIGFPVLVRPSYVLGGRAMEIVYDEIDLERYMKEAVRVSPEHPILIDDFLEGACEIDVDAVCDRKDVLIGAIMEHIEEAGVHSGDSACVIPPQSLSEDVLAQVRDYTRKIALGLRVKGLINIQMAEKGGKVFVLEANPRSSRTIPFVSKAVGLPLAKIAARVIAGHSLKEMGYTDEPKPKHVSIKEVLLPFDKLPGADPVLGPEMKSTGEVMGIDYDFGRAYYKAELAADNLLPLTGKVFLSIRNADKPELVEVARKLQAAGLELMGTRGTVNYLAQHGVFMDTVKKVHDGSPNVIDMMRRDEVDLIINTPTSKQSRRDGSRIRRAAVDFKVPYITTIQAASAAAAAIETMKKGEDLTIKSINEYHKEMGL

SEQ ID NO: 30000 - protein, 472 aa, Escherichia coli CFT073
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASINNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRKVN

SEQ ID NO: 30001 - protein, 959 aa, Candidatus Protochlamydia amoebophila UWE25
MNIQKAKSNPGHSIVNTDTHSYSQSNNPLKFFERISLLCKTIFQCFLNLFFNCITRDQLQSQWREVFWGQKEIIISNFTTTHSAKSEMPLLSSSQTPFLTESQNRESSDYPEDESNLIINSLDIPTNLNTSNKPFLEEINATTIHSSDFLSLPQEFKLSFQDETSLTIPNSQLTLLKEKSPYFKSLWSGNFQETLREPLTLTQKEFTHLLDCLLIVDFKVSIEDILTFIQLADYYQLAEVVKNLEQQLIDTYKSEKCELFNSTADSLIELKALLNFAQQYQLNNLKNYLELTVVSSLLNQASHLTEFEKILKCFSNEIERLNFSKNASLTDAHLLALKDCKKLKVLYLQECNNLTDVGLAYLRPLITLQGLNLNSCKKFTDAGLAHLDSLIDLTQLGLAKCHNITDNGLAYLRPLIALQGLNLNGCKKLTDAGLVHLKSLVTLTYLNLSQCDDLTDAGLAHLTPLVALQHLDLSFCCYNITDAGLAHLTPLVALQNLDLSFCYKLTDDGLAHLKPLVALKQLNLWACSNLTGAGLAHLTPLIALKHLDLGFCYGLTDDGLAHLKPLVALQYLSLSGCKKLTDAGLAHLTSLITLQQLNISSCANLTDDGLAHLKPLIALQQLNLSSCKKLTGVGLAHLTSLVNLTHLSLSECGNLTDAGLAHLAPLVALQQLDLNFCYNLTDAGLAHLITLVALQQLYLSACGNLTDAGLAHLTPLVALQQLNLSGCKKLTGVGLAHLTSLATLTHLSLSACANLTDDGLAHLTTLVALTYLNLSDCNNFTGAGLTHLKPLVALQYLSLSGCKKLTDAGLAYLKPLVALQQLNLRGCKKITDAGLTHLMSLVALQCLSLSGCKKLTDDGLAHLKPLVALTHLSLGECVKLTDDGLAHLTPLLALTHLNLSDCNNLTVAGLAHLTPLENLTYVDLNNCNNFTDVTLTYLTSLLTVQHFNRTWEECYFKLN

SEQ ID NO: 30002 - protein, 413 aa, Yarrowia lipolytica CLIB122
MEDLDFDIASNSTQDILNRKRLLENEIKIMKSEFQRLSHERNTMNEKIKDNADKIENNKVLPYLVGNVVELLDMEGEVAEEGANVDVEASRVGKSAVIKTSTRQTVFLPLVGLVDPETLKPGDLIGVNKDSFLILDTLPAEYDSRVKAMEVDEKPKETYADIGGLDKQVEELVEAVVLPLKQAEKFKQLGIKPPKGALMYGPPGTGKTLLARACAAQSNATFLKLAAPQLVQMFIGDGAKLVRDAFALAKEKAPTIIFIDELDAIGTKRFDSDKSGDREVQRTMLELLNQLDGFGSDDRVKVLAATNRVDVLDPALLRSGRLDRKIEFPLPSESARADILQIHSRKMTCDDSINWMELARSTDEFNGAQLKAVTVEAGMIALRSGKNKITHEDFVEAITEVQARKSKSVSFYA

SEQ ID NO: 30003 - protein, 939 aa, Arabidopsis thaliana
  misc_feature (497)..(497): Xaa can be any naturally occurring amino acid
  misc_feature (506)..(506): Xaa can be any naturally occurring amino acid
  unsure (1)..(939): unsure at all Xaa locations
MSFDELLRFVSEVQGERHAGLDYVQDIFHSVKHHNVFHHHGLVHLNAFYRYLFSDTNSPLPMSGQVHHDMKAPLSHYFVYTGHNSYLTGNQVNSRSSVEPIVQALRKGVKVIELDLWPNPSGNAAEVRHGRTLTSHEDLQKCLTAIKDNAFHVSDYPVIITLEDHLPPKLQAQVAKMLTKTYRGMLFRRVSESFKHFPSPEELKGKILISTKPPKEYLESKTVHTTRTPTVKETSWNRVANKILEEYKDMESEAVGYRDLIAIHAANCKDPSKDCLSDDPEKPIRVSMDEQWLDTMVRTRGTDLVRFTQRNLVRIYPKGTRVDSSNYDPHVGWTHGAQMVAFNMQGHGKQLWIMQGMFRGNGGCGYVKKPRILLDEHTLFDPCKRFPIKTTLKVKIYTGEGWDLDFHHTHFDQYSPPDFFVKIGIAGVPRDTVSYRTETAVDQWFPIWGNDEFLFQLSVPELALLWFKVQDYDNDTQNDFAGQTCLPLPELKSGVRXPSGFTIEQXQGLQEHEASRQLRLGSSLYVSDHQRTMEEEGSPDIIIVGAGISGLSTAVGLHRLGIRSMVLESSETLRATGFAFTTWFNAWKAMEALGVSQHIRSLHDRLEGWVVGTISAGTPPTEMLFPESEEYESRCVQRKLLLEALAGELPEETIRFSSKVVHIELSGCYKKVHLSDGTILKTKVLVGCDGVYSVVGKWLGFKNPATTARLAIRGLTHFPEGHGFGKRFFQFYGDGVRSGFIPCDHNTVYWFLTHTSTDIDEETNSEILKEFVLNKIKDLPENIKNVVETTDLDSMVMSQLKYRPPWELLWSNITKDNVCVAGDALHPMTPDIGQGGCSAMEDGVILARCLGEAIKAKSLKGETEENEEEGYKRIEEGLKKYAGERKWRSIDLITTAYTVGFIQQSRGKWMNMFRDRFLSSYLSRMLLKKSHFDCGSLVP

SEQ ID NO: 30004 - protein, 490 aa, Kineococcus radiotolerans SRS30216
MSTTPGRSAAPGGGVHDALPPLTDGPHRRRLGVVALIATFGGLLFGYDTSVINGALEPMVRELGLTTLTEGVVTSSLLFGAAVGAISGGRLSDAWGRRRSILLMSLFFFGGALVCVFTPNFEVMVVGRVVLGLAVGAASTVVPVYLAEMAPYEIRGSLSGRNEMMIVVGQLAAFVVNAIVGNVWGEHAGVWRIMLAFVTLPAVALFVGMLRVPESPRWLIDHGHYDEALAVLRTLRSEERAEAEARQIAGLTHEDSKRVPMDWRSVLSHRWLRRILLIGTGLGVAQQLTGINSIMYYGQSILGEAGFSSSAALIANVAPGVIAVVGAFIALRIMDTFSRRRTFVLGYSLTTACHLLIGIGSVLLPVGNPLRPWVILFLVVAFVGSMQTFLNVATWVTLSEIFPQRMRAFGMGTSVFVLWITNALLGLWFPTLVSALGITGCFFGFAVVNLLALVFVKTQVPETRGRSLEQLEEAVTSGAIHDRAVRDGLA

SEQ ID NO: 30005 - protein, 325 aa, Kineococcus radiotolerans SRS30216
MSTTAALDVVTMGRVGVDLYPLQDDVGLEDVETFGKYLGGSATNVAVAAARHGRATAVVTRTGNDAFGRFVHRALAGFGVSDRFVSGVEGLNTPLAFCEIYPPDHFPLLFYRQPTAPDLQIRAEELDLDAIRDAGVFWTTVTGLSEEPSRGAHHAAWAARARKPLTVLDLDYRPMFWASPQEATEQVRRALPHVTVAVGNREECEVAVGETEPRRAAEALLAAGVEVAIVKQGPKGVLGATRNPDGGTAFVEVPPTPVAVVNGLGAGDGFGGALCHGLLAGWDLERTLRFANAAGAIVATRRECSTAMPFTSEVEALLEEVAARA

SEQ ID NO: 30006 - protein, 331 aa, Escherichia coli O157:H7 EDL933
MTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 30007 - protein, 301 aa, Escherichia coli O157:H7 EDL933
MKLKDCVMIKKIFALPVIEQISPVLSRRKLDELDLIVVDHPQVKASFALQGAHLLSWKPAGEEEVLWLSNNTPFKNGVAIRGGVPVCWPWFGPAAQQGLPAHGFARNLPWTLKSHREDANGVALTFELTQSEETKKFWLHDFTLLAHFRVDKNCEIDLEAHGEFETTSALHTYFNVGDIAKVSVSGLGDRFIDKVNDAKEDVLTDGIQTFPDRTDRVYLNPQDCSVINDEALNRIIAVGHQHHLNVVGWNPGPALSVSMGDMPDDGYKTFVCVETAYASEMQKVTKEKPAHLAQSIRVAKR

SEQ ID NO: 30008 - protein, 502 aa, Nostoc punctiforme PCC 73102
MHGEGVPSLLSGFATCPGLFYATPAADGILSRIRIPGGIISSQQCRAIADIADQHGGGYVDVTNRANLQVREIRTGINSEVLQHLQDMGLGSRNSVVDHIRNIMTSPTAGIDAQELIDTRPFVQDWDNYIAAHPALSGLSAKFSVCFDGGGIIRVCDRLNDILFAAVLVDGNVYFRLYLSVGTKGQPPSDTGILLTPEQCLPVLAALTEVYLAHSNTTNNRRLRLLELLNTLGCENYLQEVQQRLPFSLLCSNLTPQPPSLVGKGEKFSPLLQGEGLGERLDAKYQHIGIHPQRQQGLFYIGVVLPLGRLESNQMKGLADLAAKYGSGTLRLTPWQNLLLTDIPQQWVGDVQSKIAFLGLDISATNIKSALIACSGNKGCASSATDTKSHALALVEYLETRVTLDCPVNIHFSGCEKSCAQHSKSDITLLGVSIEDGNGTVEGYHVYVGDSEHKFGRKIIYQYVTFAELPALIKRMLDVYKIQRLNSDESFGEFANRYTEKL

SEQ ID NO: 30009 - protein, 327 aa, Nostoc punctiforme PCC 73102
MTSQVNQRDLEIDSSPLLAVLQELHSQYKLLQEGAVAKYIPELAKVNPDLFSICIVTVDGQIYKVGNYDQLFTIQSISKVFAYGLALEDHGLDYVLTRVGVEPTGDAFNAIVLDEQSKRPYNPMVNAGAIATTSLIKGSGPTERLNRMLDMYKRYIGRDVFVDISVFTSERSTGHRNRAMAHLMLNFGMIDRNIEESLDLYFQQCAVIVNCEDLAVMAATLANKGMNPITKEQAVDKRYIKDILSVMYTCGMYNFAGEWAYKIGIPAKSGVCGGIIAVVPNKMGIGVFSPLLDVRGNSVRGVKVCEELSQRLGLHLFDCSGQEAKFD

SEQ ID NO: 30010 - protein, 377 aa, Oryza sativa (indica cultivar-group)
MAAATVSVRFHPAASAARCGGGSRRSRRLSGVIRAQSAPASAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGTPIKDALAAGKEISALEGVLEHGLFLDMATFGDHALEQMASVSKTNVCLLSKDYLRVASCRLARFVGQETARQPAFPRLARNVFGCVLLLVTLFTSKFVKQRM

SEQ ID NO: 30011 - protein, 267 aa, Prochlorococcus marinus str. NATL2A
MTTPFRNVTPNGPGGTTTLLLVLSFTGFLLLTQAFFVVPAGQVSVVTTLGKVSGGSRKPGLNFKVPFVQNTYPFNVQTQVRPEKFDSLTKDLQVISATATVKYALKPNEAGRVFKTISYNDREIYNRIIQPSLLKALKSVFSKYELVTIASSWSDISELVEDTVAEELNKFDYVDVQSLDLTGLTIADEYRAAIEQKQIAEQQLLRAQTEVKIAEQEALRYDTLNKSLDDQVLFKLFLDKWNGETQVVPSLPGNGSGNVPVIVRGKN

SEQ ID NO: 30012 - protein, 386 aa, Pseudomonas syringae pv. tomato str. DC3000
MCHLQINMNVIATEHSYQPHGSNGIRWMIRSCLNTAPRLESTHKPLLRGPAMTDLSNRQFLLAKRPSGAVRRDDFTYQQVPVTSLADGQILVRNKFLSLDPAMRGWMNDGKSYIPAVQLGEVMRALGVGEVLESKNPKFAAGDHVQGALGTQDYFAGEPKGFYKVDTSLAPLPLYLSALGMTGMTAYLALLDVGQPKSGDTVLISGAAGAVGSIAGQIAKLKGCRVVGIAGGKDKCSLLTSELGFDAAIDYKSEDVMDAIKRHCPDGVNVYFDNVGGDILDAALSQLAVGARVVICGAISQYNNTTAIKGPANYMSLLVNRARMEGFIVLDHADRFAEAGQVMAGWIKEGKLKSKEHIVEGLETFPETFQMLFNGENQGKLILKVE

SEQ ID NO: 30013 - protein, 432 aa, Prochlorococcus marinus str. NATL2A
MTDALNTKRSEEIFGAAKNLMPGGVSSPVRAFKSVEGDPIVFDRVKGPYAWDVDGNRYIDYVGSWGPAICGHAHPEVIAALQETLEKGTSFGAPCVLENQLAEMVIDAVPSVEMVRFVNSGTEACMAVLRLMRAFTGRDKVIKFEGCYHGHADMFLVKAGSGVATLGLPDSPGVPRSTTANTLTAPYNDLEAVKELFAENPDAISGVILEPVVGNAGFITPEPGFLEGLREVTQENGALLVFDEVMTGFRISYGGAQERFGVTPDLTTMGKVIGGGLPVGAYGGRKEIMSMVSPSGPMYQAGTLSGNPLAMTAGIKTLELLKQEGTYEKLEAITKKLLDGILTAAKESNIPIYGQSISAMFGFYLCEGPVRNFEEAKSSDTELFSKIHRLMLQKGVYLAPSAFEAGFTSLAHSEDDINATIKAFKEIFSEMS

SEQ ID NO: 30014 - protein, 463 aa, Salmonella typhimurium LT2
MLTILKTGQSAHKVPPEKVQATYGRYRIQALLSVFLGYLAYYIVRNNFTLSTPYLKEQLDLSATQIGLLSSCMLIAYGISKGVMSSLADKASPKVFMACGLVLCAIVNVGLGFSSAFWIFAALVVFNGLFQGMGVGPSFITIANWFPRRERGRVGAFWNISHNVGGGIVAPIVGAAFAILGSEHWQSASYIVPACVAVIFALIVLVLGKGSPRKEGLPSLEQMMPEEKVVLKTKNTAKAPENMSAWQIFCTYVLRNKNAWYISLVDVFVYMVRFGMISWLPIYLLTVKHFSKEQMSVAFLFFEWAAIPSTLLAGWLSDKLFKGRRMPLAMICMALIFVCLIGYWKSESLLMVTIFAAIVGCLIYVPQFLASVQTMEIVPSFAVGSAVGLRGFMSYIFGASLGTSLFGVMVDKLGWYGGFYLLMGGIVCCILFCYLSHRGALELERQRQNALHNQDSLQLADAQ

SEQ ID NO: 30015 - protein, 412 aa, Salmonella typhimurium LT2
MADFRPERRFTRIDRLPPYVFNITAELKMAARRRGEDIIDFSMGNPDGATPPHIVEKLCTVAQRPDTHGYSTSRGIPRLRRAISHWYQERYDVDIDPETEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEQYAAMGSLEFAKKLLNEAKVCVSPGIGFGDYGDTHVRFALIENRDRIRQAVRGIKAMFRADGVLPSHPKPVEASTE

SEQ ID NO: 30016 - protein, 321 aa, Salmonella typhimurium LT2
MTKYALVGDVGGTNARLALCDIASGEISQAKTYSGLDYPSLEAVVRVYLDEHSVSVEDGCIAIACPITGDWVAMTNHTWAFSIAEMKKNLGFSHLEIINDFTAVSMAIPMLKKEHLIQFGGGEPVDGKPIAVYGAGTGLGVAHLVHVDKRWISLPGEGGHVDFAPNSEEEAMILEILRAEIGHVSAERVLSGPGLVNLYRAIVKSDNRLPENLRPKDITERALADSCIDCRRALSLFCVIMGRFGGDLALTMGTFGGVYIAGGIVPRFLEFFKASGFRGGFEDKGRFKDYVHGIPVYLIVHDNPGLLGSGAHLRQTLGHIL

SEQ ID NO: 30017 - protein, 202 aa, Synechococcus elongatus PCC 6301
MRTPTMRLVVRSLVSLAAIASLASGLPARAQSGSSVPAPERVTTQSNLNYDSVMRIMAEGDAAVAAQKFPVALDKYDLARKSFGALVQFHQGLAGSFSGIDVKIANDQRQRAAQAAQGRDQAGYKLALLYRRLNQPEVAIPLLVQVVQSQNPTTDLGKQAYAQLYELGFTSLPYPRSVDGTQPAPQQSPAPQTPPAQQPPAR

SEQ ID NO: 30018 - protein, 104 aa, Zea mays
  misc_feature (77)..(77): Xaa can be any naturally occurring amino acid
  unsure (1)..(104): unsure at all Xaa locations
MSGRGKGGKGLGKGGAKRHRKVLRDNIQGITKPAIRRLARRGGVKRISGLIYEETRGVLKIFLENVIRDAVTYTEHXARRKTVTAMDVVYALKRQGRTLYGFGG

SEQ ID NO: 30019 - protein, 122 aa, Desulfitobacterium hafniense DCB-2
MKEIRTAKAPGAIGPYSQGFISGDLVYTSGQIPVDPTSGDVAAGIAGQAEQSCKNVGAILEAADSDFSKVIKTTCFLTDMNDFAAFNEVYARYFVSKPARSCVAVRALPKGVLCEIEAIAEL

SEQ ID NO: 30020 - protein, 338 aa, Vibrio vulnificus CMCP6
MSGMRTLGEFIVEKQADFPHASGDLSSLLSSIRLAAKIVNREINKAGLVDITGAAGVENIQGEVQQKLDVYANEKFKSALEARDQVCGVASEEEDEAVAFNKELNKNAKYVVLMDPLDGSSNIDVNVSVGTIFSIYRRVSPIGTPPTQEDFLQPGHKQVAAGYIIYGSSTMLVYTTGNGVNGFTYDPSLGTFCLSHENMMIPQNGNIYSINEGNYIRFPMGVKKYIKYCQENVPEDGRPYTSRYIGSLVADFHRNLLKGGIYLYPSTQSHPQGKLRLLYECNPMAFLIEQAGGLASDGVNRILDLKPTELHQRVPFFVGSTNMVKKVEEFLEVYRDEA

SEQ ID NO: 30021 - protein, 376 aa, Oryza sativa (japonica cultivar-group)
MAASEQRVVAVIMVGGPTKGTRFRPLSLNVPKPLFPLAGQPMIPNLAQIYLVGFYEEREFALYVSSISNELRVPVRYLREDKPHGSAGGLYSFRDYIMEDSPSHIVLLNCDVCSSFPLPDMLEAHKKYGGMGTLLVNKVSAESANQFGELVADPETNELLHYTEKPETFVSDLINCGVYIFTPNIFNAIEDVLKQKKDRANLRRVSSFEALHSATKALPADYVRLDQDILSPLAGKKELYTYQTLDFWEQIKTPGMSLRCSGLYLSQFRHTSPHLLASGDGKRSATIIGDVYIHPSAKIGPNVSISANARIGAGARLIHCIILDDVEIMGEGDHNAKLGITILGEAVDVEDEVVVVNSIVLPNKTLNVSVQEEIIL

SEQ ID NO: 30022 - protein, 370 aa, Pseudomonas aeruginosa PAO1
MIKSRAAVAFAPNKPLEIVEVDVAPPQKGEVLVRIVATGVCHTDAYTLSGQDSEGVFPCILGHEGGGIVEAVGEGVTSLQVGDHVIPLYTAECGKCKFCLSGKTNLCQAVRATQGKGLMPDGTSRFSYKGEPVFHYMGCSTFSEYTVLPEISLAKIPKDAPLEKVCLLGCGVTTGIGAVLNTAKVEEGATVAIFGLGGIGLAAIIGAKMAKAARIIAVDINPGKFDIARELGATDFINPKDYDKPIQDVIVELTDGGVDYSFECVGNVQLMRAALECCHKGWGESVIIGVAGAGQEISTRPFQLVTGRVWRGSAFGGVRGRSELPSYVEKAQKGEIPLDTFITHTMGLEDINEAFELMHEGKSIRTVIHY

SEQ ID NO: 30023 - protein, 444 aa, Kluyveromyces lactis NRRL Y-1140
MMQMQQRVALGDVTSQINNRANRFSVDGDSKKAFVDAGFLKEKRVKNAKENDLFSGHDDDLVVARAQKLREQTLVSSVSTESIRSQQLSSNSNETVQHHLIEVEADDEDDAETDSEALAFKEDEEAETGGDISEEMEDVDESFTPLVPVVTEHSERLYQYVYERLHREEPDPNDEDTWDPVMVSEYTIEIFEHLKFLERKFSPNPRYIEHQPELTWKYRSTLIDWIVQVHDRFQLLPETLFLTVNIIDRFLSKKQVTLNRLQLVGAAALFIASKYEEINCPTLKDMLYMLDNAYTREEILRAERFMINTLNFEFGWPGPMSFLRRVSKADDYEYDTRTVAKYLLETSIMEPEIIAAPPSWLAAGAYYLSKIIIGLTGWSDEHIYYSGYTEEQLIPLATMILDSCRHATERHKAIFDKYSRSRHRKSAFVVAKWISMAESRLEQK

SEQ ID NO: 30024 - protein, 536 aa, Vitis vinifera
MPAGGFAAPSAGGDFEAKITPIVIISCIMAATGGLMFGYDVGVSGGVTSMDPFLKKFFPVVYRKQHEELESNYCKYDNQGLQLFTSSLYLAGLTSTFFASYTTRSFGRKATMLIAGIFFIVGVVLNTAAQDLAMLIIGRILLGCGVGFANQAVPLFLSEIAPTRIRGGLNILFQLNVTIGILFANLVNYGTAKIKGGWGWRVSLGLAGIPAVLLTVGSLLVVDTPNSLIERGRLEEGKAVLRKIRGTDKIEPEYQELLEASRVAKLVKHPFRNLMQRRNRPQLIIAVALQIFQQFTGINAIMFYAPVLFDTLGFGSDASLYSAVITGAVNVLSTLVSVYSVDKVGRRLLLLEAGVQMFFSQVVIAIILGIKVKDHSNNLHTGYAVLVVVLVCTFVAGFAWSWGPLGWLIPSETFPLETRSAGQSVTVCVNLLFTFVIAQSFLSMLCHLKYGIFLFFSGWVFIMSFFVLFLLPETKNIPIEEMTERVWKKHWLWKRFMDDHVEGFPVFGYNDEETVVNGSDKKRDGYGNGFDPSSQL

SEQ ID NO: 30025 - protein, 221 aa, Lactococcus lactis
MFKAVLFDLDGVITDTAEYHFRAWKALAEEIGINGVDRQFNEQLKGVSREDSLQKILDLADKKVSAEEFKELAKRKNDNYVKMIQDVSPADVYPGILQLLKDLRSNKIKIALASASKNGPFLLERMNLTGYFDAIADPAEVAASKPAPDIFIAAAHAVGVAPSESIGLEDSQAGIQAIKDSGALPIGVGRPEDLGDDIVIVPDTSHYTLEFLKEVWLQKQK

SEQ ID NO: 30026 - protein, 451 aa, Glycine max
MERYKLIKEVGDGTLGSVWRAINKQSGEVVAIKKMKKKYYSWEECVNLREVKSLRKMNHANIVKLKEVIRECDTLCLVFEYMEYNLYQLMKNREKLFSENEVRNWCFQVFQGLAYMHQRGYFHRDLKPENLLVTKDVIKIADFGLAREISSLPPYTEYVSTRWYRAPEVLLQSHLYSSKVDMWAMGAIMAELFTLRPLFPGSSEADEIYKICSVLGSPTTESWADGLKLARDINYQFPQLAGVHLSTLIPSRSDDAISLVTSLCSWDPCKRPTAAEVLQHPFFQSCFYIPPSLRTRAVTRTPPSAGTRGSLDRLGLKRYSGALPNTKITNNFTSPKVQASIASGVQRKLDMANEDGIKSKKSLKTTQQSKYRLPGKGSPTSINKGRTARGVSETAEKLVNMSIGTRRLSLGQTRPPPMKAGVNWISESGNFMLRSGQQIPSERSLTRKVAG

SEQ ID NO: 30027 - protein, 543 aa, Coprinopsis cinerea okayama7#130
MHRARAVLSLRPAAVKRAALVQARQLHRHSECQAQRNGHHGTSVIQPSSTSRAMSTTSERHEHITDLGELYEFGLRHVTHGLGRITTGIMTKGDGSYVEYADGRRLLDFTCGIGVTNLGHAHPRISGAAADQCMKLVHSQCSISLHEPYLRLIERLLPVMPHPSLDSFFFWNSGSEAVEAAIKMARTLTGRQNIICMQGAYHGRTMGAMAVTKSKTIYSQGVHPVMPGVYSIPYPYWHQVGVPVETPTHDLATLALTQLDLVLAQQSAPSDTAAIIIEPVLGEGGYVPAPVEFLQGLREVCDKHGILLIIDEVQSGFGRTGTYFAIEESGVRPDILVMAKGLGNGFPISGVVSRKELTDKLKPGSMGGTYAGNAVACAAAVAVQDVIQEECVLENVQARSRELFSVLRGLLYDPSIRPHILDIRGRGLMVGVEFASPTGIGVGAQFAVDNFPTTSTVNTLTLGPSPYILHDSEKKGENGGAETHPRAMASRVAKKCIEKGMLILTTSVFEVIRFIPPLNISKEDLAKGCQIFAEAVKEVVEEG

SEQ ID NO: 30028 - protein, 385 aa, Oryza sativa (japonica cultivar-group)
MSSTSRAPRGIREETLLRVPGASVHLLDGAEGPVELARGDLAVVRIAKDGVAVATVARVGRGLGWPITRDEPVVRLDRLHYLFTLPDSTGGGGGGGGGALFLNYGVSFAAPDDALLASLDAFLKANACFSTPSSPAPSRSSATTTTRPAPTTTATADGYWNDFAPRMDSYNNVLAKAIAAGTGQLVRGIFMCSEAYATQVRASDRSLTFNLFSVQSVDFDSASRAGSTRSRPDSSSSYRQRDQTIRRRRVRKLSEMTEKMSQSLLDTVIAVTGSMAAPLLRSKQGKAFLATVPGEVILASLDAINKVMDAVEAAERRSLAATSNVVSGAVSRRYGESAGEATEDAFATAGHAVGTAWNLFKIRKAVTPSSSLPGNMVKSAVRNRK

SEQ ID NO: 30029 - protein, 413 aa, Salmonella typhimurium LT2
MTDNRVENSSGRAARKLRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELFFSQPDMAQLGKGMVIPALPNPEAVFLAAGVLGATIMPHVIYLHSSLTQHLHGGTRQQRYSATKWDVAIAMTIAGFVNLAMMATAAAAFHFSGHTGIADLDQAYLTLEPLLSHAAATVFGLSLVAAGLSSTVVGTLAGQVVMQGFVRFHIPLWVRRTITMLPSFIVILMGLDPTRILVMSQVLLSFGIALALVPLLIFTSNATLMGELVNTRRVKQVGWIIVVLVVALNIWLLVGTVMGLS

SEQ ID NO: 30030 - protein, 489 aa, Glycine max
MSQNPRLRSLQTEANCTIDKENAFISSNLSQDKKFSISQKFRKVNEILLKPTAKQYGQEAYHSQTMNPQAGNVQNKYNLEQDFESKMNISRVKKTLSFERNSMNVQRASDLLAAQKERQNYMEKENRLSIIEQRERYSFGEKQIINESKKGLTLNAARAPYAEKEPIRLNPILEPVAREDKYHEEVIPEITEREIEKIPAPTVDINEQCNNSLKDYISDIIRTLKIKDKESTPIYSLKKHKIPVNLRSKMVDWMIEVLSSYKCSDQTFFIAVNLMDLFLEKTNVQHEVSDLHLTGVTCMFMASKYEEIYPLRLSVIHEKIAHRKIHPDQIKKKEMEIFMTLGYKMTNSTPYEFIMNVLYQLNVKETMAPRLYNYLRKVCVYLAKANMHDYELLSQQDYSELAASTLFVAFKIIEQLDKSFPLFEMLNKVRQILKVEEDIVYDCASRILSIAKNFDKLYPNLENLKKFHSFNFEDLPESKDSKVCQKTIF

SEQ ID NO: 30031 - protein, 172 aa, Synechococcus elongatus PCC 6301
MPEELTPTPETAVVEAGPVSRWLSENGFENTALERDHLGVEIVQVDREVLLPIAAALFAYGFNYLQCQGGYDLGPGQDLVSFYHLTKVSDDASQPQEVRVKVFLPRHDPKVPPVFWIWKGADWQERETFDMYGIQFEGHPNLKRILMPEDWVGWPLRKDYISPDFYELQDAY

SEQ ID NO: 30032 - protein, 429 aa, Pseudomonas aeruginosa PAO1
MAKIVDIKGREVLDSRGNPTVEADVILDNGIVGSACAPSGASTGSREALELRDGDKSRYLGKGVLKAVANINGPIRDLLLGKDAADQKALDHAMIELDGTENKAKLGANAILAVSLAAAKAAAQAKGVPLYAHIADLNGTPGQYSMPVPMMNIINGGEHADNNVDIQEFMVQPVGAKNFAEALRMGAEIFHHLKAVLKARGLNTAVGDEGGFAPNLSSNEDALAAIAEAVEKAGYKLGDDVTLALDCASSEFFKDGKYDLEGEGKVFDAAGFADYLAGLTQRYPIISIEDGMDESDWAGWKGLTDKIGAKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAPYRGRAEFRG

SEQ ID NO: 30033 - protein, 433 aa, Vibrio parahaemolyticus RIMD 2210633
MSKIVKVLGREIIDSRGNPTVEAEVHLEGGFVGMAAAPSGASTGSREALELRDGDKARFLGKGVLKAIEAVNGPIAEALVGKDAKDQAAIDAVMIELDGTENKSKFGANAILAVSLANAKAAAAAKGMPLYEHIAELNGTAGQFSMPLPMMNIINGGEHADNNVDIQEFMIQPVGAATLKEAVRMGAEVFHNLAKVLKSKGYNTAVGDEGGFAPNLKSNAEALEVIAEAVAAAGYELGKDVTLAMDCAASEFFDKEAGIYNMKGEGKTFTSEEFNHYLAGLVEQFPIVSIEDGLDESDWDGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 30034 - protein, 94 aa, Glycine max
SCHGLPARLSAEYVNMQDPEMDMKSVTDRAARTLLWTELFRGLGMTLSYLFREPTTINYPFEKGPLSPGFRGEHALRRYPSGEERCIACKLCEA

SEQ ID NO: 30035 - protein, 704 aa, Prochlorococcus marinus str. MIT 9303
MPNAFCLAADTAVSKMHLGTPWPLGSTITTRGVNFSVAAPTAKRVELLLFADANATQPEHILELQPCHRSGDYWHVEVEGLRTGCCYGYRIFGPHNTGSDSFHPSKVLLDPCTRAITGWDIYQREQAKGSSPNIQACLKGVVCEREHFDFASHPRPRTPWNRSVIYELHVGGFSSGPKSEVTPQRQGTFLGLIDKLPYLRQLGITAIELLPIFAFDPSDAPTGRDNYWGYSPLNWFTPHPKYVHGDDPLQARQQVRELVAACHDEGIEVILDVVYNHTTEGSLDGPTLSWRGFSDALYYHQNDSGEYLDVSGCGNSIAANRPIVRQLILESMRCWAIELGVDGFRFDLGIALSRGEGLKPLEHPPLFEEIEADPELSDLKLFSEPWDCGGLYRLSDFPAQRIGTWNGHYRDDLRAFWKGDEDSAWRMGQRLSGSADLYKGEPAPLGRSLNFITAHDGFTLNDLVSFNRKHNLANGESNRDGENHNNSWNNGIEGPCSDHAVQALRHRQMRNLIATLLLSRGVPMLLMGDEVGRSQGGNNNSWCQDNPLGWMLWNPEQCDMDLHLFVSRLLMIRQQLSELFCPINPPPEEMPVSLQQSPDDLWLQWHGVEIDKPDWGSWSHTICYSLNRGSSGAVMWMGFNAYSKAMHFDLPKPTSAWHLLLDTACPSPDDLPARPNAWTSVDIDLQNRSMLILMAEEYASKLKL

SEQ ID NO: 30036 - protein, 456 aa, Xanthomonas axonopodis pv. citri str. 306
MSARYDYDVVILGGGSGGLAAGFRAAKHGARVAIMEPDELGGTCVNLGCVPKKAMWLAADLAGKIELASALGFDVPRPTLVWQELVTHRQGYIANIHASYRRRLNEDGVVLIPQRGVLQDRHTVMGSDGVPVTAGHIVIATGAHALRPDVEGAEHGEVSDDFFNLCHAPEQVAIIGGGYIAVEIAGLLQALGSRVHLFVQGERLLERFDAELTLQLADNLRHLGVRLHFGFTTTALERDMHGALRVHGHSVHPREQGNDVFDKVFFAVGRRANTAGLGLDTVGVALGDKGEVVVDDRQTTNVPNIHAIGDVGGKVGLTPVAIAAGRKLMDRLFGHQPDARMDYENVPSVVFSHPPLGNVGLTEEQARARYNGAVRVYRSNFRPMLHALADAPQRSLFKLVCVGEEERVVGVHLLGESADEMLQGFAVAVKMGATKRDFDETVAIHPTSSEEIVLMH

SEQ ID NO: 30037 - protein, 42 aa, Brassica napus
GAEKVEVEHGNHSLSNRVHEAVQAIMSFVKREGPSGWDDPWS

SEQ ID NO: 30038 - protein, 1472 aa, Oryza sativa (japonica cultivar-group)
MADPQHVQEEAAGAEAVHAHAARHDGAVVMEILSRSLQSMPASPDVSAYFSGASSRRPSAADEVDDEEALRWYGDREVDVRTLELAQRQAFVERVFHVAEEDNERFLKKLRARIDRAGIQMPTVEVRFRNVNVQAECHVGTRALPTLANVSRDVGESLLGLVGLNFAKRKALHILKDVSGIVRPSRMTLLLGPPSSGKTTLLLALAGKLDPTLETSGEVTYNGYGLDEFVPQKTAAYISQHDVHAGEMTVKETLDFSAKCQGVGQRYELLKELAKKERQLGIYPDPEVDLFMKATSVEGSTLQTDYILRILGLDMCADVIVGDELRRGISGGQKKRLTTAEMLVGPTKVLFMDEISTGLDSSTTFQIIRCIQQIVHMGEATVLVSLLQPAPEIFELFDDVMLLSEGQIVYQGPREHVLEFFERCGFRCPERKGVADFLQEVTSKKDQEQYWIQSEKPYRYVSVPEFVAKFKKFHMGKSLKKQLSVPFNKGKIHKSALVFSKQSVSTLELLKTSCSKEWLLMKRNSFVYIFKTVQGILVALIASTVFLRTQLNTRDEDDGQIYIGALIFVMITNMFSGFADLSLTLARLPVFYKHRDFLFYRPWTFALPNVLVRIPSSLFESIIWVAITYYTMGFAPEASRFFKHLLVVFMLQQMAAGLFRVTAGLCRTVVVTNTAGSLAVLIMFVLGGFILPKDAIPKWWVWAYWCSPLTYAYIAFSSNEMHSPRWMDKFVPDGKRLGVAVLENSGVFTNKEWYWIATGALLGFTILFNVLFSLSLMYLNPVGKPQSILPEETDSQENIQEGKNKAHIKQIITVETPEPVSPNSIITLDKVIQQLRGYSANTSDRSHSYINAAGRTAPGRGMVLPFEPLYMSFNEINYYVDMPLEMKSQGVTADKLQLLSGISGAFRPGVLTALMGVSGAGKTTLMDVLSGRKTGGYIEGEIYISGYPKNQATFARISGYCEQNDIHSPQITVRESLLFSAFLRLPKEVNDQEKKIFVDEVMELVELTGLKDAIVGLPGVNGLSTEQRKRLTIAVELVANPSIIFMDEPTSGLDARAAAIVMRTVRNTVNTGRTVVCTIHQPSIDIFEAFDELLLLKRGGQVIYSGPLGTNSHKVVEYFEAIPGVPKIEENRNPATWMLDVSSAASEVRLEIDFAEYYRSSTMHQRTKALVKELSNPPPGSDDLYFPSQYSQSTFNQFKLCLWKQWWTYWRSPDYNLVRIFFALFTALMLGTIFWRVGHKMESSKDLLVIIGSMYAAVLFVGFENSVTVQPVVAVERTVFYRERAAGMYSAIPYALAQVVVEIPYVFVETVIYTLIVYPMMSFQWTPAKFFWFFYVSFFTFLYFTYYGMMNVSVSPNLQVASILGAAFYTLFNLFSGFFIPRPKIPKWWVWYYWLCPVAWTVYGLIVSQYGDVEDFITVPGQSDQQVRPFIKDYFGYDPDFMGVVAAVLAGFTVFFAFTYAYSIRTLNFQQR

SEQ ID NO: 30039 - protein, 279 aa, Triticum aestivum
  misc_feature (170)..(170): Xaa can be any naturally occurring amino acid
  misc_feature (186)..(186): Xaa can be any naturally occurring amino acid
  unsure (1)..(279): unsure at all Xaa locations
MHIVPELELFHLCRNKIKILDAGALEPLLGYLQSSDLNLQEYAAAAILTLSASSTNKPIISVSGAIPLLVKVLEEGNPQAKNDAVMALYNLSTIADNLQTILSVQPIPPLLELLRAGKRSSKTADKCCALLESLLAFDQGRVALTSEEGGVLTIVEVLEEGSLQGREHVXSVLTMCESDRSKYRDXILNEGAIPGLLELTAHGTPKSRVKAHALLDLLRNSPYSRPKLQPNTLENIVSNIASQIDGEDRGGKAKKMLAEMVKVSMEQSLRHLQRRASFA

SEQ ID NO: 30040 - protein, 386 aa, Escherichia coli CFT073
MTNNPLIPQSKLPQLGTTIFTRMSALAQQHQAINLSQGFPDFDGPRYLQERLAYHVAQGANQYAPMTGVQALREAIAQKTERLYGYQPDVDSNITVTAGATEALYAAITALVRNGDEVICFDPSYDSYAPAIALSGGIVKRIALQPPHFRVDWQEFAALLSERTRLVILNTPHNPSATVWQQTDFAALWQAIAGHEIFVISDEVYEHINFSQQGHASVLAHPQLRERAVAVSSFGKTYHMTGWKVGYCVAPAPISAEIRKVHQYLTFSVNTPAQLALADMLRAEPEHYLALPDFYRQKRDILVNALNESRLEILPCEGTYFLLVDYSAVSTLDDVEFCQWLTREHGVAAIPLSVFCADPFPHKLIRLCFAKKESTLLAAAERLRQL

SEQ ID NO: 30041 - protein, 468 aa, Oryza sativa (japonica cultivar-group)
MAASPTGSSSSAPAAAAAAAAEATDGPTLSVVSKRLRALRKKHNRILQMEESLAGGRKLNKEQEGVLRSKPAVVALIDELERMRAPLAAALAEELSSRPAPSSSAAPPPPASSSAAGAADSSVVEDLLALIYFGTLFDLKPQTEFVATMVARAQERDCCITYDYVTEDAADLLHQSDLDKVSALAALAASRPAAAVGVSHRDALQSCAQHARLWLRRADEPIHPESSITCTHAAVRAKLDKIMASDYYTAQPEMPEMGAAVDLSAAVQESMVVSPEAPAVEESQAEGHKDEKEASEATEIYNDNQPNVADAQNVEDEAPVNPSEEFSAAEVEQEKFEADVEEQERNADQQFTSRRPYQNQRGGGGRGGGRRGYQNGGRGGRGGRGMGGGGYQNGRGGGGGGGYQNGRGGGEGGGYYYNEPGYYQQRGYSNRGRGGRSGGGNSYYNNQGGGSQGGGHAHPGRVELGANA

SEQ ID NO: 30042 - protein, 262 aa, Oryza sativa (japonica cultivar-group)
MAASPTGSSSSAPAAAAAAAAEATDGPTLSVVSKRLRALRKKHNRILQMEESLAGGRKLNKEQEGAREFVVFEDFSRSFYFGTLFDFKPQTEFVATMVARAQERDCCITYDYVTEDAADLLHQSDLDKVSALAALAALGPAAAVGVSHRDALQSCAQHARLWLRRADEPIHPESSITYAAVRAKLDKIMASDYYTAQPEMPEMGAAVDLSAAVQESMVVSPEAPAVEESQAEGHKEQNKYGLSSTRIRLQDIKYLNGSLYEQ

SEQ ID NO: 30043 - protein, 286 aa, Pseudomonas syringae pv. tomato str. DC3000
MSDYQETLYEGYGQRFRMEKMLHEVRTEHQHLVIFQNPRMGRVMALDGVIQTTEADEFIYHEMLTHVPILAHGAAKRVLIIGGGDGGMLREVAKHLTVEHITMVEIDATVVEMCKEFLPNHSSGAFDDSRLNLVIDDGMRFVATTEEKFDVIISDSTDPIGPGEVLFSENFYQACHRCLNEGGILVTQNGTPFMQLSGVQTTAGRMNGLFADWHFYQAAIPTYIGGAMTFAWGATDKSYRKLPLETLRQRFSGSGIVTRYYNPEVHIGAFALPQYVLHAVNKASND

SEQ ID NO: 30044 - protein, 449 aa, Lactobacillus acidophilus NCFM
MNENTKLKRGLKSRHVTMIAIGGAIGTGLFLGSGSAIHSAGPSIILSYLIVGIITFFMMRALGELILADPDSHSFLESIKKYLGKRAEFVAGWTYWACWLSLAMADLTATGIYLRYWFPWLPQWVGPLVIVVLLMLINMVNVGLFGELESWFSMIKVIAIIALIVVGAVMIIFHTPVKGGTVSLTNLVSYGGFFPTGVWGFLLSFQMVVFAFVGVEIVGQTASETANPHQDIPKAINTLPVRIGLFYVGSMMAIMSVYPWNQIKTTSSPFVQVFTGIGVTAAAGILNFVVLTAALSATNSAIFSTSRSLYSLARNGHAPKKLGNLTKKAIPMNALITSSLILFVVVILNYVMPAEIFAVVSTVSTICFVIVWIMIMFTHIVYRRHNKNNLGEFRMPGYPLTSWLTIVFYIAILILLFFIESTKLALIISIVFVLILTVSYNFVSKNTNN

SEQ ID NO: 30045 - protein, 599 aa, Aspergillus oryzae
MTLGYLSMHLSFVSLFFSMRRLGSKFWLAGTVLLTGAFAFLFGLLVTTKLGVPINVLLLSEGLPFLVVTIGFEKPIILTRAVLNASADNKRRGGAGPSSQSSPTTAKSIQDSIQTAIREQGFEIVRDYYSSKRSAEECEVFLKEKRAPYLSDEDLIELCLRGKIPGYALEKTMENEDLMSRVDAFTRAVKIRRAVVSRTKATSAVTSSLEASKLPYKDYNYTLVHGACCENVIGYLPLPLGVAGPLTIDGQSYFIPMATTEGVLVASASRGAKAINAGGGAVTVLTGDGMTRGPCVGFPTLARAAAAKVWIDSEEGQSIMKAAFNSTSRFARLQTMKTALAGTYLYIRFKTTTGDAMGMNMISKGVEKALHVMSTECGFDDMATITISGNFCTDKKSAALNWIDGRGKSVVAEAIIPGDVVKSVLKSNVDALVELNTSKNLIGSAMAGSLGGFNAHASNIVTAIFLATGQDPAQNVESSSCITTMRNLNGDLQISVSMPSIEVGTIGGGTILEGQSAMLDLLGVRGSHPTNPGDNARQLARIVAAATLAGELSLCSALAAGHLVRAHMAHNRSSAPTRSSTPVSAAVGAARGLTMTSSK

SEQ ID NO: 30046 - protein, 287 aa, Agrobacterium tumefaciens str. C58
MEDTRHPTPPYPEQQQEPPGKTAEMKPIPDHGEQSYVGDGKLKGRVALITGADSGIGKAVAIAFAREGADIVISYLNEDDDARDTAKWVKEAGQGALLVPGDIKSEEHCKNLVHRAVNELGAVDILVNNAAFQRTYDDIADITAEEWDETFRTNIYAPFFLSKAAAPHMKPGSSIINTTSIQSRQPSPQLLAYASTKGAISNFTAGLAEMLAEKGIRVNAVAPGPIWTPLIPSTMPAEKAAKFGENTLIGRAGQPAELAGAYVLLASDLGSYMTGAVIPVTGGEIMI

SEQ ID NO: 30047 - protein, 504 aa, Kluyveromyces lactis NRRL Y-1140
MITRTQNGSMLLNRINHEPSNDSAEGSCNSLFKPKTLKRKNLKHLTLESSCSSSSSSPDEIPKGFSNGNGPTLSLMLEKLPVREEISPISRDTSFQTVSFLQGSSSTSDISSIVSGTTPTTRDAPMSLTPTGVSMMQQETDETATLTTQIARLSLTPENGIQLENLVRLSKIGAGNSGTVVKTLHVPDSRIIAKKTIPVENKEVLKNQLVRELTIMKNVSAHDNIVGFYGAFYNPSTTNEIVILMEYMDCGSLDKILSVYRSDCHRKNVSISCKTSWFNEMPLSRISFCVLNGLIYLYDCYKIIHRDIKPSNILINSKGDVKICDFGVSTTLINSLADTFVGTSTYMSPERIQGGRYTTKGDVWSLGLMIIELSSGEFPLGGHHDTPEGILDLLQRIVNEPAPKLSKNEHYSIEMTDFVNRCCIKEERGRSSLKELICHDFICKYNNRDTIAKEFRHWCKKVKKRIKEDKMIRREETERSKIEKRQLEKAALAVTAARSSSTRR

SEQ ID NO: 30048 - protein, 418 aa, Oryza sativa (japonica cultivar-group)
MHLSPAIYRCMQWRSWMPATPAGGSGGGANDGGGDGEDKKKSGEVAEAVISVPVHCDGCARKLRRSVQRLDGVEEVTVDCRTNTVIVRGPKAAVDPAGIVEVLDRRTGKKALLLSSLPSANLKPPLSPEKRSSETAKKDAAEQDMGKEMSEEDMEMVVVMRIDLHCEACCEEIKRRILKIKGVEEVTPHMKSSQVMVRGKVEPATLVGLIHKWTGRRAAIFRAEPQHPLPPPSESPPKVDDDNEPPKVAGSTEPAEEEETKQGGDPSPSDDAQEKKEGEEADQMKDQKEEPEEKEKKEEPDEKNEGGEADDLKPLTEDDASYNGVAEESHSTKDHLFRVALPRSVVAVAPPESEKMAMNSLCYSYYYYPAYPYPCHQYYQYPQQNIYAAGNYPAMYGYYPHHVPEDFSDANPNVCTVM

SEQ ID NO: 30049 - protein, 458 aa, Glycine max
MVRENAVMGGASEERGVRVTRAMARAVLGGVSASSRPSFKKQHKNNKGFGRVALADVTNISKKGCATSKSQARGGYKKTNTKGASNVSIQVLSTQEDVRAKLAKDLPSISMVQSHDANVAERQEGTEVVQPSMSVMAGPLLSMQDSMKSDEILRSPNKDVDMMITEKLKLSDGLDIVDIDSVELKDPQVWSSYAPDIYNSIFVREFERRPSSDYMDMLQQDITPSMRGILIDWLVEVSEEYKLLPDTLYLTVNLIDRSLSQSLVQKQRLQLLGVTCMLIASKYEEICAPRVEEFCFITDNTYTKAEVLKMESEVLNLLHFQLSVPTTKTFLRRFILASQSSYKVSYVELEFLANYLAELTLVEYSFLQFLPSLIAASAVLLARWTLNQSEHPWNSTMEHYTNYKVSELKTTVLALADLQHDMKGCSLNSIREKYKQQKFRSVANLSPKPVQSLFKAQV

SEQ ID NO: 30050 - protein, 524 aa, Arabidopsis thaliana
MDSFSYSSMKSMLIQARGSLNSRLSEFEPLVLLLVPLVSLFLAQIIGSVFGVVHEKGLKACLIGFIMGLLKMIPGVQNYIDAEKQKVVDQLQSGSSSKKKNKTEVLPVKGLGVEVLEKMENEKRNDAIWQGKCSGTVFAHTNPLHIDVFQSVVRFESEVVAMTAALLGSKETASGGQICGNMTSGGTESIVLAVKSSRDYMKYKKGITRPEMIIPESGHSAYDKAAQYFKIKLWRVPVDKDFRADVKATRRHINRNTIMIVGSAPGFPHGIIDPIEELGQLALSYGICFHVDLCLGGFVLPFARKLGYQIPPFDFSVQGVTSISVDVHKYGLAPKGTSTVLYRNHEIRKHQFVAVTEWSGGLYVSPTIAGSRPGSLVAGAWAAMMSLGEEGYLQNTSKIMEASKRLEEGVREIHELFVIGKPDMTIVAFGSKALDIFEVNDIMSSKGWHLNALQRPNSIHICITLQHVPVVDDFLRDLREAVETVKANPGPITGGLAPIYGAAGKMPDRGMVNELLVSFMDSQY

SEQ ID NO: 30051 - protein, 101 aa, Brassica napus
  misc_feature (6)..(6): Xaa can be any naturally occurring amino acid
  misc_feature (11)..(11): Xaa can be any naturally occurring amino acid
  misc_feature (21)..(21): Xaa can be any naturally occurring amino acid
  misc_feature (51)..(51): Xaa can be any naturally occurring amino acid
  misc_feature (58)..(58): Xaa can be any naturally occurring amino acid
  misc_feature (62)..(62): Xaa can be any naturally occurring amino acid
  misc_feature (75)..(75): Xaa can be any naturally occurring amino acid
  misc_feature (88)..(89): Xaa can be any naturally occurring amino acid
  misc_feature (92)..(92): Xaa can be any naturally occurring amino acid
  misc_feature (94)..(94): Xaa can be any naturally occurring amino acid
  misc_feature (96)..(96): Xaa can be any naturally occurring amino acid
  misc_feature (98)..(99): Xaa can be any naturally occurring amino acid
  unsure (1)..(101): unsure at all Xaa locations
EKEEVXAYSMXSSATVVTSPXQATMVVPFTGLKSSSAFPVTRKANNDITSXVSNGGRXNCMXAWPPIGKKKFETXSYLPDLTEAELPXXVDXLXRXKXXPC

SEQ ID NO: 30052 - protein, 476 aa, Cryptococcus neoformans var. neoformans B-3501A
MPSFEPAVSSHIAPLPSASKPLPLTTSTEGLQALADKHITKGLGRLRDHVFKEGKGLRVLTTENQKLLDFTSGIGVTSLGHAHPDVTAAIISQAQSIIHVQCAIGLSEPYVQLVESLLTMMPDPSLDSFFFWNSGSEAIEAAIKVSRTKTKRNNIVVMQGGYHGRTSGAAALTRSKTSFFRGTGPLMPCVYTTPFPYWHAMGLPKDTPEEVLTEQAILGIENLLQQQTAPEDTAAIFLEPVIGEGGYIPAPTAYVKHLRKLCDKYGIMLVIDEIQTGFGRTGKTFAIEHTGVTPDIMVYAKGFANGMPISGIVTRKEIMDVMAPGSLGGTYSGNVVACAAALATTRYMRTHDILGNVQARSEQLFKGLREIQEDEANGGWMIEEVRGKGLMIAIEFKDPNSKLTSSHNRGDISLPGNLNKLVQDACYDRGLLVLTTSIYPVLRLIPALVLSEEEVDEALKIIKESVKEVASVIEGN

SEQ ID NO: 30053 - protein, 481 aa, Arabidopsis thaliana
MASAAASSAFSLLKSTGAVASSAGTRARASLLPIPSTSVSARPLGFSATLDSRRFSLHVASKVESVRGKGSRGVVSMAKKSVGDLTSADLKGKKVFVRADLNVPLDDNQTITDDTRIRAAIPTIKYLIENGAKVILSTHLGRPKGVTPKFSLAPLVPRLSELLGIEVTKADDCIGPEVESLVASLPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 30054 - protein, 359 aa, Cryptococcus neoformans var. neoformans B-3501A
MPSNSRQHNIAVIPGDGIGIEVTASTLKVLRAVQKKVGGFELSFDELDYGSARYKAQGSYTPAGWLDHLRKSDAIFFGAVGDPDVPDHISLWELILPMRQTFQQYVNIRPSSILPGIPSRIVGTKPGDLDWIIVRENTEGEYAGQGGRTHVGTEWEVATELAVFTRKGVERVMRFAFETAQSRPKKLLTVVSKSNAQRYGLLLWDEVAEIVSKDFPDVKWDKMLVDAMTVRMVAKPTSLDTIVTTNLHGDILSDLAAGLSGSIGIAHSASLDPTRTSPSLFEPVHGAAFDIMGKDLANPIAAIMSAAEMLRWLGENEAADLVEKACKQSIADGQTTGDLGGKLKTSQVTEAVCKILETL

SEQ ID NO: 30055 - protein, 503 aa, Coprinopsis cinerea okayama7#130
MSQVETLPAVNPIDFSLSASQVCQRNEESNLNWPAASSPLINDVSASQCLRMPNNSYNGESHDSSGDVIFPSLPPLHQGHPDIHMRNGVMASFAAAADHEPDAEKAFFVADLSQVYRQHQRWITCLPEIQPFYAVKCNPDPYVIRLLAALGAGFDCASLNEISSVLNVGGIDPSRIIFANPCKAVSFIRNASRMGVDTMTFDNADELYKVARSHPKAKLVVRILTDDSKSLCAFGIKFGAPLNVVPSLLAKAKELNLDVVGVSFHVGSGCYDPSVYTDAIMRSRTVFDMAKEAGYDFTLLDIGGGFEDALFEKAATVLREAIDRYFPDRKHIKMIAEPGRFYVSTAFKLAAHIIARRAPLEKDAAPATSGTAEEPDQPKVMYYINDGVYGAFNCILFDHQVIHPYVLSMGGSFHVAESEPKHVSSVWGPTCDSIDCVSPKTVLPVNLQVGDWLGFNNMGAYTVCAASQFNGFAVSNVIYTAGVAHANEVRMALKAFAAEGHGL

SEQ ID NO: 30056 - protein, 358 aa, Oryza sativa
MSAYCGKYKDELIKNAAYIGTPGKGILAADESTGTIGKRFASINVENVEDNRRAFRELLFCTPGALQYISGVILFDETLYQKTKDGKPFVDILKEAGALPGIKVDKGTIEVAGTDKETTTQGHDDLGKQCAKYYEAGARFAKWRAVLKIGPNQPSQLAIDLNAQGLACYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 30057 - protein, 575 aa, Salmonella typhimurium LT2
MISGILASPGIAFGKALLLKEDEIVIDRKKISADKVDQEVERFLSGRAKASAQLEAIKTKAGETFGEEKEAIFEGHIMLLEDEELEQEIIALIKDKHMTADAAAHEVIEGQATALEELDDEYLKERAADVRDIGKRLLRNILGLAIIDLSAIQEEVILVAADLTPSETAQLNLQKVLGFITDAGGRTSHTSIMARSLELPAIVGTGSVTAQVKNGDYLILDAVNNQVYVNPTNDVIEQLRAVQEQVATEKAELAKLKDLPAITLDGHQVEVCANIGTVRDVEGAERNGAEGVGLYRTEFLFMDRDALPTEEEQFAAYKAVAEACGSQAVIVRTMDIGGDKELPYMNFPKEENPFLGWRAVRIAMDRKEILRDQVRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 30058 - protein, 241 aa, Coprinopsis cinerea okayama7#130
MATQNLYDVQSPEHFQQLLSADLNRVSVLNFWAPFADPCKQMNEIFKELAGKYPAALFLQIQAEDQADITDSFEIEAVPTFLLLRGHTLLKRISGADAPTLTQSVQKHATSPAYSPLSKTDQQPAKATDSSAPAQPEETQEQLEERCKKLMNQSKVVLFMKGDPQTPRCGFSRKIVALLQEQNVQFTTFDILTDEAVRQGLKTINNWPTYPQLIINGELVGGLDIVKEMVETGELAEVLAA

SEQ ID NO: 30059 - protein, 85 aa, Glycine max
SPPSSVPVCLLHMLLGGVFLDVFDAEQASILEDARARSKKALQRVPADIRTQCGVARMNDPQLIMDIKRSVTIHVMVQARIGHFV

SEQ ID NO: 30060 - protein, 332 aa, Prochlorococcus marinus str. NATL2A
MESLLSQLSSMTVVVADTGDLEAIKKYHPRDATTNPSLILAAAQMPAYQSLIDQALTTSREMLGTSAAKADVVKEALDELCVVFGKEILKLIPGRVSTEVDARLSFDTDATIEKARKIIAKYNADGISNDRVLIKIASTWEGIKAAEVLEKENIHCNLTLLFNFYQAVACAEAGVTLISPFVGRILDWYKSATGRDSYPATEDPGVVSVTKIFNFFKSNGYKTEVMGASFRNIEEITELAGCDLLTISPKLLQQLNETHMDLPIKLNAQKPLVIEEKIHLDQTSFELMMAGDKMATEKLDDGISGFSKAIDKLENQLNERLELIEGEVALTH

SEQ ID NO: 30061 - protein, 192 aa, Zea mays
MPHVPTDVFIDACKQVVKANEHFIPPYGSGGALYLRPFVIGTGDNIGVRTAPEFIFSVFCIPVGAYFKGGLVPHNFQISTFDRAAPQGTGAAKVGGNYAASLMPGSEAKKAGFADAIYLDPMTHSKIEEVGSANFFGITHDNQFITPKSPSVLPGITRLSLIELAKTRLGLDVVEGEVFIDKLDQFKEAGAC

SEQ ID NO: 30062 - protein, 323 aa, Desulfitobacterium hafniense DCB-2
MTNTVRKIAVLTSGGDAPGMNAAIRAVVRKGIYHGLEVFGIRKGYEGLIHGEFITMHLGAVADIIHRGGTMLMTARSQEMLTPEGQKNAAAQLRYRGIDALIVIGGDGSFRGAQTLSAQGIAIVGIPGTIDNDITGTDLTIGFDTAVNNVVQAVSKIRDTATSHDRTFLVEVMGRDCGNIALQSGVACGAESILVPEIEPDLDDIVAKLERGHQRGKHHSIIMVAEGAMSAWNLGEELRQRTGFETRVTILGHIQRGGNPSALDVVLASQMGGKAVEILCAGETDRMTACVNQEIQSLPLEVAYGERKPFNKVLYDLANQLAI

SEQ ID NO: 30063 - protein, 162 aa, Gossypium hirsutum
MKRRTPDSQATVSDQKLKKIKEDEEPEDTKSGLMNLDENLLYEVFKHVDARTLARASCVSRLWRQTAKDERLWELICTRHWANIGCGTQQLRSVVLPLGGFRQLHSRYLWTFSKPQAASASAWSPPKIINSKPPARWGKDEVNLCLSLLSIQFYEKMNNRGR

SEQ ID NO: 30064 - protein, 213 aa, Triticum aestivum
  misc_feature (92)..(92): Xaa can be any naturally occurring amino acid
  misc_feature (147)..(147): Xaa can be any naturally occurring amino acid
  misc_feature (150)..(150): Xaa can be any naturally occurring amino acid
  misc_feature (157)..(157): Xaa can be any naturally occurring amino acid
  misc_feature (167)..(167): Xaa can be any naturally occurring amino acid
  misc_feature (177)..(177): Xaa can be any naturally occurring amino acid
  unsure (1)..(213): unsure at all Xaa locations
MHVGAVQPNDRVLIVDDLIATRLCAAAKLIERASDGRVERIASSIRAIPNFPKPVILFQDITTLLLDPQAFRDTTDLFVERYKDKDITVVAXGVEARGFIFGPPIALAIGANLFQIRNPKNYLGEVISEDIPLEYGTDKIEMHVGAXQPXDRSLIVXDLIPTGGPFXPAAKFIDCVXAFIVYCTCVIELPELKGRDKLGDMPVFVLVQADESV

SEQ ID NO: 30065 - protein, 587 aa, Coccidioides immitis RS
MRYFTPWERPRHVEDYYLPRIIQRLQGSTKVPFGDAVISTPDTCLGAETCEELFTPAGPHADMGLNGVEIFTNSSGSHHNLRKLDQRVSLILEATRKSGGIYLYSNLQGGGGERLYYDGCSMIVVNGEIVAQGTQFSLNDVEVVTATVDLEEVRAFRFAPSRGLQAVRAPEYRRIETSFSLSAESDQLDPGLSPSPRLDVRYHLPEEEIAFGPACWLWDYLRRSQLAGFLVPLSGGIDSCATAIIVFSMCRLVIEAIEKGNQQVVTDVKRIAGVYEKEGWLPKTPQELCYNIFHTVYMGMASQSSKETRSRAKDLSKAIGAYHVDLNIDDIFNAQKDTFAKATGFDPKFKVYGGTQAENLALQNIQARTRMVTAYEFSQLLPTVRKRPGGGGLLVLGSANCDEALRGYYTRYDCSSADINPIGSISKKDLKLFIAWAQKEFELPILVDFLNATPTAELEPITKDYVQADEVDMGMTYDELSTFGICRKVLKLGPYSMFEKLLHEWKGLKPRDIATKVKRFYHYYAVNRFKMTTLTPSYHAESYSPDDNRYDLRPFLLPPQYSSLPFKKIDELVDKIENSEKGESSSK

SEQ ID NO: 30066 - protein, 500 aa, Cryptococcus neoformans var. neoformans B-3501A
MPSLTQTKDLASLLSDASHFKQKGYINGEWVSASDGATFPLYNPATGAKLADMPHMPRSQVAEAINAAKAAFPAWAALTAYQRQNYLLKLFKEMEEHSEDLAIILCTENGKPLAESRVEISYGASFLTWNAAEALRTYGQTIPSPFPGTRNTVIKQPIGVCGLITPWNFPNAMITRKMAPALAAGCTVVIKAPAETPLSALAMCVLCERVGIPPGVVNVVTMDKGQREMAAGLELCENVKVSKISFTGSTPVGRLLMKQSSGTLKKLSFELGGNAAFIIFDDADLDLAVNGVILSKFRAAGQTCICANRIFVHSKIYDDFARRLVERVKAFKVGNGIEEGVTIGPLVSQRGVEKVERHVQDAVGLGAKVLVGGKRIDKGEGSCFYEPTVLVDVPRQCAVSNEETFGPLAPLFKFDDEDDVVERANSSEVGLAAYFFTKDLARTHRVAEKLEVGMVAVNTGAIAQACVPFGGVKQSGFGREGGPSGIDEFMVEKLITIGGL

SEQ ID NO: 30067 - protein, 389 aa, Oryza sativa (indica cultivar-group)
METRPPPAAAAAAAAPARVSRFRRLLVRVSAAPERAGGGSGGGGEVREKEEKAAEMEVGSVGLDRMVLSFMEDSAAAAVERPPRGRCGSCFNGGGDGSDDEEFDFLPSDSSATAAASAAAAAGDALDALKGLVQSASMAERNLLADASRIAERCRKGGKKKADVRCAVADGLAALGYDAAVCKSRWDKTPSYPAGEHEYIDAVVAAETRLVVEVDFRSEFEVARSTKAYRAALQALPPLFVGTPDRLGQIVAVVAEAARQSLRKKGLHVPPWRKPEYMRAKWLSPQVLRCSDKPPPPPPSPPPTPVSLSSFSGEFELRFDAKTPPNLSATAAGDDNDNDDKVEAKKITMVVSPSPWRPVEPEAASKKRSPPPPPRRPEGKVVTGLAAVL

SEQ ID NO: 30068 - protein, 1044 aa, Ehrlichia chaffeensis str. Arkansas
MISALQTPNEIRRRMQMLYRIEENSCTRYLTEKTEISQDSKIRIYSVAKQIIERIRVDRNLGIIDAFMQEYGLSNEEGIALMCLAESLLRIPDDCTINDLIKDKIGNSMWSNHIGSSSSMFVNAATWGLFIGGKVLKDSNDSTRWFGTINNLLKTMGEPIIRKAVQQAMCILGKHFIKGRDITEALNNRREGELYSFDILGEAAKTRKDAERYFTEYMAAVDSIGKSKVNNEIGNLIDYDEISVKISALHSRYEFSQIDKVLDEIVDKLLQICKLAKEHNIRVCVDAEEASRLEISLMILEKLRFDSSLNGWEGLGLAVQAYQKRAFSVLDFVEDISVRSHHKMMVRLVKGAYWDYEIKNAQELGLSSYPVFTRKVYTDVSYLACANKILSKPNTFSPCFATHNAYTLAAILEMANKDHPGFEFQRLHGMGANLYEYVTQELAANVKCRVYAPVGSYQDLLPYLIRRLLENGANSSFINQLNDSNVSLEQLIEDPLEKARELEYLPHPSIPLPKDIFGPERLNSMGIDITDSVTLTNFNEEMKNYQTCKFKAAPIIGGKELDGNFIEVFSPTNSEDIIGEVLFTDTAQALSALDMAYNAFKDWSNIPVSTRAAILEKAANLIEENKAKLIMLLIREGGKVISDAIAEIREAVDFLRYYAVLGRQELEQSRKLPGPVGEDNYLYFRSRGVFVCISPWNFPLAIFVGPIAAALVTGNTVLAKPAEQTSIIAYETVKLLHDAGVPKEVLHLLLGSGKELGEALLRNEKIGGVAFTGSTETARIINQSIAEKEGGIIPFIAETGGLNTMITDTSALIEQVTNDVITSAFKSAGQRCSALRVLFVQEEVADKQIEMICGAMEDLVVGDPMLLKTDIGPVIDKASQEMLIAHEDRMSREAKLLYKVKLGEDCEKGYFFAPCVYEIQSISQLKREVFGPILHIIRYKKGDLHRILDEINSTGYGLTFAVQSRVQSNIDVIIDSVNVGNVYVNRNQVGAVVGVQPFGGQGLSGTGPKAGGPYYLHRFLTEKVVSINTTALGGNTTLMCLTDQ

SEQ ID NO: 30069 - protein, 748 aa, Cryptococcus neoformans var. neoformans B-3501A
MTLDILQPKPTPDASVQAFLNRHKQLLELERKAEEEQTRLLNSKCSPSLLEQRGLALNGLGVSGISIGLGGKSLIELHRPLAYHTSPALPPHTFRPGDPVRIEAHVATTSGKIKGKKRESEDEGAVEGVVYRVGPEKVVVAVNESKEIDLPERLRLLKLANSVTFDRMEKTLAHLERLVLPSGGTPSPPSFNMPLVQALLGKQLPTWKETIPPQNNIEPLGQLSSDEDMKWFGQHLNDSQKESIKFCLKANEVACIHGPPGTGKTHTLVELIFQLLSRPASPNTTLPPRILITTPSNLALDNLLIRLHILAQQPPYSSLLPRNSFLRMGHPTRVHRDLVKETLDWKAANGDQGELLKDVGKEMQGHLDALGKKRGEKGAVKGKERGKKWGEVRELRKEYRQREGKVVKTVVNGAQIVLATCHSAGSRQLNNMIFDVCIIDEATQAVEAVCWVPILKSKKLILAGDPQQLPPTIMSKENAPPLKDLQEAIDQIKLGDSPSLKSPRTLETTLFERLEKLYGPGIKRVLQVQYRMNEHIAVFPSETLYESALISDASVAKRTLLELPSVKDKTSEDVKDDLEPTVVFFDTADCEFYERTEGDGEATKSSIGEGSKSNENEAEIVARWARKLISLGIPPIEIGIVTPYQAQVTLISSLLHEEYPEMTIGSVDGLQGQEREAIILSLVRSNPSGEVGFLGEYRRLNVAMTRAKRQLCVVGDSKTVSKGTKYLKKWMDWLEAEAYVRWAGEETV

SEQ ID NO: 30070 - protein, 131 aa, Zea mays
MASRAFALFLAVNLVVLGVASACSPYCPTPTPTPSTPTTPTPTPSSFGRCPRDALKLGVCANVLGLIKAKVGVPPAEPCCPLLEGLVDLEAAVCLCTAIKGQILGINLNLPIDLSLILNYCGRTVPTGFKC

SEQ ID NO: 30071 - protein, 495 aa, Triticum aestivum
MGKKPKWLGAVKKAFSPESKDQKLQRRLAAAGTSAGAAYPRDLTPSASYLEARASGSAPPPALPRYPDDFQEEEHEIEHVAAAPAPAPATDAPLPAPPAAAPPQVQAAIAPASSSCVMSRELAATKIQTAFRGHLARRALRALKGLVRLKSLVQGHSVKRQATSTLRCMQTLSRVQSKIRTRRIKMAEENQALQRQLLLNQELETLRMGDQWNTSLQSKEQIEASLVSRQEAAARRERALAYAFSHQWKSTSRSANPMFVDPSNPHWGWSWLERWMASRPFDGRNGASEKEGSSVDRTSVHSTSLSMNLGEGETVTKADNQVVDSLKPNDDKPPPLSTPKPSGPAPRQSPSTPSPALARKKSATPKSGDCDGDDARSVVSTVRSERPRRHSIGASSVRDDAGSSPSVPSYMAATKSASARAKSRVQSPTLTEGAAQAETLEKGWSSVGSAKKRLSFPAGTPPPVPAAAARRHSGPPKVRQAGVEGGTEERDSSLA

SEQ ID NO: 30072 - protein, 130 aa, Zea mays
  misc_feature (28)..(28): Xaa can be any naturally occurring amino acid
  misc_feature (44)..(44): Xaa can be any naturally occurring amino acid
  misc_feature (61)..(61): Xaa can be any naturally occurring amino acid
  misc_feature (88)..(88): Xaa can be any naturally occurring amino acid
  misc_feature (98)..(98): Xaa can be any naturally occurring amino acid
  misc_feature (121)..(121): Xaa can be any naturally occurring amino acid
  unsure (1)..(130): unsure at all Xaa locations
CLTWIASSIGVIPDFTKSWIMFQEISTXLLDPKVFRDTIDLFVXRHKDTMITAVAGDKLHXGFIFETPITLDIVAKIVSLRKSKKMPXEEISEKYALXYVTDQIQMHVGAVQVNYRALVVXELIATGATL

SEQ ID NO: 30073 - protein, 117 aa, Arabidopsis thaliana
MASKALILLGLFAILLVVSEVSAARQSGMVKPESEETVQPEGYHGGHGGHGGGGHYGGGGHGHGGHNGGGGHGLDGYGGGHGGHYGGGGGHYGGGGGHGGGFGGGAGAGGGFGGGHH

SEQ ID NO: 30074 - protein, 351 aa, Arabidopsis thaliana
MKGFFKTESETRKHSDKNGSLLHEELIACSDGKYNPIRMFSSDQILKATNNFDADHIIAKDRFIWYKGTIEERRVLIKKWEGDYVLFSSPENVYRDIAVLSMMSSHKNVLKLLGCCVEFYKPVLVCELAEKGPLKLEDMDGTPLPWSARLKIGKDIANAVAYLHTAFPRVIINRDVRPQNIFLDEDGTAKLSSFCLRISIPEGESSVYDDKVVYGVSVDPEYNGTGLVSEKFDVYSFGVTMLFLLGGELGLTWLSAIIGEFGFPFPGCGEELADQFMYVIDSNIWNGESEASAVQVETFFGLALRCIRFWPGQDVLTMIDVAKELKGIEELFKASSSEQDKEQIDQVNYSV

SEQ ID NO: 30075 - protein, 365 aa, Triticum aestivum
VCEPREEETCRPETETMDLVNGALNWAAMPAMVAALLLFYPPYYLFKLCYSFLSYLFPDDLKRKVVLITGASSGIGEQLAYQYAAKGACLALVARKEWSLRQVADRAFDLGAPDVIILPGDVADPDDCNRFVQATVDHYGRLDHLVCNAGIASVGAFQEIPDVTNYSSQLDVNFWGAVQSTSAALPHLKRTRGRIVVTASATGWNPVPRMIFYNAANAALINFFETLRSELGSEVGITIVTPGWIESEMSKGKFLKEHGGVEVDQEYRDAQIGLFPVEYAKNCARAMVQAARQGDRYLTVPSWFGTMYLWRVFAPEVVEFCYRLLYMHRHGGGDQTDAPSKTMAQGGGKQMLYPSSLRSSDVKSD

SEQ ID NO: 30076 - protein, 235 aa, Glycine max
MHHHQHLLISGRLINFWCKYINELYLHKLMPTKVKGLLKYISQIFEEKEEEFQIGLPTDVRHVAHIGSDDPSANAPSWMNDIKGGKEPPSGNPTQTVEEREKKASSNSKRSKIRNHLIPKSRHNSIDIDPDAPKPKATRRHNRSSDPSADSSNHESSSGSRQRHHRGSNHDPGSLSSQEMPPTGPKTNRRKSKASEDGSTKKPSSRRSSKGDSLTDISISDFGSDSRPESELTTH

SEQ ID NO: 30077 - protein, 511 aa, Glycine max
MEAAWVNILMLILILALIWVWKKFNSLWLTPKRLEKILREQGLRGSPYRFKVGDTKETLKMQMQAMSKPMNLFSNDIGPRVSPYDHYIVNKHGKNSFIWNGQTPRVTLTDPELIKDVFNKIYDFGKPNMGPNIRSLIPGLAMHEGEKWSKHRKIINPAFNLEKLKNMLPLFIQCCDDLISKWEEMLSSDGSSEIDVWPFVKNLTADVISRTAFGSSYLEGRRIFQLLKEKIELTLKMRGQRLVPKRMKEIDRDIKASLMDIINKRDKALKAGEATKNNLLDILLESNHKEIEEHGNNKNVGMNIEEVIEECKLFYFAGQDTTSVLLVWTMILLSRYPDWQARAREEVSQVFGNQKPTFDGLNQLKIVTMILYEVLRLYPPGVGVPRKVIKDVKLGNLSFPAGVEIFISTILVHHDSELWGDDAKEFKPERFSEGVLKATNGRFSFFPFGGGPRICIAQNFALLEAKIALSMILQCFSFELSPTYTHAPTMVMTIQPQYGAPVILHKVEKYE

SEQ ID NO: 30078 - protein, 218 aa, Vibrio parahaemolyticus RIMD 2210633
MTQDEMKKAAGWAALKYVEKGSIVGVGTGSTVNHFIDALGTIKDDIKGAVSSSVASTERLKELGIEVFECNDVIKLDVYVDGADEINHAREMIKGGGAALTREKIVAAISEKFVCIVDDTKAVDVLGQFPLPVEVIPMARSYVARELVKLGGDPAYREGVVTDNGNIILDVHNMQITNPKEMEDKINGIAGVVTVGLFAHRGADVVITGTPEGAKIEE

SEQ ID NO: 30079 - protein, 276 aa, Oryza sativa (japonica cultivar-group)
MESQVLVALALSLVGGLSTSIGALFVILNPTPNLKMLGLLQGFAAGLMLSISFLDLAHNALNSIGFLKGNLWFFAGVLFFGLVVKFIPEPTVVPTADAGKKQTDDDGSGKDMMKKHRRQVLFSGIITAVGISLHNFPEGMAVFLGSMKGLRVGLNLAIAIALHNIPEGVAVALPLYFATNSKWQAFKVATLSGFAEPLGVIIVAYLFPSSLNPEVLEGLLGSVGGVMAFLTLHEMLPLAFDYAGQKQAVKAVFVGMAFMSASLYFLEISLPKEVSL

SEQ ID NO: 30080 - protein, 429 aa, Vibrio angustum S14
MNRIIVVGGGAGGLELATKLGRTLGRKGRAEVTLVDRRASHLWKPLLHEVATGSLDAGVDAISYRAHAKNHHFDFQMGSLETIDRENKTITLAALFDKQNELLLPERTLEYDILVLAIGSTSNDFNTPGVRDHCIFLDSPEQAHRFRTEMNNQFMKLHGNKDQKTVDIAIVGAGATGVELSAELHNAVQELHNYGFGDLDSSRLNVNLVEAGDRILPALPPRISQAAHNELTKLGVTVRTGTMVTKADETGLTTKDGDHIPAQIMVWAAGIKAPDFMKDIAGLETNRINQLVVKPTLQTTRDDNIYVIGDLASCVQEDGSFVPPRAQAAHQMASRCFSNIVAKITDREQKPYVYSDHGSLVSLSRFSTVGSLMGNLSKGSMMVEGRIARMVYISLYRMHQMALHGMFKTGLIMLVSRINRVLRPSLKLH

SEQ ID NO: 30081 - protein, 339 aa, Oryza sativa (indica cultivar-group)
MARDFTATFLLLLSVASLLVISPCAAQQIKTTDTRWSYHLPLPDGVSGAESLAFDGKDGLYTGVSDGRVLKWGGSAAGWTTFAYNANYRKIPLCSSSEVPPEERESICGRPLGIRLFRKTGELYIADAYKGLMKVGPDGGEAQVVATEADGVPFHFLNGLDVDQATGDAYFTDSSSTYTRRFNGEITMNADATGRLLKYDARTRRVTVLKTDLPYPNGVAVSRDRTHLVVAHTVPCQAFRYWLRGTKAGEYELFADLPGYPDNVRRDTKGGYWVALNQERMRLGAAPAAKHLVGVRLNPDGVEVEELTATKGVTLSEVAEQKGKLWLGSVELDYIGMFA

SEQ ID NO: 30082 - protein, 230 aa, Triticum aestivum
MPGGWIPPPPKLGYPIPPFDFSVKGVTAISADVHKYGLAPKGTSSVLYRDQAIRKHQFVAVTEWTGGLYISPTMAGSRPGGLVAGAWAAMMSLGLNGYLESTGKIMEVSKKIQKGIDDISGLFVIGKPDMTVVAFGSDAVDIFEVNDIMSSKGWHLNALQRPNSLHICVTLQHTAIYEEFLKDLEDSVDTVKANPGPISGGMAPIYGAAGKMPDRGTVKELLVEFMDSSC

SEQ ID NO: 30083 - protein, 328 aa, Glycine max
MALRLTTVVSSVGHSGKPRFRFRIRSVAATVRNMAFSATSKVIDSHLHVWASPQEAGRFPYSLGQEPTLPGNAEFLLQCMEEAGVDGALIVQPINHKFDHSYVTSVLNKYPTKFVGCCLANPADDGSGLRQFEDLVLKDGYRAVRFNPYLWPPGEKMTNKVGKEIFQRAGELNVPVGFMCMKGLDLHISEIEQLCTEFPSTVVLLDHLGFCKPPINDEEGLVFSQLLNLSRFPQVHVKFSALFRVSRAQFPYLDLSPLFSQVVSHFGANRVMWGSDFPFVVAECGYKGAKEAVHLIASEISLPLSDLEWIMGRTATQLFQNQLTPVNS

SEQ ID NO: 30084 - protein, 323 aa, marine gamma proteobacterium HTCC2207
MTATNFITSAQRTIKMEADAVAELQHRLDDSFVTACETMLACEGRVIVTGMGKSGHIGNKIAATLASTGTPSFFVHPGEASHGDLGMITKNDVVIVISNSGSTAEVITILPLIKRLGIPMISMTGDPGSVLSQAARANLDVSVTSEACPLNLAPTTSTTVTLAMGDALAIALLESRGFTAEDFAFSHPGGALGRKLLLRVADIMHKDVEVPRVLTSEPLHQALLVMTEKGFGMTTVVSDENKLLGVFTDGDLRRIVDAKVDINNVTMADVMSPNPKTINGEILAAQALKIMEDGSITALIVEDEHQSPIGVLHMHDILRAGVM

SEQ ID NO: 30085 - protein, 195 aa, Zea mays
ACVSPAGGKGRRWWRWRPLTRAWRGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 30086 - protein, 418 aa, Oryza sativa (indica cultivar-group)
MEAAVDGRWTRVRTLGRGASGAVVSLAADDRSGALFAVKSAAAAAAAEQLVREGRILSGLRSPHVLPCLGFRAEAGGECQLFLEFAPGGSLADVVARSGGRLDECAIRAYAADVARGLAYLHGMSLVHGDVKGRNVVVGADGRAKIADFGCARTVGSDRPIGGTPAFMAPEVARGEEQEPAADVWALGCTVIEMATGRAPWSDMEDILSAVRRIGYTDAVPEVPEWLSAEAKDFLARCFARNPRERWTSSQLLEHPFLASAGCSVKTGEAAPQWVSPKSTLDAAFWESDTDDEEDDMPASPAERIKALACPCSALPDWDSDEGWIQVLNESSEACDTAVAKVEAEGKGRVLIEALETINESSGGDAECVDPECTVRLITVASIGQQEVFCLGLINDPLVFSVNKSELTKSLFPQIVSF

SEQ ID NO: 30087 - protein, 124 aa, Desulfovibrio desulfuricans G20
MKKIVHTDAAPAAIGPYSQAVLKGDTLYISGQLPVDPATGELVDGIEAQTRQSLTNAKAILEAAGSSLDKVCRTGVFMKDLSQFAQMNAVYAEFFSTAFPARSCVQVAALPKDALVEIELIAEV

SEQ ID NO: 30088 - protein, 386 aa, Vibrio parahaemolyticus RIMD 2210633
MSVIKMTDLDLAGKRVFIRADLNVPVKDGKVTSDARIIASLPTIKHCLEAGAKVMVTSHLGRPTEGEYAEEFSLQPVVNYLNDALDCEVKLAKDYLDGLELNAGELVVLENVRFNKGEKKNEEELSKKYAALCDVFVMDAFGTAHRAQASTHGVGMHAPVACAGPLLANELEALGKAMDKPARPMVAIVGGSKVSTKLTVLESLSKIADQLVVGGGIANTFIAAAGHNVGKSLYEADLVDTAKKLMDECAIPVATDVACAKAFDENAEAEIKHVSEVQDDDMIFDLGPESTAALAEILKNAKTILWNGPVGVFEFKNFEAGTKGISEAIAASEGFSVAGGGDTLAAIDKFGIKADVSYISTGGGAFLEFVEGKVLPAVEMLEARAK

SEQ ID NO: 30089 - protein, 664 aa, Vibrio parahaemolyticus RIMD 2210633
MSSRKHLANAIRALSMDGVQQANSGHPGAPMGMADIAEVLWRSHLNHNPANPEWADRDRFVLSNGHGSMLIYSLLHLSGYELSIDDLKNFRQLHSKTPGHPEYGYAPGIETTTGPLGQGITNAVGMALAEKALAAQFNKEGHDIIDHFTYVFMGDGCLMEGISHEACSLAGTLGLGKLIAFWDDNGISIDGHVEGWFSDDTPKRFEAYGWHVIPAVDGHDSDAINAAIEAAKADPRPTLICTKTIIGFGSPNKSGSHDCHGAPLGAEEIAAAREFLGWEHPAFEIPADVYAEWDAKAAGAEKEAAWNAKFEAYAAAYPTEAAELKRRLNGELPAEWEEKANQIIADLQANPANIASRKASQNALEAFGQMLPEFMGGSADLAPSNLTMWSGSKSLEANDFSGNYIHYGVREFGMTAIMNGIALHGGFVPYGATFLMFMEYARNAMRMAALMKIQNIQVYTHDSIGLGEDGPTHQPVEQMASLRLTPNMNTWRPCDQVESAVAWKLAIERKDAPTALIFSRQNLAQQERTAEQVTDIAKGGYILKDSDGKPELILIATGSEVELAVKAAEQLTAEGKKVRVVSMPSTDAFDKQDAAYREAVLPSDVTARIAIEAGIADFWYKYVGFDGRIIGMTTFGESAPADQLFEMFGFTVENVVNTAKELLA

SEQ ID NO: 30090 - protein, 522 aa, Oryza sativa
  misc_feature (84)..(85): Xaa can be any naturally occurring amino acid
  unsure (1)..(522): unsure at all Xaa locations
MAISLITSLLFSLPQQWQPVVLTGLLPVIVSLVLLARKGRLKMPPGPEQVPLLGNLHQLAGPQPHRALRDLARVHGPVMRLRLXXASAVVLTSAEAAWEALRGHDLDCCTRPVSAGTRRVTYGMKNVAFAPYGAYWREVRKLLMVELLSARRVKAAWYARHEQVEKLLSTLRRAEGKPVALDEHILSLSDGIIGTVAFGNIYGSDKFSQNKNFQHALDDVMEMLSGEGSSAEDLQLPAAVGRLVDRLTGFAARRERIFRQLDSFFEMVIEQHLDPNRAPPENGGDLVDVLIGHWKKNEPRGTFSFTKDNVKAIIFSTFVAGIDTNAATILWAMSELARKPRVLKKVQAEIRAAVGVNGRVQPDDITKLSYLRKVVKETLRLHPPTPLLLPRETMRHIQISGYDVPAKTRIYVNAWAIGRDPASWPDEPEEFNPERFEANEIDFKGEHPELMPFGTGRRICPGMAMAMANVEFTLANLLFAFQWSLPEGTTPDNVCLEEEGRLVCHRKTPLVLVPTVYRHGLE

SEQ ID NO: 30091 - protein, 229 aa, Cryptococcus neoformans var. neoformans B-3501A
MPPHLARTWTCEELLRGHATKKYALIIVNQPIRKDLLQRAWQAVDIRLCADGGANRLFDVDHESQYLPDLIKGDLDSLRPDVQAHYASLKVPIKKDEDEYSTDLMKCIQEVPEDYALVLLGGLSGRVDQTVHTMSMLHKMDREIYVLDKESMAWVLRPGQHEIHIDHSTMGQTCGILPVGIDSAHVRTKGLKWDVGNLSTSNHLLPEEPVVWIETSRPILWTVEIRQIE

SEQ ID NO: 30092 - protein, 351 aa, Aspergillus nidulans FGSC A4
MSTTGPIRVAAIPKHYLQFTVRTYTRSMASAGLRYSNPPLVKKCYDQPTGKRFISSTPQSQIKDYFPPPDAPKIVEVKTAWAHPVYSEEEMRAVTVGHREAKNWSDWVALGSVRLLRWGMDLVTGYKHPAPGQEDIKKFQMTEKEWLRRFVFLESVAGVPGMVGGMLRHLRSLRRMKRDNGWIETLLEEAYNERMHLLTFLKMAEPGWFMRLMVLGAQGVFFNGFFLSYLISPRTCHRFVGYLEEEAVLTYTRAIKDLESGRLPHWEKLEAPEIAVKYWKMPEGNRTMKDLLLYVRADEAKHREVNHTLGNLKQAVDVNPFAVEWKDPSKPHPGKGIKHLKTTGWEREEVV

SEQ ID NO: 30093 - protein, 513 aa, Myxococcus xanthus DK 1622
MTPAHKVLLCILDGWGIRQERDNNAIVLAGTPHLDKLASPYPFTELQTAGLAVGLPEGQMGNSEVGHTNIGAGRIVYQDLVRINRAAESGELAQNPVLRAALDGVKADGKALHLLGLVSPGGVHSSMDHLFALLKAAKERNVAHVYVHAFLDGRDTPPQSALGYVEELERFLHETHTGRIATVTGRFYAMDRDKRWDRVHQAYEALVFGRGPKAPDALSAIRASYAEKVTDEFVKPTVLAAGDGTPVGRIQDGDAVIFFNFRADRARELTQALAFPEFKEFDRGGLRLGRYVCMTQYDETFKLPALFEPDQPQDIFPELLSRQGLRQFRTAETEKYAHVTFFFNGGREVVYAGEDRHLVPSPRDVKTYDLKPEMSAYEVTAELVKRLDSGKYDFALVNFANPDMVGHSGRLDAAMKAVKAVDECLGALGKACERNGWVLAISADHGNCEQMVDLETGEPHTAHTLNPVPFHLIHPDFRGQKLRPGILADIAPTLCKVMGLPQSKEMNRQGLLP

SEQ ID NO: 30094 - protein, 157 aa, Oryza sativa (indica cultivar-group)
MANAGLKPVAGLLLVLNFCMYVIVAAVGGWAINHAIHTGYFIGSGMALPANFSPIYFPMGNAATGFFVIFAVIAGVVGAAAALAGFHHVRAWSHESLPAAASSGFIAWTLTLLAMGLAVKEIDLHGRNARLKTMESFTIILSATQLFYLLAIHGGSV

SEQ ID NO: 30095 - protein, 197 aa, Glycine max
MRPPRGGGRGGGFRGGRDGGFRGGRDGGGRGRGGFGRGGGGFGRGGGGFGRGGGFRDEGPPSEVVEVSSFMHACEGDAVTKLTNEKVPFFNAPIYLKNMTQIGKVDEIFGPINEAYFSIKMMEGIVATSYSSGDKFYIDPRKLLPLARFLPQPKGQSAGRGGGGGGRGGGRGGRGGGGFRGRGGAGGGGGGGGGGGG

SEQ ID NO: 30096 - protein, 1126 aa, Marchantia paleacea var. diptera
MSTTKVTYSSGSSAKSKHSVRIVQTTADAKLQAVFEESGESGDSFDYTKSINASKSTGESVPAQAVTAYLQRMQRGGLTQTFGCMLAVEELTFRVLAYSENAPEMLDLMPQAVPCVGQQDVLGIGTDARTLFNSASAVALEKAAGALDVSMFNPISVQCKSSGKPFYAIVHRIDAGLVIDIEPVRPSDPSVSAAGALQSHKLAAKAISRLQSLPGGDIGLLCDTVVEEVRELTGYDRVMAYKFHEDEHGEVVAEIRRSDLEPYLGLHYPATDIPQASRFLFMKNRVRMICDCCAQPVQVIQDKELRQPLSLAGSTLRAPHGCHAQYMGNMGSIASLVMAVIINVNDEEYSSRGYHHKGRKLWGLVVCHHTTPRSVPFPLRSACEFLMQVFGLQLNMEVELAAQLREKRILRTQTLLCDMLLRDAPIGIVSQSPNIMDLVKCDGAALYYGKRYWVLGTTPTELQIKDIADWLLEYHKDSTGLSTDSLADAGYPGAASLGDAVCGMAAARITSKDFLFWFRSHTAKEIKWGGAKHDPDDKDDGRKMHPRSSFKAFLEVVKRRSLPWEDVEMDAIHSLQLILRGSFQDIDDSDTKTMIHARLNDLKLQGMDELSTVANEMVRLIETATAPILAVDSSGFINGWNAKVAELTGLPVSEAMGRSLVKDLALEESVETVERLLYLALQGEEEQNVEIKLQTYGAQKDKGAVILIVNACSSRDVTENVVGVCFVGQDVTGQKVVMDKFTRIQGDYKAIVQNPNPLIPPIFGSDEFGYCSEWNPAMEKLAGWKREEVIGKMLVGEIFGTQMMCCRLKGQDAMTKFMIVLNSAMDGQDSEKFPFAFFDRQGKFVEALLTANKRTDSEGAFTGVFCFLQIASMELLQALTVQRATEKVAFSKLKELAYIRQEIKNPLYGIMFTRNLVEDTNLTEEQKQFIETSALCERQLRRILDDMDLESIEDGYLELDTAEFIMGTVMDAVISQGMITSREKGLQLIWDTPRDTKNLCLFGDQVRLQQVLADFLLNAIRFTPSSEGWVGIKGVSSRHRQGGGVHVVHFEFRVTHPGAGLPEELVQEMFDRGRGMTQEGLGLNMCRKLLKLMSGDVQYIREAGKCYFLVNVELPIAQRDDAGSVK

SEQ ID NO: 30097 - protein, 293 aa, Bordetella bronchiseptica RB50
MGKTQEFLRLRRIIALSSLLASRKSAMCLAVLALHAIPGLPVLIAANRDEFHARPTAEATRWPGSPAIYAGRDLQAGGTWLGVSDQGRYAVVTNFRDPRNIQPDAPSRGALVEAFLRGAASAQEYLRDVHARGARYNGFNLIVGDAGGAWYCSNRDGAPQRLAAGVYALSNHLLDTPWPKLARTKAAFERIIAATPQPDLAALYAALADPTPAADHELPATGLALERERLLSSPFIVSPDYGTRSACILALHDDGRGELHERRFRPDGAIAGQADLDFPWRAARAELHRASCV

SEQ ID NO: 30098 - protein, 301 aa, Triticum aestivum
WPAWLSAVAGEAINGWTPRRADTFEKIDKIGQGTYSNVYKARDSLSGKIVALKKVRFDNLEPESVRFMAREILILRRLDHPNVMKLYGLVTSRMSCSLYLVFDYMVHDLAGLAASPDIKFTLPQVKCYVHQLLSGLEHCHNQGVLHRDIKGSNLLLDDDGVLKIGDFGLASFFDPNHKQPMTSRVVTLWYRPPELLLGATDYGVGVDLWSARCILAELLAGKPIMPGRTEVEQLHKIFKLCGSPAEEYWKKSKLPHATIFKPQQPYKRRIAETFKDFPQSALRLIETLLSIDPADRLTPTA

SEQ ID NO: 30099 - protein, 212 aa, Thermoplasma acidophilum
  misc_feature (1)..(1): Xaa can be any naturally occurring amino acid
  misc_feature (13)..(13): Xaa can be any naturally occurring amino acid
  misc_feature (122)..(122): Xaa can be any naturally occurring amino acid
  unsure (1)..(212): unsure at all Xaa locations
XGSDKIHHHHHHXLKIYVVDNGGQWTHREWRVLRELGVDTKIVPNDIDSSELDGLDGLVLSGGAPNIDEELDKLGSVGKYIDDHNYPILGICVGAQFIALHFGASVVKAKHPEFGKTKVSVXHSENIFGGLPSEITVWENHNDEIINLPDDFTLAASSATCQVQGFYHKTRPIYATQFHPEVEHTQYGRDIFRNFIGICASYREIQKENFQH

SEQ ID NO: 30100 - protein, 295 aa, Oceanobacillus iheyensis HTE831
MPQNPRTKYTNEDFPKQFQEQPGIQREMTPIPDCGETTYKGSGQLQGRKALITGGDSGIGRAAAIAYAREGADVAINYLPVEESDALEVKALIEEAGQKAVLLPGDLRDEQFTRSLIHEAINELDGLDTLVMVAGEQQAVEDITNLSTEQLVSTFQTNVYSMYWMVQEAIPHMPPGSSIITTSSVEGYDPSPMLMDYAPTKSAIIGFTKGLAKQLSSKGIRVNSVAPGPYWSALQISGGQPQENIPKFGKETPETPLGRAGQPAELGGLYVFIASEHASYATGHVFSATGGLRAN

SEQ ID NO: 30101 - protein, 377 aa, Setaria italica
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKTSSSVEKSYELPDGQVITIGAERFRCPEVLFQPSFIGMESPGIHETTYNSIMKCDVDIRKDLYGNIVLSGGSTMFPGIADRMSKEITALAPSSMKIKVVAPPERKYSVWIGGSILASLSTFQQMWISKGEYDESGPAIVHRKCF

SEQ ID NO: 30102 - protein, 542 aa, Fusobacterium nucleatum subsp. vincentii ATCC 49256
MAKKSYEVLNDPFLNKGTAFTKEERKELELTGLLPPQIQTIEEQAEQVYAQYKSKEPLINKRRFLMEIFDTNRTLFYYLFSQHVVEFMPIVYDPVIAENIENYSELFVNPQNAVYLSIDSPETIEESLRNATKDREIRLIVATDAEGILGIGDWGTNGVDISVGKLMVYTAAAGIDPKSVLPVVLDAGTNRETLLEDKLYLGNRHKRVYGDEYYDFVDRFVQTAEKLFPRLYLHFEDFGRSNAANVLHKYWKTYPVFNDDIQGTGIITLAGILGALKISGEKLTDQRYMCFGAGTAGAGIADRIYQEMLQQGLSENEARSRFYLVDKQGLLFDDMNDLTPEQKPFARKRTEFNNANELTNLEAAVKAVRPTILVGTSTQPNTFTETIVKEMASYTARPIIFPLSNPTKLAEATAENLIKWTEGKALVATGIPADPVEYNGVTYEIGQANNALIYPALGLGAIASTAKLMTNEMISKAAHSLGGIVDTTKPGAATLPPVSKLTEFSQRVAEAVGQCALDQKLNREDITDIKEAIEKIKWTPKY

SEQ ID NO: 30103 - protein, 1067 aa, Legionella pneumophila str. Paris
MPKRTDIKSILILGAGPIVIGQACEFDYSGTQAVRALKEEGYRVILVNSNPATIMTDPELADATYIEPVQWKEVARIIEIERPDALLPTMGGQTALNCALDLVREGVLAKYSVEMIGATREAIDRAEDREKFRQLMIKIGLDMPRSAIAHSLEEAIQVQARLGFPAIIRPSFTMGGSGGGIAYNREEFEEICIRGLELSPTRELLIDESVLGWKEYEMEVVRDKNDNCIIVCTIENFDPMGVHTGDSITVAPAQTLTDKEYQRMRDAAIKVLRAVGVDTGGSNVQFAINPEDGRMLVVEMNPRVSRSSALASKATGFPIAKVAAKLAVGYTLDELKNEITGGKTPASFEPSIDYVVTKVPRFNFDKFPQTPDTLTTQMKSVGEVMAIGSNFQESLQKAIRGLEIGRCGLHSLFQKEDMARLRGHLREPTPDRLWYIADAFRQNLSLEEIHLESRVDPWFLAQIQELVLLERSIIGKTIRDLDKTTLHLMKHRGFADAYLAKLLGCTEAEVRARRVELEILPVYKRIDSCAGEFPSDTAYMYSCYEGSCEARPESNKKKIMILGGGPNRIGQGIEFDYCCVHAALSLRSAGYQTIMVNCNPETVSTDFDTSDRLYFEPVTLEDVLSIVAMEQPEGVIVHYGGQTPLKLARDLEANGVKIIGTSSDAIDMAEDRERFQQMVKELKLHQPDNGTVRSEAEAIELANKIGYPLVVRPSYVLGGRAMEIVYQEEDLRYYLSHAVEVSNDSPVLLDKFLNDAIEVDIDAVCDGKDVLIGAIMEHIEQAGIHSGDSACTLPPFSLGVVVQQDLIEQIRKMALKLGVVGLINAQFAIQADDIYVLEVNPRASRTVPFVSKATGLPLAKIAALCKVGISLKDQGLNQNHHAPSFYSIKLPVFPFIKFSGVDSILGPEMKSTGEVMGIAKRFGQAYAKAQLGAGCHIAKRRRAFVSVRDADKTRVGEIAKRLIELGFEIIATRGTALALQAAGVDCRRVFKVAEGRPHVLDFIKNNEIDFIVNTTEGKQAIADSFAIRRNALQHKVSYTTTLSGAEAACLAMKYEDRETVTRLQDLH

SEQ ID NO: 30104 - protein, 316 aa, Salmonella typhimurium LT2
MNQLDGIKQFTTVVADSGDIESIRHYQPQDATTNPSLLLKAAGLEQYGHLIEDAIAWGKKHGGTQEQQVAAASDKLAVNFGAEILKSIPGRVSTEVDARLSFDKEKSIEKARHLVDLYQQQGVDKSRILIKLAATWEGIRAAGQLEKEGINCNLTLLFSFAQARACAEAGVYLISPFVGRIYDWYQARSPLEPYVVEEDPGVKSVRNIYDYFKQHRYETIVMGASFRRTEQILALTGCDRLTISPNLLKELKEKEEPVIRKLVPSSQMFHRPTPMTEAEFRWEHNQDAMAVEKLSEGIRLFAVDQRKLEDLLAAKL

SEQ ID NO: 30105 - protein, 264 aa, Oryza sativa
  misc_feature (135)..(135): Xaa can be any naturally occurring amino acid
  unsure (1)..(264): unsure at all Xaa locations
QPSSPFKWRDMLHHSPVPLFHSPASSPASRSPSASWLAGRERERLFSSFVRNALGSCVDYAPVAALPLGVSAAVGVGAGELAFELDEHLSEAEPSCEPYARDLLAGAQARHRIFHDELVVKAFFEAERAHRGQVXLSMSLNLVPFVLCLCDQTRASGDPYLQHCVETAVLLAKIGANATVVSAGLLHDTIDDSFMDYDQIFRMFGAGVADLVEGVSKLSHLSKLARDNNTASRTVEADRLHTMFLAMADARAVLIKLADRLHNM

SEQ ID NO: 30106 - protein, 414 aa, Methanococcus maripaludis
MFLTLDDFELEGKTVALRVDINSPIDVNTGDILDDTRIKACSDTIKSLSEKGAKVVILAHQSRPGKKDFTTLEAHAKKLSEVLNMEVTHVDGLICASAREAILAMDNGEIILLENVRLLAEEVLSDWKSWEEITPEKQAKTVMIKKLHPFFDYFVNDAFAAAHRAQPSLVGFSYYVPMLCGRVMEKELFTLTKVLKNPERPCVFALGGAKADDSIEVLKNVLEKQTADQVLTSGVVANIFLVAKGYKIGPNENVIADMGYTNQIEIAKELISKYGDKIVVPIDAALNVDGERVEKELDLNEEITYPIHDMGEKTMKLYEEILKDAKTVVANGPAGVFENKNFLKGTEELLKSTANSKGFSVIGGGHLSAAAEVVGLAGKMDHISTGGGACIEFLAGKKLPVIEMLSKSYEKHKL

SEQ ID NO: 30107 - protein, 186 aa, Arabidopsis thaliana
MAFAATLFVPPPVAVRSPARFLGRLSIPCLLQVLPTNGAASPRQVKRAIVANASPGNGGVKAEEEDGVSLGTMKLPVDTDLARFETLLFQWANSLCQGANLPLPVPLKVDRISGGARLGFIVMEDEGKTDVPVYIDCLVFQTTENGVVFQATRNGRKKDKAPPGEERIMRSLLGALKKAVEIARVT

SEQ ID NO: 30108 - protein, 666 aa, Salmonella typhimurium LT2
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLGAQFNRPDHEIVDHYTYVFMGDGCLMEGISHEVCSLAGTLGLGKLIGFYDHNGISIDGETEGWFTDDTAKRFEAYHWHVVHDIDGHDPEAVKKAILEAQSVKDKPSLIICRTVIGFGSPNKAGKEESHGAALGEEEVALTRQKLGWHHPAFEIPKEIYRAWDGREKGEKAQQQWQEKFAAYEKAYPELAAEFTRRMSGGLPEAWESATQKFINDLQANPAKIATRKASQNTLNAYGPLLPELLGGSADLAPSNLTIWKGSTSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAIERQHGPTALILSRQNLAQVERTPEQVKAIARGGYILKDSGGKPDIILIATGSEMEITLQAAEKLTGEGHNVRVVSLPSTDIFDAQDEAYRESVLPAHVTARVAVEAGIADYWYKYVGLKGAIIGMTGYGESAPADKLFPYFGFTVENIVEKARRVLNIKG

SEQ ID NO: 30109 - protein, 515 aa, Coprinopsis cinerea okayama7#130
MLSVQTAVAKASLNRIPPLLSSVNVNNVAAKPSTSTLSNREALANATTKRRSHSMALAVNSPTEFFTSTIPSVTQRVKPIGFDEEPCTLGLQDGYSYARVEIGDRFGAQDRYEVVRKLGWGLYATTWLIKDRRDDAYHALKILNHYGTLLEAGEVDDPRRPRFFEREILARVSASDVAPGAKYCMKLLESFHIERETGKHLCLVMELGGMSVEDMRPLIGTNYSMPTAFVKTIVKQMCKALDYLHEECRVVHTDLKPSNILVTFSPKDTQELIDMTLKHRPVERYPPRRVLGETIRAMRSQPLPLPGFDQRNPLTWVFKLTDFGSAQWIGKRSATVVQPIRLRAPEVVLGHEWNEKIDIWSLGCLTFEFLTGRTLFRAQGGPHWRPEDDLLANQLELLSLTHFPSYFSQNSRYALYHLKEDGSLKNIPERMMYPKTLSEALARHKEAPINLDDTNKERDLALAFITRCLTLDPRDRPSAAQLLKHPWLRDFELGKPQPIPARMVLNSKRSRTVKF

SEQ ID NO: 30110 - protein, 657 aa, Staphylococcus aureus subsp. aureus MRSA252
MAKETFYITTPIYYPSGNLHIGHAYSTVAGDVIARYKRMQGYDVRYLTGTDEHGQKIQEKAQKAGKTEIEYLDEMIAGIKQLWAKLEISNDDFIRTTEERHKHVVEQVFERLLKQGDIYLGEYEGWYSVPDETYYTESQLVDPQYENGKIIGGKSPDSGHEVELVKEESYFFNISKYTDRLLEFYDQNPDFIQPPSRKNEMINNFIKPGLADLAVSRTSFNWGVHVPSNPKHVVYVWIDALVNYISALGYLSDDESLFNKYWPADIHLMAKEIVRFHSIIWPILLMALDLPLPKKVFAHGWILMKDGKMSKSKGNVVDPNILIDRYGLDATRYYLMRELPFGSDGVFTPEAFVERTNFDLANDLGNLVNRTISMINKYFDGELPAYQGPLHELDEEMEAMALETVKSYTESMESLQFSVALSTVWKFISRTNKYIDETTPWVLAKDDSQKDMLGNVMAHLVENIRYAAVLLRPFLTHAPKEIFEQLNINNPQFMEFSSLEQYGVLTEPIMVTGQPKPIFPRLDSEAEIAYIKESMQPPATEEEKEEIPSKPQIDIKDFDKVEIKAATIIDAEHVKKSDKLLKIQVDLDSEQRQIVSGIAKFYTPDDIIGKKVAVVTNLKPAKLMGQKSEGMILSAEKDGVLTLVSLPSAIPNGAVIK

SEQ ID NO: 30111 - protein, 451 aa, Ustilago maydis 521
MASNFASNFDTLQLHAGQEVDPATNALAVPIYANSSFAFNDSAHGADLFGLRKFGNIYSRLMNPTNDVFEKRIAALEGGAAALATSSGQAAQGMVVMGLCGSGDNIVSSSYLYGGTYNAWANLFPRLGITTKFVKSESPEAYAAAIDAKTKAIYIESIANPKYIVHDIAALAKVAHDHGIPLIVDNTFGAGGYLVRPIEHGADVVVHSATKWIGGHGTTIGGVIIDSGKFDWSKSGKFPQFTEPSAGYHGLKFWDTFGPITFAIYLRVVILRDLGPCQNPFGSFLLLQGLETLSLRVGRIVENALALAQWLEAHPQVSWVSYPGLKSHPSHEIAKKYLQRGFGGVLSFGIKGDAATGSAFVDSLKLATNLANVGDAKTLIIHPASTTHQQLSDEDQLSSGVTKDLIRVSVGYEWIEDIKADFAQAFEKTSGVKGNVASGQTGPAPGLSGSV

SEQ ID NO: 30112 - protein, 487 aa, Arabidopsis thaliana
MQPWRRKFPLFETGVTMKQRKNSNLSIFVVVFSVFLFGIFMYNEDVKSIAEFPFSTSKPHDVHDEATPITEITTLPVQESIKNSDPIQESIKNADSVQDSVKDVAEPVQEEVSKTEEVKKIELFAATEDEEDVELPPEECDLFTGEWVFDNETHPLYKEDQCEFLTAQVTCMRNGRRDSLYQNWRWQPRDCSLPKFKAKLLLEKLRNKRMMFVGDSLNRNQWESMVCLVQSVVPPGRKSLNKTGSLSVFRVEDYNATVEFYWAPFLVESNSDDPNMHSILNRIIMPESIEKHGVNWKGVDFLVFNTYIWWMNTFAMKVLRGSFDKGDTEYEEIERPVAYRRVIRTWGDWVERNIDPLRTTVFFASMSPLHIKSLDWENPDGIKCALETTPILNMSMPFSVGTDYRLFSVAENVTHSLNVPVYFLNITKLSEYRKDAHTSVHTIRQGKMLTPEQQADPNTYADCIHWCLPGLPDTWNEFLYTRIISRS

SEQ ID NO: 30113 - protein, 368 aa, Selaginella apoda
  misc_feature (216)..(216): Xaa can be any naturally occurring amino acid
  unsure (1)..(368): unsure at all Xaa locations
LVCDNGSGMVKAGFAGDDAPRAVFPSIVGRPKHTGVMVGMGQKDAYVGDEAQSKRGIQALKYPIEHGIVTNWDDMEKIWHHTFYNELRIAPEEHPVLLTEAPLNPKANREKMTQIMFETFNVPAMYVAIQAVLSLYASGRTTGIVLDSGDGVKHTVPIYEGNAMPHGIFRLDLAGRELTDCLMKILTERGYTFTTTAEREIVRDMKEKLAYVALEXEQEIESAKNSSSLEKTFELSDGQVITIGSERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWIAKSEYDDSGPSIVHRKCF

SEQ ID NO: 30114 - protein, 368 aa, Selaginella apoda
  misc_feature (138)..(138): Xaa can be any naturally occurring amino acid
  misc_feature (148)..(148): Xaa can be any naturally occurring amino acid
  misc_feature (169)..(169): Xaa can be any naturally occurring amino acid
  unsure (1)..(368): unsure at all Xaa locations
LVCDNGSGMVKAGFAGDDAPRAVFPSIVGRPRHTGVMVGMGQKDAYVGDEAQSKRGILTLKYPIEHGIVTNWDDMEKIWHHTFYNKLRVAPEEHPVLLTEAPLNPKANREKMTQIMFETFNVPAMYVAIQAVLSLYAXGRTTGIVLDXGDGVTHTVPIYEGYALPHAIXRLDLAGRDLTDALMKILTERGYSFTTTAEREIVRDVKEKLAYVALDFEQELETAKSSSSIEKSYELPDGQVITIGSERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWIAKTEYDESGPSIVHRKCF

SEQ ID NO: 30115 - protein, 306 aa, Vibrio parahaemolyticus RIMD 2210633
MKPTAEILTDILAEVRPLIGQGKVADYIPALAKVPNNKLAIAVYTNEGEVIKAGDADESFSIQSISKALSLTLAMCLYKQEEIWARVGKEPSGQAFNSLIQLEMEQGIPRNPFINAGAIVVADLLQSRLSAPRQRLLEFVRQLSGDTHIVYDKVVAASEMMHGDRNAAIAYLMRSFGNFENEVIPVLQNYFHACALKMSCVDLAKTFSYLANKGTSVQTGKPVVSPTQTKQLNALLATCGLYDGAGEFAYRVGMPGKSGVGGGIIAVVPGEMTIAVWSPELDASGNSLAGTKALELLSERIGRSIF

SEQ ID NO: 30116 - protein, 304 aa, Oryza sativa (japonica cultivar-group)
RSYCTEVKTVSVLTAARLTPNGPNIGVFICLKCSGVHRSLGTHISKVLSVTLDQWSDNEIDNVIEVGGNSHANAIYETFLPQNHSKPHPDSTQEEREKFIRSKYELQEFLEPSLRIVSHQSSDSGKHAGSASHSVSSKSEVGMIEFIGILNVKVKGGTNLAIRDMSSSDPYVVLTLGQQKAQTSVIKANLNPVWNEELKLSVPQQYGPLKLQVFDHDMLSKDDLMGEAEIDLQPMINAAAAFGDPGLLGDRQIGRWLKSGDNALVRDSAVVVAGGEVRQELALKLQFTESGEVELEMQWFPLNM

SEQ ID NO: 30117 - protein, 551 aa, marine gamma proteobacterium HTCC2207
MNNVTSISEPSFSELSFSELSFSQQKLIELNAEDGFASLVDGFNRASEKFSERPAFTCLGQTLCFSEIEQLSRQFGCYLLEHCGLGAGDRVAVQLPNISQFPIAIWGILRAGLVVVNTNPMYTAREQLHQFNDSGAKALVVLSDLLPVTEQVIPQTGVETVIATSAIDLLQPQPLPASSLSNLVSFTDALALGADKQLPERSSSMSDVAVLQYTGGTTGPSKGAILTHGNIFGGVRMSKVSVDFSDEEVPDLLIAPMPLYHVFGFTMNAVSGFLGGSHSVLIPNARDIDSMVATMKQHPLTTMAGITTLLQGLMRHPQFDEIDFSRLKGIVVGGAALVKEVGDEWEARTGAPVFEGYGLSETTAVLTCNGPDKSRLGTVGLPMLFQEVKLIDVEGNAVATGERGEVCCRGAHVMQGYWNRPDATAEALDADGWFRTGDIGVMAEDGMLTIVDRLKDMVIVSGFNVYPNEIEDVAYGHGDIIECAVVGVADERTGEAVKLFVVSTNPDLSEQQVKDFCREQLTAYKVPKHVAFMDELPKSPVGKILRRELRD

SEQ ID NO: 30118 - protein, 366 aa, Cosmarium botrytis
QDNGSGMVKAGFAGDDAPRAVFPSIVGRPRHQGVMVGMGQKDAYVGDEAQSKRGILTLKYPIEHGIVTNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTEYLVTILTERGYSFTTSAEKEIVRDIKEKLAYVALDYEQEMSTAKSSSSLEKTYELPDGQEITLGSERFRCPEVLFNPSLVGKEAAGIHETCYNCIMKCDVDIRKDLYGNIVLSGGTTMFPGIADRMTKEITALAPNSMKIKVVAPPERKYSVWIGGSILASLSTFQQMWIAKGEYDESGPSIVHSKCF

SEQ ID NO: 30119 - protein, 170 aa, Glycine max
PWTCPGDDVFYNASIIWGVVGPKRMFTKDGVYPGMNWFFLIGLLAPLPVWLLSNKFPNHKWIQLINFPIIIAGASNIPPFRSVSYITWGIVGIFFNFYVYRKFKASWARHTYILSAALDAGVAFMGVALYFALQSNGIFGPTWWGLDADHCHLAKCPTAPDVHAKGCPLL

SEQ ID NO: 30120 - protein, 309 aa, Oceanospirillum sp. MED92
MDLGERIQSLYAKYGSLKGITIELHKQLIAVSVRNEAASATIFLQGAQLAEYKRAGEHPLIWLSDQCDYQSGTPLRGGIPICWPWFGDLSRNPKAVKNQICGSDQPAHGFVRDREWELIAVELPDTETTRITLKLEVAADEIWKFPAALRVIITVGTELSLQFQVTNLGAEPFSFSHALHAYFNIGDIEGVRVEGLEGYDYLDTLDNWTLKKSNFPLQINAEVDRVYPDVAKELRITDRKLNRTIKIEAMNLSDLVVWNPWIDKSKRLSHFGETDYTQMLCLESARLLDNIVCLTANETYKCTVRYSFN

SEQ ID NO: 30121 - protein, 127 aa, Zea mays
MATRVLLTALLLAFLLVATPFTARVARADSEEDAAAAEVVEGADLGIVGDDTQVSSDGPLSPAPGVETVVVFPKNAGKIVLAGEETELLVGLQNEGNHNFSSHFFSLCCTGINFLLYTIQLFAGGSC

SEQ ID NO: 30122 - protein, 57 aa, Zea mays
  misc_feature (24)..(24): Xaa can be any naturally occurring amino acid
  unsure (1)..(57): unsure at all Xaa locations
SDVPAHWTGCWYAWLDVIFSDVAXPYQAMILALNASYFLKNGGHFVISIRANCHRLH

SEQ ID NO: 30123 - protein, 206 aa, Triticum aestivum
  misc_feature (19)..(19): Xaa can be any naturally occurring amino acid
  unsure (1)..(206): unsure at all Xaa locations
PGRPRVRDLSGSPVALASXVTPFVASPGTDRVSRSNPGAWLILRPAGDGAWEPWGRLECWRERGGAGSSDSLGYRFDLLVPGVDHAVPIADSTIAASKGGKFALDLTAAQPLSRGSTPGCSPRGSGDFSQWPLGNYRGFVMSASVEGEGRCSKPTVEVGVAHVGCAEDAAAFVALAAAVDLSMDACRLFSHKLRKELSHLRSDVLR

SEQ ID NO: 30124 - protein, 394 aa, Leucaena leucocephala
RILPKGKLSGGINQEGIKYYNNLINELLANGLKPFVTLFHWDLPQALEDEYGGFLSSDIVKDYGDYAELCFKEFGDRVKHWITLNEPWTYSNGGYAMGQQAPGRCSAWLRLNCTGGDSSTEPYLVAHHLLLSHASAVQIYKSKFQASQKGVIGITLVCHWFVPLSDKKSDQNAAARAVDFMFGWFMGPLTEGEYPKSMRALVGSRLPKFSRKNPSLVKGSFDFLGLNYYTANYAANAPSLRNARPSYQTDSHANLTTERNGTPIGPRAASDWLYVYPRGIRDLLLYVKTKYNNPLIYITENGIDEFDDPTLTLEEALIDTFRIDYYFRHLYYLQSAIKDGANVKGYFAWSLLDNFEWASGYTVRFGINFVDYKHGNQRYHKLSAQWFRNFLQKY

SEQ ID NO: 30125 - protein, 223 aa, Zea mays
  misc_feature (80)..(80): Xaa can be any naturally occurring amino acid
  unsure (1)..(223): unsure at all Xaa locations
MASMLARRSLNTLRTRHLVLSGKALQGSHLSGLQSRAISYGSKKDDEEEEQLAKEISKDWNTVFERSINTLFLTEMVRGXLSLTLKYFFDPKVTINYPFEKGPLSPRFRGEHALRRYPTGEERCIACKLCEAVCPAQAITIEAEEREDGSRRTTRYDIDMTKCIYCGFCQEACPVDAIVEGPNFEFPTETHEELLYDKEKLLENGDRWETEIAENLKSESLYR

SEQ ID NO: 30126 - protein, 1009 aa, Oryza sativa (japonica cultivar-group)
MLGGLKDKLTGKNGNKIKGLAVLMSRKLLDPRDFTASLLDNVHEVFGNSITCQLVSATVADQNNEGRGIVGSEANLEQGLTDLPSVSQGESKLTVRFNWEMDKHGVPGAIIIKNHHSTKFFLKTITLHDVPGCDTIVFVANSWIYPVGKYHYNRIFFANNSYLPSQMPEALRPYREDELRYLRGEDRQGPYQEHDRIYRYDVYNDLGEPDRDNPRPVLGGSQKHPYPRRGRTGRIPTKKDPNSESRLSLLEQIYVPSDERFAHLKMSDFAGYSIKAIVQGILPAIRTYVDLTPGEFDSFEDILKLYRGGLKLPSIPALEELRKSFPVQLIKDLLPSYLPSQMPEALRPYREDELRYLRGEDRQGPYQEHDRIYRYDVYNDLGEPDRDNPRPVLGGSQKHPYPRRGRTGRIPTKKDPNSESRLSLLEQIYVPSDERFAHLKMSDFAGYSIKAIVQGILPAIRTYVDLTPGEFDSFEDILKLYRGGLKLPSIPALEELRKSFPVQLIKDLLSVGGSYCSSSPNLISSKEFPPKSTLDPSKYGDQTSTITPAHIEKNLEGLSVQQALDSNRLYILDHHDHFMPFLIDINSLDGIFTYATRTLLFLRDDDTLKPLAIELSLPHIEGNLTSAKSKVHTPASSGIESWVWQLAKAYVAVNDSGWHQLISHWLNTHAVMEPFVIATNRQLSVTHPVYKLLQPHYRDTMTINALARQTLINGGGIFEQTVFPGKHALAMSSAVYKNWNFTEQGLPDDLIKRGIAIKDPSSPSKVKLLIKDYPYATDGLAIWQAIEQWVTEYCAIYYPNDGVLQGDVELQAWWKEVREVGHGDLKDADWWPKMQSLPELTKACTTIIWIASALHAAVNFGQYPYAGYLPNRPTISRRPMPEPGSKEYTELDENPEKFFIRTITSQFQTILGVSLIEILSKHSADEIYLGQRDTPEWTSDPKALEAFKRFSRQLVEIESKVLNMNKDPLLKNRVGPANFPYTLMFPNTSDNKGAAEGITARGIPNSISI

SEQ ID NO: 30127 - protein, 192 aa, Glycine max
RTRGLEITVQFAKYGPNAERIFSNCSHKGRIIETSPRSRRSRSRSPRKRHRDDYRDRDYRRRSRSRSYDRYERDRHRGRDKDYRRRSRSRSASLDYKGRGRGRYDDERNSRSRSRSVDSRSPARRSPSPRRSPSPQRSTSPQRSTSPRKSPRGESPANRSREERSPTPRSVSPRGRPDASRSPSPRNSNGDE

SEQ ID NO: 30128 - protein, 247 aa, Zea mays
IFDCFFLRCKLFVHSQQSVAELKQALLATTLELEAAREELRRKEQSIAKLAGLVREVARERDDARDQLQSLRLLAAQAAAAAPPLVTSSVTDSDGSLASSPADPFFDPVTSADRRCKLSPATPPAPPPKPVQQRHCQPGACGRGSAPAADAVLETLASKRPLPQRGRLLAAVMEAGPLLQNLLVAGQLPRWRNPPTVRAPDTTLPLGAATLASTACMKRPVAAAAMSVLPAASCPPAFIAKRQRLLH

SEQ ID NO: 30129 - protein, 82 aa, Brassica napus
MQDQLVCHGCRNTLLYPRGATNVRCALCNTINMVPLHPPPPPPHHHAHAGMDMAHIVCGGCRTMLMYTRGASSVRCSCCQTV

SEQ ID NO: 30130 - protein, 136 aa, Zea mays
MSGRGKGGKGLGKGGAKRHRKVLRDNIQGITKPAIRRLARRGGVKRISGLIYEETRGVLKIFLENVIRDAVTYTEHARLLPSIQSPLSPPARVVDLARAAAVASSTPETASACFGLRVSVQDDCWRASTSPCTRPT

SEQ ID NO: 30131 - protein, 957 aa, Klebsiella pneumoniae
MTKPVLVLVGHGMVGHHFLEQCVSRDLHQQYRIVVFCEERYAAYDRVELTEYFAGRSAESLSLVEGDFFTQHGIELRLSESVASIDREARVVRDAFGHETHWDKLVLATGSYPFVPPVPGHNLEGCFVYRTLDDLDQIAARAATARRGVVIGGGLLGLEAANALKQLGLETHVVEFAPNLMAVQLDNGGAAMLREKISELGVGVHTSKATTEIVRNEQGLQLNFRDGSSLATDMLVFSAGIRPQDALARSGGLSVGERGGICIDNQCRTSDPDVLAIGECALWENKIYGLVAPGYQMAARRAATLAGEAGSFSGADMSTKLKLLGVDVASFGDAQGRTPGCQSYQWTHGPQQVYKKIVVSADGKNLLGGVLVGDAGDYATLLQMMLNGMALPKHPESLILPALEGSRPKALGVAALPDGAQICSCHNVSKGDICQAVSGGAGDMAAIKSRTKAATGCGGCSALVKQVMEYQLAEQGVEVKKDICEHFPWSRQEIYHLVRVNHIRTFEQLIARYGQGHGCEVCKPLVASVLASCWNEYLLKPAHLPLQDTNDRYFANIQKDGTYSVVPRMAAGEVTPDGLIAIGQIAKRYQLYSKVTGGQRIDLFGARLEQLPAIWRELAEAGFETGHAYGKSLRTVKSCVGSTWCRYGVQDSTGLAVTLEHRYKGLRAPHKIKMAVSGCTRECAEAQGKDIGVIATEKGWNLYVCGNGGMKPRHADLFASDLDEATLIRSIDRLLMFYIRTADRLQRTSTWMDNLEGGVDYLREMILEDSLGIGEELEQEMARVVESYQCEWQTTLNDPQRLALFRSYVNSDEPDETVQRQTLRGQPQLAPFAAQGEPALPSRPWQAICDLDAIPQQAGIGARLGERQIALFRFGDQVYALDNLEPGSEANVLSRGLLGDAGGEPIVISPLYKQRIRLRDGRQCDGGEQAVRAWPVKVENGKVWVGNQQLLARAEAS

SEQ ID NO: 30132 - protein, 56 aa, Glycine max
FETFVSPFPNSAFLPKFFLLGGGSPPACFRAPASGGIFPIKKGPQLPPKFGPLGKI

SEQ ID NO: 30133 - protein, 624 aa, Methylococcus capsulatus str. Bath
MSAIPQEILHEAVTAKKASIQPFAASEKVYLQGSRPDLRVPMRKISQSDTPTNTGREKNPPVYVYDTSGPYTDPTVSVDLRLGLPPLREPWIEERGDTELLKGPSSSYGLQRQRDPALASLRFEHIRAPRRAKGGANVTQMHYARQGIITPEMEFVAIRENQKLEALAETYKFQHPGEAFGAAIPQVITPEFVRDEVARGRAIIPSNINHPESEPMIIGRNFLVKINCNLGNSAVSSSIEEEVEKMLWAIRWGGDTVMDLSTGKNIHETREWIIRNSPVPIGTVPIYQALEKVDGKAEELTWEIFRDTLIEQAEQGVDYFTIHAGIRLPFIPLTAKRTTGIVSRGGSIMAKWCLAHHKESFLYTHFEDICEIMKAYDVAFSLGDGLRPGSIADANDEAQFAELRTLGELTRIAWKHDVQVMIEGPGHVPMHMIKANMEEQLKHCHEAPFYTLGPLTTDIAPGYDHITSAIGAAMIGWYGTAMLCYVTPKEHLGLPNKQDVRDGIIAYKIAAHAADLAKGHPGAQARDNALSKARFEFRWQDQFNLSLDPEKALEFHDETLPQEGAKQAHFCSMCGPHFCSMKITQDVRDYAREHGLDEAQALAKGMEEKSDEFVRSGAEVYQRT

SEQ ID NO: 30134 - protein, 455 aa, Oceanobacillus iheyensis HTE831
MKVAVIGCTHAGTTAIKNIVNLYPDAEIDVLERNDNVSFLSCGIALSVGGVVENPEDLFYASVPQFERLGVRMHMNHDVISCDVTAKQLQAKDLKTDTIKNYSYDKLIIASGSWPITPPIPGADLENVLLCKNYDHAKEIINRSASVRNVVVVGAGYIGVELVEAFEENGKNVTLIDSEERILNRYLDDIFTEPVEASFEQRGVQLALGQTVSQFEGEETVEKVITDKGEYAADLVVMCIGFRPNTGLFNNQLDMLGNGAIVVDAYMQTSVKDVFAAGDCCAIYNNATKQSAYIPLATNAVRMGTLVAHNLVRPVMAHPGTQGTSGLKLYHHNIASTGLTESAASLSGVSVDSVVYKDNYRPDFMPENAEIQLKLVYETETHRIVGAQVISDADFTQAINTISVGIANNMTVEQLALTDFFFQPHYNKPVNFLNEVALKAMAKKAGKTQKQAVLS

SEQ ID NO: 30135 - protein, 789 aa, Oceanospirillum sp. MED92
MQNYVLRLDQVGMNDVERVGGKNASLGEMLQELTGANVKVPNGFATTADAYRDFLAHGGLEEKINAKLHELDTNDIQALTDAGKTIRNWVMEADFQPELDAAIETYWAEISADNANLAVAVRSSATAEDLPDASFAGQQETFLNVRGLANVKHAIKEVFASLYNDRAISYRVHHGFEHSEVALSAGIQRMVRSETGSSGVMFTLDTESGFNHVVFITSAYGLGETVVQGAVNPDEFYVYKPTLKMNAPAIIRKTLGSKAIKMVYSEPGSENPVATVDVDMAQRNEFSINDDDVQQLARIALEIEAHYGRPMDIEWAKDGDTGELFVVQARPETVKSRSNQAVIERYLLKETSEVLVEGRSIGHKIGSGHVRIVHDLSEMETVQPGEVLVTDMTDPDWEPVMKRASAIVTNRGGRTCHAAIIARELGIPAIVGCGDATEQFVNGQLVTVSCAEGDTGRVYAGKLDYEHQSNSVEQMPDLPFEIMMNVGNPDRAFDFQALPNAGVGLARLEFIINRMIGVHPKALLNFDTQPPALQQTISRRIAGYDSPVDFYVDRLVEGISTLAAAFYPKKVIVRMSDFKSNEYGHLIGGESFEPSEENPMLGFRGAARYISESFRDCFELECRALKRVRDEMMLTNVEVMIPFVRTPGEAKQVVDLLAQNGLKRGENGLRVIMMCEIPSNALLADEFLEHFDGFSIGSNDLTQLTLGLDRDSGVIAHLFDERNEAVKKLLSMAINACKKQGKYIGICGQGPSDHPDLARWLMEQGISTVSLNPDSVLDTWFFLANNDEE

SEQ ID NO: 30136 - protein, 322 aa, Legionella pneumophila str. Paris
MTIDRIRELVSEDFNAVNNLIIDKIQSQVGLIQDLSQHIVESGGKRLRPLVVLLASNACGYKGKDHISLAAMVEFFHTATLLHDDVIDESTLRRGRQTANSIWGSKASVLVGDYLFTQSVNLMVEVGIKEILNLLANTSHQITCGEVKQLANRHNPALTLDDYFDVIRAKTALLFAAAACIGPILTNAPIEIRDSLYNYGLHLGNAFQLIDDALDYCSDAATLGKNIGDDLADGKATLPLIHALQNGNATQQQQIRESLMKGSLSHLPDILIAIEQTEAIPFTKRIAAQEVDSALSALEILPDSVYKEALVDLAKFALERNY

SEQ ID NO: 30137 - protein, 413 aa, Novosphingobium aromaticivorans DSM 12444
MRRSCRVHSTSNQTVDEEFYRMKRLPPYVIAEVNGMRAAARAAGRDIIDLGMGNPDLPPPQHVIDKLCEVAQKPDAHGYSASSGIPGVRKAQANYYGRRFNVDLDPETEVVMTMGSKEGLASLATAITAPGDVVLAPNPSYPIHTFGFIIAGATIRSVPTTPDERYWDSLDRAMKYSVPRPSILIVNYPSNPTAETVDLAFYERLVAWAKENKVWILSDLAYSELYYDGNPTRSILEVPGAKDVAVEFTSMSKTFSMAGWRVGFAVGNQRLIAALKRVKSYLDYGAFTPIQAAACAALNGPQDIVVKNRELYQKRRDVMVEAFGRAGWEIPSPSASMFAWAPLPPALTHLGSLEFSKQLLTHAEVAVAPGVGYGEDGEGFVRIAMVENEQRLRQAARNIKRYLQSMGVNASAA

SEQ ID NO: 30138 - protein, 298 aa, Cryptococcus neoformans var. neoformans JEC21
MSLDNYQKIEKVGEGTYGVVYKAKDINTGHIVALKKIRLEAEDEGVPSTSIREISLLKELSKDDNIVKLLDIVHSEAKLYLVFEFLDMDLKKYMDTIGEKDGLGPDMVKKFSYQLVKGLYYCHGHRILHRDLKPQNLLINKSGDLKIGDFGLARAFGIPLRTYTHEVVTLWYRAPEVLLGSRHYSTAIDMWSVGCIVAEMATRQPLFPGDSEIDEIFRIFRVLGTPDEDVWPGVRGLPDYKPTFPQWHPVELADVVKGFEADGLDLIAQTLVYDPAHRISAKRALQHPYFDTVNLSAA

SEQ ID NO: 30139 - protein, 311 aa, Solanum lycopersicum
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGLSKTRPQLYQTTDVKGTFGYIDPEYFIKGRLTEKSDVYSFGVVLFEVLCARSAMVQSLPREMVNLAEWAVESHNNGQLEQIVDPNLADKIRPESLRKFGETAVKCLALSSEDRPSMGDVLWKLEYALRLQESVI

SEQ ID NO: 30140 - protein, 137 aa, Gossypium hirsutum
MGSKRTASLALFFALNILFFSLVSACGSCPSPNPKPKPKPKPNPTPSPSSSGKCPRDALKLGVCADLLGGLLNVTIGTPPVQPCCSLIQGLADLEAAVCLCTAIKANILGINLNVPLSLSLLLNVCSKKVPSGFQCR

SEQ ID NO: 30141 - protein, 202 aa, Triticum aestivum
  misc_feature (189)..(189): Xaa can be any naturally occurring amino acid
  unsure (1)..(202): unsure at all Xaa locations
LSLGRAMTWAEAAWFRYSVATPDYYLYCHHIVIFLVVYTLAPLPLAVLQLRAPAILLPYKLQPRVRLKPAAFLRCYVRTVRVFLLAMGPVQLLSFPAVKMVGIRTGLPLPSAGETAAQLAVYLLLEDYLGYWVHRLLHTKWGYEKIHHVHHEFTAPVGYVGLYAHWSDVLIIGFPVFVGPAVVPWHMNXLWLWFVIPQLALL

SEQ ID NO: 30142 - protein, 454 aa, Burkholderia thailandensis E264
MKNLQRHLSARHIRFLALGSAIGTGLFYGSASAIRLAGPAVILAYIVGGAAVYMVMRALGEMAVREPVPGSFGHYASENLGPFAGFVTGWTYTLEMVIVAIADITAFGIYMGFWFPDVPQWIWVLAIVAIICGLNLCHVKVFGELEFWLSIVKVGAIVAMIGGGAAILFSGMKLGSGGAPALANLWSHGGFLPNGVGGLVASLSVVIFAYGGIEVIGMSAGEAKEPERVIPRAINAVPMRILLFYVLTMVVLMSIFPWTGVGANGSPFVQIFSALGVRSAAEILNLVVISAAISAINSDIFGAGRMMYGMALQGQAPRALASMSARGVPWVTVLVMAGALLVGVVLNYLMPKDVFLMVAAIATFATVWVWLMILLSQVAMRRRLSAAETAALKFKVPFWPIGPAITIAFMAFVIAMLGYFDDTRIALFVGAAWLALLTLVFYTRVRPRLAAVAR

SEQ ID NO: 30143 - protein, 531 aa, Burkholderia thailandensis E264
MILPTDSPPHLSLELLDAPPIHASEPLLSVAELRDIETAAAAALPPHTLMERAGKSAAQWLAGRLVSDPRPVWFAVGPGNNGGDALVAAAELRRLGFTADVWMPVEVKPEDARWALERARAANVPIDEAAPESFDGYGWLVDGLFGIGLARPLDGAFAAIAQRIAARARRTGRVLALDVPSGLDSDTGTRVGGASAVAATDTLSFIAAKPGLYTGDGRDLAGEIHVAPLDLGEPPAPAIRLNAPELFDARLPERAFASHKGTYGSIAIVGGDTGMCGAPILAARAALFAGAGKVHVGFVGAGAPPYDPPYPELMLHPVDALPAASLTALAIGCGLGASERAARVLAALLPLEAPKLVDADALNLIATTPALADALAARGRAGDAAVLTPHPLEAARLLATDAADVQRDRVAAARALAARFSAVVVLKGSGTVIAAPDGRVAINPTGNAALATGGTGDVLGGLIGAFLAQRMPRYEAALAGVYLHGLAAEQLCAAGAGPAGLAAGELAPAVRTLVNRLFYTRPATPGEAPLY

SEQ ID NO: 30144 - protein, 320 aa, Solanum lycopersicum
MGSKYSKATNSINDASNLSYGIPFENYRVPFVDLEEATNNFDDKFFIGEGGFGKVYRGVLRDGTKVALKKHKRESSQGIEEFETEIEILSFCSHPHLVSLIGFCDERNEMILIYDYMENGNLKSHLYGSDLPTMSMSWEQRLEICIGAARGLHYLHTNGVIHRDVKCTNILLDENFVPKITDFGISKTMPELDLTHLSTVVRGNIGYIAPEYALWGQLTEKSDVYSFGVVLFEVLCARPALYLSEMMSSDDETQKMGQLEQIVDPAIAAKIRPESLRMFGETAMKCLAPSSKNRPSMGDVLWKLEYALCLQEPTIQDDPE

SEQ ID NO: 30145 - protein, 500 aa, Gibberella zeae PH-1
MSDLYVNLEAPNGVKYRQPTGLFINNEFVPGSSTQKITSIDPATEKEIATVHAANADDVDKAVKAAYDAFRNPSWKKLPPPQRGVLMNKLADYIEERTKIFATSEAWDNGKVYTDAEGGDVVEVINTIRYYAGWADKITGQTITANPNKLAYTLRQPLGVVAQIIPWNYPLAMAAWKIGPALACGNTIVMKAAEQTPLSILLLGEAIKAVGFPPGVFNALNGYGSEAGPALVEHPLVDKVAFTGSTATGARIMEMASKTLKNITLETGGKSPLLVFSDSDIDEAVKWSHMGIMSNQGQICTATSRLLVQDKVYDEFVQRFIETTKTVSKVGHQWDSETYQGPQVSKQQYDRILEYIQIGKSEGATLLAGGQPVDSSKKGFFIQPTVFGDVHHQMRVFREEIFGPVVVITKFSDEAEALKLANDTTYGLGAAVFTKDVERAHRVAAEIEAGMVWINSTQDSEPYIPFGGVKQSGIGRELGEAGLEAYSNTKSIHVNLGSRL

SEQ ID NO: 30146 - protein, 494 aa, Gibberella zeae PH-1
MAENYHKEVISGLKNKSLFIQDAFINGQWVAKENKFDVFEPSTATVLGQVANCALEDFQTAIKSADVAQTKYFDSTTGASRGAMLRKWYDLVLANQEDLAKILSLENGKTYSEALGEVIYSASFISWFAEEATRSYGVTIPSSAPHTTLMTIREPVGVCGIITPWNFPAAMITRKIAPALAAGCSVVIKPPSETPYSALAFTKLAIEAGLPPATIQVLPTRDRQAATELATNPLVKKISFTGSTGVGKYLAKLAAGTLKKLSLELGGNAPFIVFEDADLDLAAEGAMFCKFRCSGQTCVCANRLYVQKSVAKEFTAKLVEKVNALKMGGGLDKTTTQGPLVNKSAIDKVKEHIADATSKGAKIATGGSTPDSPGFFHQPTVLTGVTQEMAVAKDETFGPLAPVFEFDTEEDAIRLANDTEFGLAGYFFSKDISRVMRVAHKMQVGMVGANTGKISAAEAPFGGVKESGYGKEGSLYGMAEYQNIKSITIGNLNN

SEQ ID NO: 30147 - protein, 458 aa, Geobacillus stearothermophilus
MSGPNDIDEAVQAAKEAQRQWALVPAPKRAEILYKVGMLLKERKEQLARLLTMEMGKVIEEARGEVQEGIDMAFYMAGEGRRLFGDTTPSELKDKFAMSVRTPVGVVGIITPWNFPIAIATWKSFPAIVAGNAVVWKPAPETPIMAQELARIFEEAGLPPGVFHVVHGDGPTVGNALVEHPDVKVISFTGSNEVGRMIAEKCGRLLKKVSLEMGGKNAVIVMDDADLTLAVDGIIWSAFGTSGQRCTACSRVIVHERVKQEFERRLLEAVKTLKIGNGLDETVKVGPVIHEEALQKIDRYVRIGVEEGAKLLVGGYILREGDYARGFYYAPTIFTDVTPNMRIAREEIFGPVVSIISVRSLDEAIAVNNSVDYGLSSAIFTRDVNNVFRAMRDLDTGIVYVNAGTTGAEIHLPFGGTKGTGNGHRDSGVAALDVFTEWRSIYVDFSGKLQRAQIDTDD

SEQ ID NO: 30148 - protein, 385 aa, Geobacillus stearothermophilus
MKVLVLGAGLMGKEAARDLVQSQDVEAVTLADVDLAKAEQTVRQLHSKKLAAVRVDAGDPQQLAAAMKGHDVVVNALFYQFNETVAKTAIETGVHSVDLGGHIGHITDRVLELHERAQAAGVTIIPDLGVAPGMINILSGYGASQLDEVESILLYVGGIPVRPEPPLEYNHVFSLEGLLDHYTDPALIIRNGQKQEVPSLSEVEPIYFDRFGPLEAFHTSGGTSTLSRSFPNLKRLEYKTIRYRGHAEKCKLLVDLTLTRHDVEVEINGCRVKPRDVLLSVLKPLLDLKGKDDVVLLRVIVGGRKDGKETVLEYETVTFNDRENKVTAMARTTAYTISAVAQLIGRGVITKRGVYPPEQIVPGDVYMDEMKKRGVLISEKRTVHS

SEQ ID NO: 30149 - protein, 531 aa, Prosthecochloris aestuarii DSM 271
MDAILTAEEMALADRAAIATLRTSETRLMELAGREASKILGRHLTGSEDESLDGFHFLIVCGKGNNGGDGFVLARHLINRNATVDIVLLYPPETLAAVNREGFAILEAYAEHCDALTICHSHDEALPSLAENSYDAVIDAVLGTGLHIERDDEPLRSPVREGIELINTIRERTSAVSVALDLPSGLDATTGCAAAPAVEADMTITMAYRKTGFFFRNGPRLSGEVVTAEISIPSFLVKECACRLTDSAFAAETFTLRETSSAKHTNGKVLIIAGSSSPSSSMTGAAILATRAAIACGAGYVCVSLPEGMATALHIAAPSATVIGRNVDDIIEKAAWADSILIGCGMGRAPETIDLITKLCESPEISNTKLVLDADALYAIASSARERRSRTFFDAILTPHAGEFSRLSGYSAHDIRENPLDIIRSYSAEQQINLLLKGNPTLIANPSGKILINQSGTEALATAGTGDLLSGMIAAISAKGPDTWNAAAAAAWFHGRAGDLANDISSLVSSEDVLTAIPDAIAEIFFAEEEE

SEQ ID NO: 30150 - protein, 784 aa, Magnaporthe grisea 70-15
MAQEAPKITDIGVPLEQVSDVREVGPEAEAITQVRMVRANSEASSLSDMEKKSSSTVEVKHQESTRSSTDVEDNGREKVSANMEVVALKALHTDDDPTQNPWTFRAFFLGLALAAFGSSLATSISITFLTVISYVFGNAMARYIPSKGPIGRFLNPHGFNSKEHMGIIIMASSASSTAHATDVLAAQKLFYNIVPHPAVAIMLLFSSQLLGYGLAGYLRESLVYPTAMIWPSQLPLASLIETLHRNRTEMASRWKFFWIIFWSIAVYEFFPQYITPVLTGVSVFCLAQQKNHMFTNIFGGAAGNEGLGVGALSFDLQYIGVSAFFLPLKMITNAFIGYVLCIVLFVILFYKNVWSAMQSAILNDRLELDEEALKQHGLPFFAATHASALLTTNLATGATILHIILYHPQIVKSAMGWGTHSWRRYLKYLKNPKQIFKYEEKTFSPTEDPANLDPHHRTMLQNYKEVPNWWYGICLGLSVIAAGACIYLAESTLPWYLFFLAIVIAYLYVVFFGALSGLLGFHVPIGSAIQLLGGWLNPGKPLSLMFFSLFAFTTSGQALYLVSHLKLGQYGKLAPRCTFTFQILGTVVGCILNFALMSSITTEQRDILLSIQGTNIWSGTHVQSFNSNAISFGALSKFMFVGGTYASVVYALPLGFLIPLPLWLAGKAWPKYAKSLSYIVTPVICAHLGFLSGGINSSVFMHFILAFTVQFYVRKKYPAWFLKYNYLLAAALSGGLELTIFFLTFIFNGAVMKQIPMPNYALNPKGNLDYCMRDPALAGARGGQ

SEQ ID NO: 30151 - protein, 343 aa, Cryptococcus neoformans var. neoformans JEC21
MAAAAAFDLLDKYIPGASDSLTIVNATTAQNTLYPGVDFAALNWLERLWASYYVWVGNPIIATGLMSFLLHEIVYFGRCIPWLIIDAMPYFQKWKLQPNKHVSRAQILKCTKVVLLTHFTCEAPLILAFHPICCLFGMKTYEIPFSSIGLMAAQIAFFFVFEDTFHYWAHRALHYGPLYKHIHKLHHEFSAPIGIAAEYAHPLEVLILAQGTISGPFLYAVFRNDLHILTVYVWITLRLWQAVDAHSGYDFPWSLRHFLPFWAGADHHDFHHATFTSCFSTSFRWWDYYFGTDVKYHAYKARVAAAGVKERAAVEKREMEKLEKEGIIEERAAASHSKRGKKE

SEQ ID NO: 30152 - protein, 172 aa, Arabidopsis thaliana
MAILIPASFGRLTITSRAQVRVRVSASANQRTIRRDSVDWVKETSSFFEEDKRPIMLFDGVCNLCNGGVKFVRDHDRNRSIRFEALQSEAGKKLLLRSGRAPDDISSVVLVENDRSYIKSEAVLKIMKYIDLPFPQLAFFLQFAPLFVRDFLYENVANNRYAMFGRSDSCEL

SEQ ID NO: 30153 - protein, 351 aa, Pinus taeda
MEQRVPNRELILVAYANEGPVTDSHLNIRETKLDLGSVGKDGSSGDVAVQNLWISVDPYLRQLMKESDDGLYLPSFPLNQAIRSILVGKVVASANPAFEVGDIVSGFYQVSEYAIVPRGDLMKIDTSVVKPSDYLGLLGMPALTAWAGFIIVGEPKPGDEVFVSAAAGSVGMLVGQLAKIKSCRVVGSAGSDQKVKLLKEFGFDDAFNYKCETDLDAALSRYFPRGIDIYFDNVGGRMLEAVLNHINMKARIPLCGMISQYNQEWKQRFGVRNLLNLVGKCAKMEGFMSGQYHHRMGEFFEEMTGYIKQGKIKYKEDVKVGLDSFLEAFNSMFTGENIGKPVIYLGPPLPK

SEQ ID NO: 30154 - protein, 364 aa, Arabidopsis thaliana
MATGSTTDSARSPSSGVLQKLLLLFSVCIATSTYKAIQPPPSKLCGSPDGPSITGPRIKLRDGRQLAYKEHGVPRDEATHKIIVVHGSDSCRHDNAFAALLSPDIKEGLGVYMVSFDRPGYAESDPDPNRTPKSLALDIEELADQLSLGSKFYVIGYSMGGQATWACLKYIPHRLAGVTLVAPVVNYWWKNFPSEISTEAFNQQGRNDQWAVRVAHYAPWLTHWWNSQSWFPGSSVVARNLGMLSKADKEIMFKLGAARSQHEAQIRQQGTHETLHRDMIVGFGTWEFDPMELENLFPNNEGSVHLWQGDDDVLVPVTLQRYIAKKLPWIHYHEIPGAGHLFPFAPGMVNNIVKTLLTNDGVKK

SEQ ID NO: 30155 - protein, 200 aa, Zea mays
MNKNEKKEVKAVKKEKKCPFATVKIEEISEDNDAGCVAIRKAFAKGNGKGKRKELSPQDAALLIQMTYRAHLAHRSQVLRCLRDLAVAKAKLKELRSLFYNISYRHRIAHDHEERQRFSEKIIVLLITVDALEGPDYMVRTAKKSMLEELEAMLEVVDPQPPGKQRSLSRRKFDLPEGGAIPDEKTAAVNKAIRIIEEGK

SEQ ID NO: 30156 - protein, 654 aa, Triticum aestivum
MEERRGGGGGGRGSGKGPAAGKMMSLNEFVSSMAPLIDLEKAAEISAESEASSKRKERRGSVMPNLKCTDAQTGLMGKTLLEFQPNKGDVLPPHKFGTHDVVALKPNKADAGSPALGQGVVYRLKDSSITVVFDDIPEDGLNSPLRLEKLANEVTYRRMKDALIQLSKGIQTGPSANLVPVLFGENSPMRSKDAVKFSPFNKNLDDSQKDAISKALRSRDAFLLHGPPGTGKTTTIIEIILQEVKRGAKILACAASNIAVDNIVERLSQYRTKLVRLGHPARLLPQVLDSALDAQVLRADDNSLAGDIRKEMKVLNSKLLKAKDRNTKRDIRKELKTLAKEERKRQQLAVADVIKNADVVLSTLTGASSKKIAGITFDLVIIDEAAQALEVACWIALLKGQRCVLAGDHLQLPPTIQSVEAEKKGMGKTLFERLTEGYGEEITCMLTIQYRMHELIMNWSSKELYNNKIKAHSSVAGHMLYDLEGVNKSSSTEPTIILVDTTGCDMEEVKDEEESTMNEGEAAVSIAHAKLLVESGVRAIDIGIITPYSAQVTCLKMLRNKDAKLKDLEISTVDGFQGREKEAIIITMVRSNPKKEVGFLSDHRRMNVAVTRARRQCCIVCDAETVSSDRFLKRLVEYFEENGEYLSASEYQSS

SEQ ID NO: 30157 - protein, 338 aa, Burkholderia thailandensis E264
MSITRRTTLSKYLIEQQRETHNLPADLRLLIEVVARACKAISYNVSKGALGDALGTAGSENVQGEVQKKLDILSNEILLDANEWGGNLAAMASEEMETFFPIPANYPRGEYLLVFDPLDGSSNIDVNVSIGTIFSVLRCPDGQQATEQSFLQPGTEQVAAGYAVYGPQTVFVLTTGNGVNCFTLDREVGSWVLTQSNLRIPEDTREYAINASNARHWYDPVKRYVDELNAGAEGPRGENFNMRWIASMVADVHRILNRGGIFMYPADKRTPDRPGKLRLMYEANPMSFIVEQAGGAATTGLKRILDVQPTGLHQRVPVILGSKNEVERVARYHQEAQS

SEQ ID NO: 30158 - protein, 90 aa, Glycine max
  misc_feature (41)..(41): Xaa can be any naturally occurring amino acid
  misc_feature (66)..(66): Xaa can be any naturally occurring amino acid
  unsure (1)..(90): unsure at all Xaa locations
MGNFYVWNFDGVIWDSWGKTVIFVFKVAKWRWPPWLDGGNXTIKDWMVAQLIPVRPGGETGFETLXLGRWLLGTKFPSIKKFLFSEGRNV

SEQ ID NO: 30159 - protein, 455 aa, Campylobacter upsaliensis RM3195
MDPSQIATDTSYSIFMIFVAFVLVFLNGFFVLSEFSIVKVRRSKLEEMVKEKKPNAKKALDVTSKLDTYLSACQLGITLSSLALGWIGEPAIAKMLETPLLKLGLNAVLIHTIAFVIAFSIITLLHVVLGELVPKSIAIAIADKVVLWVARPLHWFWILFLPCIKIFDILAALTLKIFGIKPAKEHELTHSEEEIKIIASESQKGGVLDEFETEIIRNAVDFSDTVAKEVMTPRKDMICLNKQKSYSENMQIICEHKHTRFPYIDGSKDTILGMVHIRDIVQNELNTKSENLDNFVKPLILVPENLSISKVLVMMNKERSHTALVIDEYGGTAGLLTMEDIMEEIIGEIKSEHEEDNYKKLADNIYEFQGRCDIEKVEELLLITYDEDLEQVTIGGYVFNLLGRLPVVGDRIEDELCYYEVKKMDGNSIERVKVVKKTKTEESEDQTHSKFFILD

SEQ ID NO: 30160 - protein, 328 aa, Zea mays
MAGSDEVNRNECKGAVPIHTWVLISNFKLAYNMLRRADGTFDRDLAEFLDRRVPPDARAQEGVSSSDHVIDTSTGLEVRIYRAATNNGGAGAAAVTLPILDFLGGTPAASTPFPVILFFHGGSFAHSSSGTAIYDNLCRRFVKLSKGVVVSVNYRRAPEHRYPCAYDDGWAALNSGGNIAHHVAVRAADAGINICGNILLNAMFGGTERTESERRLDGKYFVTLQDRDWYWKAYLPEDADRDHPACNPFGPNGRRLRGLPFTKSLIIVSGLDLTCDRQLAYAEGLQQDGHHVKVVYREKATVGFYLLSNTDHYHEVMEEIGDFLAANL

SEQ ID NO: 30161 - protein, 524 aa, Bordetella bronchiseptica RB50
MAPPDHVVPSPANGHRHDARPATRLPEPTSLRRTLSARHLTMIAVGGSIGTGLFVASGATIAQAGPGGALLAYLLVGIMVYFLMTSLGELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 30162 - protein, 399 aa, Oryza sativa
MAGRPELPAWTPPVPTRETDLEWAPLTTLDLSQISGDDFTSVPESVVREVGEAFSRDGFIYAENHGLSWEHVLRQFAIGQYAFNGVSEADKAKYKADILSTGSFVGYKEQGHWKLNGVKDRIEQLNFGSQSFAADKREQLFPPSIQHLLPEIEEFARFNHAVILRKILSVLSLVLKLPANHLWELSKEPEKRGLDLLRYAMYHTPDQQDDDKLGGVRLQGHTDFNSVSILWSQPITSLEVLMPDNKWRLVKHRDNALVINLGDAMHFISGGYLKQTIHRVVAPPADQAHYTRLGIFYFALFNDDVALEPIEESSVVRETYAARKHKEGGFWDAAKAKGEKVPTAGDWERLRVKAYGQQQAKKAQDGHDVEEIAGQKVLGYNGERVKSKFTAQTSAVRAN

SEQ ID NO: 30163 - protein, 564 aa, Novosphingobium aromaticivorans DSM 12444
MYATSADERRHAIAVRHPAWIWNNLHSYLDWSLGDLADRPLVIADEGTLTYGDAARLSVELAGGLKARGIKKGERVGLIMANDPLTVPLLFAIWRAGAIAVPLNTLYRPDEIRFALAEAGCALLIAMDRFASRNFAQELEEGLPGWQAGACHDLPELRGGLIFDRAAPGRLVEKLSGQGGGAEDHERVEGGDTALILFTSGTTGSPKGVEISHDNLLRAMYAGAYHQAFEDGRRAVFSLPLYHGFGLVVGLLSGMVSGGAIIPLLRFDPHQILAATERHRATYLMGVPTMTIALLEQAKRQHYDLSSLNAIHSAAAPTPSWVWEDIRATFGCEEIITSYGQTEVTATVICTAPGDSIETVSETQGRIVEAGIAGMPDQGGRIAEFKIIDPETGADLPWGASGELCCRSPMNSKGYFRRPKATAALFLEGGWIRMGDLGQFRPDGNLFLTGRTKELYKSKGELVSPKELEQILTANPGVSQAFFIGMPDDQFGECGCAWVVRAEGSGICEGEVMDYLRERIPAYKMPREVWFIEDEALPKTGTGKVQKAELRNMALAMLADQKAV

SEQ ID NO: 30164 - protein, 418 aa, Bacillus anthracis str. Ames
MIEIKVPELAESITEGTISQWLLNVGDKVEKGGSVVELETDKVNVEIIAEDSGIVSKLLGEPGDTVEVGATIAILDANGAPVAVSTPAPAEQSKQETAEAPKAAAPSAEQTATLQGLPNTNRPIASPAARKMARELGIDLNDVRSTDPLGRVRPHDVQAHAAAPKEAPAAPKSPAPAPVAKTEFEKPVERVKMSRRRQTIAKRLVEVQQTSAMLTTFNEVDMTAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDNERMENRPMMYIALSYDHRIVDGKEAVSFLVAVKDMLEDPKSLLLEG

SEQ ID NO: 30165 - protein, 371 aa, Cryptococcus neoformans var. neoformans JEC21
MPDLVVTTQELRPSSPVYGHARTIIKNNFVAMAGEYVGTTLFMLCCLGGTHVALLPEKSVTGDLSQPLNTSSLFYISLSIGLSLTVNVWIFFRVSGGLFNPAVSLGMVLAGCLPPMKGALLTVAQVLGGITGAAIINVLLPGELNAGTTLGGGASIAQGLFIEAILTALLMLTVFFTAAEKNEATFLSPLAIGMALFIAEMVGVPYSGGALNPVRSLGPAVVTHNFPGYHWIYWVGPALGSVLATCFYSLLKYLEYESVPGPGEAPHVPPFWRLPARGYLSTLSHPFAKRASTGTYSHEDDPEKGLRSGKDSQANTDNPTRVNRRGSGDAEIQSPVEDTTMANARLDRIEMLLTQLMQVRTSEGTQKSPAV

SEQ ID NO: 30166 - protein, 415 aa, Oryza sativa
  misc_feature (287)..(287): Xaa can be any naturally occurring amino acid
  misc_feature (301)..(301): Xaa can be any naturally occurring amino acid
  unsure (1)..(415): unsure at all Xaa locations
MAEDPAGSRRWRCDAGDEHGCWLSSSAGGGGDDHFDRLPDPLLLVIFNRIGDVKALGRCSLVSRRFHDLVPLVDSVLVRVDCVIPDDPASSSSSSSSPSAAPSSPTASARARTVFSQIARIVLGGIIKPIQALGQILSPANSASVLAASVTSSPSSSSSSSSSSPPLPGDVSHHSPSEVLRSFKELRRLRIELPAGELSMEEGVLLKWKADFGSTLGSCVILGASSAGKDGGAGAAPAVDCGESDETGSIPESFYTNGGLKLRVVWTISSLIAASARHYLLQPIIAXDHTTLDSLDLTDAXDGAGSAHPWDKWQLQELRVKPVSASGGSHRTLMPALSMRLWYAPHIELPGGLVLNGATLVAIKPTEEATRDTVGSGIAGSAGGCWVSDAFEEPYRTAVGMLLKRRTYSLEMNSF

SEQ ID NO: 30167 - protein, 519 aa, Rhodococcus sp. RHA1
MNAADSTASRPPFYLTTAIAYPNGVPHIGHAYEYISSDALARFKRLDGFDVYFMTGTDEHGLKMQQTAAKEGIDVRELAARNSDVFEAMDKTLNISFDRFIRTTDADHEEASKAIWRRMLDNGDIYLDTYSGWYSVRDEAFYTEAETTLQDDGSRLSTETGTPVEWTEESTYFFKLSEYQDKLLRLYEENPDFIAPATRRNEIVSFVKGGLKDLSISRTTFDWGVPVPDHPEHVMYVWVDALTNYLTGAGYPDTDSEQFGKFWPANLHIIGKDITRFHTVYWPAFLMSAGIELPKRVFVHGFLYNKGEKMSKSVGNVVDPVAMVEQYGLDAVRFFLLREISYGQDGSYSHEAIVTRINADLANELGNLAQRSLSMVAKNCDAQVPTPGELTEDDTAMLAQADALLGRVRAEYDVQALHLALEAIWSVLGETNRYFSKQEPWVLRKTDPERMATVLYVTLEVVRIVGILVQPVMPDAAEKILDLLGQKADARQFSDLSTRIVAGTPLPAPSGVFPRYVED

SEQ ID NO: 30168 - protein, 589 aa, Candida albicans SC5314
MLELNSITIPRNFTEFQLTALKIYYQLKILFLATYCAQGSFGLNGSVCLARDIFVGYVVYTQLLKLYRVLRGYGIVDSIRRLYLYVSSTVSSQIFSLPFIKSKIDKELQATIGKVEEEIMKNDPQLLQFPELPEQGIDADNVSLELDKLQNLKHSDWINGRVSGAVYHGGENLLSLQVEAYKKYSVANQLHPDVFPGVRKMEAEVVHMVLDIFNAPSDGCGSTTSGGTESLLLAGLSAREYGKKYRGITEPEVIAPVTIHAGIEKACFYFGMKLHKVDLDPVTFQVDVKKVERLINSNTVLICGSAPNYPHGIIDDIESLSKLAVKYNIPLHVDACLGSFIVSFLEKSKVHGDRKLPIFDFRLPGVTSISCDTHKYGFAPKGSSIIMYRSPKLRECQYYIASDWTGGMYGSPTLAGSRPGALVVGCWATLINIGKQGYTKFCYDIVSASMKVKRAIETDPILSKHLQIIGDPIGSVISFQLAPQQSGNLSIYEISDLLTKKGWHFATLQNPSALHFAFTRLTVPVVDELIADLVEATKEAVAIAEEHKKNGVTKAPGDTAALYGIAGSVHTAGLADRLIVAFLDTLYKI

SEQ ID NO: 30169 - protein, 211 aa, Campylobacter upsaliensis RM3195
MENLISGAIKFMQEDFKEHSALFESLKNKQNPHTLFIGCSDSRVIPNLITNTGPGELFVIRNIANIVPPYRVGEDYLATTSAIEYALTSLQIKNIVVCGHSNCGGCNALYSSEKELEKVPNVKKWLTMLEPIKKDVLLFSNNDLAMRSWLTEKLNLVNSLQNILTYPGVEKALSEGKIEVHAWYYIIETGEIYEYDFKAKIFTLIQNRRNV

SEQ ID NO: 30170 - protein, 841 aa, Zea mays
  misc_feature (481)..(481): Xaa can be any naturally occurring amino acid
  misc_feature (749)..(749): Xaa can be any naturally occurring amino acid
  unsure (1)..(841): unsure at all Xaa locations
MARLTPTKSKSSRKPKPSSSSAMGAGAEPDAMSTRRPKRGKSVGGVSKKSKSGGFESMGLCEEVYRGVRHKGYRVPTPIQRKTMPLILAGVDVAAMARTGSGKTAAFLVPMLQRLRRRDPSAGVRALILSPTRDLAMQTLKFSNQLGKFTDLRTSIIVGGDSMESQFEDLSECPDIIIATPGRLMHHLNDVKDMTLRSVEYVVFDEADSLFSMGFAKHLHDILKKLNDTRQTLLFSATLPSALADFAKAGLRDPHIVRLDLDKKISPDLRMVFFTLRQEEKLAALLYLVRERISSEEQTIFFVSTKHHVEFLNVLFREEGLEPSLSYGAMDQEARMIHISKFRARKTMLLIVTDVAARGLDIPLLDNVVNWDFPAKPKLFVHRVGRVARQGRSGTAYTFVTSEDMPYLLDLHLFLSRPLRPAPTEEELLKDMDGITMKIDEAIANGESVYGRFPQTVLDLASDGLKEVITGCTELIALEKXPCANAFRLYLKTRPMPSKESIKRVKDLPREGLNPIFRDVLRSDELSALAFSERLKSFRPKQTILEAEGEAAKARNSKGSNQWLDVMKKKREVHEGIINLVHQKSSEDPRPEVEEVVDISNWEKKEVCGKKRKLQSFRDEDYYISSVPQNHHLEAGLSVRDNEGFVENRLDAAVLDLVDDEASGMQAQKTRYHWMKNKFVKLNAGDRVTATGKIKTEGGAKIKASATGIYKRWQQKTHKSINIGGKSGNFADEGTSSSGGYQRGNKKHXRGHGRRSIPNANVPSEIRNHEQMQKGRQQKAMEITRLKNKSAKDGKFQNKFQKSRQQPDRHGKGRGSGKGTGKGFSKGAGGRGGKGKGKGGR

SEQ ID NO: 30171 - protein, 416 aa, Marinobacter sp. ELB17
MDYFIYKNDELWAEGVPLARIAEQHGTPAYVYSRATLERHYRAYDNALQNHPHLVCYAVKANSNLAVLDVLARLGAGFDIVSAGELERVIRAGGNPAKVVFSGVGKQPWEMRRALEVGVRCFNVESDIELDRLNAIAGELGVKAPVSLRVNPDVDAGTHPYISTGLKENKFGIDIEVAPAIYARAASLPHLDVRGVDCHIGSQLTTVAPFLDALDRVLALVDKLAEQGVEIKHLDLGGGLGVTYNDETPPQPGEYVEAILARLGDRKLELILEPGRSIAANAGVLLTRVEFLKCTEHRNFAIIDAAMNDLIRPALYGAWQAIVPVAPHSNGDEKAWDLVGPVCETGDFLGKDRQLSLNAGDLLAVRSAGAYGFVMSSNYNTRNRPPELMVDGDQVHVVRRRETVEEQLAPESCLPL

SEQ ID NO: 30172 - protein, 134 aa, Brassica napus
  misc_feature (129)..(129): Xaa can be any naturally occurring amino acid
  unsure (1)..(134): unsure at all Xaa locations
MASDTASAVPSSVVSAAEETLGYTESVGDHLSHLLAAAAADPDAVAELPPLLRARAFLALAQAATSLLGVRLRCSGVDPDEHPIRKEFERLSLMQEKLNQFENWDKAPLRPSTTLNTQAAARFIGHSLXHLTSD

SEQ ID NO: 30173 - protein, 1427 aa, Oryza sativa
MKTFILQQMVQKGRAKRSSNFNRKEDIQLCISWQSISSDPIIGNEQPGKAYWQRIAEHYHANRDFESDRNANSLEHHWGNIQKEVSKFQGCYEQIERRHPSGIPHQELLRNSPKFQTLESHKRPRSRKSSTLIESAGEEDEEGDDARKSTTPDLLQPSAKKRPMGRKQAKEKMKNGEDGPYKEAMKDLLDAKEKEAKVKEERWKETKEIQERKLLFAEHVRTYVLAMRTQIAASKVAALNGGFDGSSGFGATASPSSRELAQRLLKKNAEHESRLRRSAQSKVPSDPNIWFQMRENYEKIILADHDFSEKREIEYLLWQLHYKRIEEFRAHIVSAGKNNANPDRIKRIRSSVRSFLSEATGFYHDLMLKIRSTYGLPLGYFSEGPDSSVVPDKDGKKVVGVKKGLLSCYRCLIYLGDLTRYKGLYGDVDYASREYAAASIYYKEAASLCPSNGNPHHQLAILASYAGDEVTAIYRYFRSLAVDNPFSAARENLILAFDKNHDIYAQLSGNSKVPNAKSLPSRSVGRARGRGETRFQPKGSSTEENSKEREHSIQEILKAFYIRFVRLNGILFTRTSLETFGELSATVISDLQILLSSGPYEELNFGVEAAENALSVVKLIAILIFTVHNANKDADNQSYAEIVQRRVLLQNAFAAAFEFVGYLLKRCAELHDVASSIYLPAILVFIEWLACHPDFVASSEMDEKQADARSFFWSQCVPFMNKLILTGLAHVDGDNDETCFFDMGTYEEGETGNRLALWEDVELRGFSPLVPAQGILDFSTKQGFGSDGGTKEKKARVERILAAGKALLNFVQIDQLRIYFDASSKKFLMASEPPPPASSVPLVVSSNAQTTNHIQQEPEVSSKIGSVAEDLGVLQSKAQLFLDGDDDEEIVFKPPVSEKLPRVTSEQTSNELLQPVVVSDVNWSNDGAPPPMTFQSNGPVLTPNVYVQSLPISSLGWAANAGQHVILDVGARSTSDIFESLKAPDHNWVSTGAPLVGSLDTVPMASFSNIISDQRTPPSSLGCFSNPDNTAILPGQDSFLLSALNNVNIGASGFLDQRVNGGLSGLQSVGNVPQVSAQATMNSTNPMIGQYKHTEVTIPSAFYSVLPSVVSSDGVSKKNPVSRPGRHVGPPPGFNNAPPKRQDDSILAGNGQHVQTNDGIWLDGYRSSLDYVNNQRFAHSNVTTASSTFTTPFPFPGKQAFSMHPRGSDEKQWQDFHLFGPTKQLPELNFQQGNQQNGPLAEQLPAQSAWSGNYLDLLRICWECLSWKHNKCYPWNWVWQVFQAMKGILDDPFHCLMRICTESSLTSQTQGFDLMSNLQFCIRAVTEMRQMMGVLQIDAGMLPSSPPWMLASCAPGDDAWSRRATVIVPVPASCRSSSCRTLSPVAFAVLLTVTQGSSTAPTWRDTAPPPAASPASSSAARGGESRR

SEQ ID NO: 30174 - protein, 476 aa, Mycobacterium tuberculosis H37Rv
MVLRSLASPAALTDPKRCASVVGVAAFAVRREHAPDALGGPPGLPAPRGFRAAFAAAYAVAYLAGGERRMLRLIRRYGPIMTMPILSLGDVAIVSDSALAKEVFTAPTDVLLGGEGVGPAAAIYGSGSMFVQEEPEHLRRRKLLTPPLHGAALDRYVPIIENSTRAAMHTWPVDRPFAMLTVARSLMLDVIVKVIFGVDDPEEVRRLGRPFERLLNLGVSEQLTVRYALRRLGALRVWPARARANTEIDDVVMALIAQRRADPRLGERHDVLSLLVSARGESGEQLSDSEIRDDLITLVLAGHETTATTLAWAFDLLLHHPDALRRVRAEAVGGGEAFTTAVINETLRVRPPAPLTARVAAQPLTIGGYRVEAGTRIVVHIIAINRSAEVYEHPHEFRPERFLGTRPQTYAWVPFGGGVKRCLGANFSMRELITVLHVLLREGEFTAVDDEPERIVRRSIMLVPRRGTRVRFRPAR

SEQ ID NO: 30175 - protein, 302 aa, Arabidopsis thaliana
MAAFAGSDSETTSSTSRVIDSHLHIWASPQEAETYPYFPGQEPTLTGDVNFLLKNMEEARVDGALIVQPINHKFDHSLVTSVLKRYPSKFVGCCLANPAEDGSGITHLENLVLESNYRAVRFHPYLWPSGQKMTNAVGKALFSKAGELCVPVGFMCMKGLDLHIAEIEELCTEFPKTTVLLDHAGFCKVPESGEAKLAYSQLMKLSRFPQVYVKFSALFRISRTGFPYQDLSPLLSQLVSHFGANRVMWGSDFPFVVLECGYKEAKEAVTIIAKEASLSSSEMDWILGKTLMQLFPGQWVLP

SEQ ID NO: 30176 - protein, 284 aa, Triticum aestivum
MAGGGELVVSFGEMLVDFVGKLGDDEFGRMLAAILRDNGVDDGAVVFDAGARTALAFVTLRADGEREFMFYRNPSADMLLTADELNVDVIKRATVFHYGSISLIAEPCRSAHLRAMEIAKEAGALLSYDPNPREALWSSREEARTKILSIWDQADIVKVSESEVEFLTGIDSVEDDVVMKLWRPTFKLLLVTLGGKGCKYYARDFRGVVPSYKIQQVDTTGAGDAFVGALLRKIVQDPSSLQNQEKLEEAIKFANACGAITTTKKGAIPSLPTEIEVLQLMENA

SEQ ID NO: 30177 - protein, 578 aa, Geobacillus stearothermophilus
MGNAIREKTIHGIAASSGIAIAKAYRLETPDLAAEKRTVADVEAEIARLEAAVAKAKEELEAIKQHALEKLGEDKAAIFAAHLLVLDDPELLNPIKEKIQTERVNAEYALDETALFFISMFEAMDNEYMKERAADIRDVTKRVLAHLLGVTISNPSLISEEVVIIAEDLTPSDTAQLNRQYVKGFATDIGGRTSHSAIMARSLEIPAVVGTKTVTAEVKNGDIVIVDGLDGQVIINPSPELLAQYEQKRARYEAQKAEWAKLVHEATVTADGIHVELAANIGTPDDVKGALANGAEGIGLYRTEFLYMGRSELPTEDEQFVAYKTVLEQMNGKPVVVRTLDIGGDKELPYLQLPKEMNPFLGFRAIRLCLEMQDMFRTQLRALLRASVYGNLKIMFPMIATLDEFRQAKAILLEEKEALLRQGVAVADGIEVGMMVEIPAAAVMADQFAKEVDFFSIGTNDLIQYTMAADRMNERVAYLYQPYNPAILRLISHVIDAAHREGKWVGMCGEMAGDPIAIPILLALGLDEFSMSATSILPARAQLKKLAKEEAARIKETVLSLGTAEEVVSFVKRTFSLA

SEQ ID NO: 30178 - protein, 245 aa, Glycine max
MRALTSSSSTFIPKRYSFFFFLSILFALRSSSGGCSEYHHHHAPMATIGGLRDSQGSQNSVQTEALARFAVDEHNKKQNSLLEFSRVVRTQEQVVAGTLHHLTLEAIEAGEKKLYEAKVWVKPWLNFKELQEFKPAGDVPSFTSADLGVKKDGHQPGWQSVPTHDPQVQDAANHAIKTIQQRSNSLVPYELHEVADAKAEVIDDFAKFNLLLKVKRGQKEEKFKVEVHKNNQGGFHLNQMEQDHS

SEQ ID NO: 30179 - protein, 286 aa, Oryza sativa (japonica cultivar-group)
MYPYRFSNVMIGYLNLATLLASIPVIGAGLWMAKGSTATCSSMLQTPLLVIGFVVLLVSLAGFVGACFHVAWALWLYLLAMMLLIAFLLGLTAFGFAVTAGGGGTQVPGRPYREYHTSDYSSWLQKHIQDAKYWRPALACVVGSKACPKIANWSPMDYLQHDLTPIQSGCCKPPTACAYSGGVAVGAQDEDCFRWNNAAGILCYGCESCRAGVMEKVREDWHKISVLNVMVLVVLICICACGCCAFRNARRSVSEYPYGVNRMHKIHPRWDYYWWRWWRDRREQLY

SEQ ID NO: 30180 - protein, 373 aa, Hevea brasiliensis
SLEGLPLDGFDYESILGQCCEMAIGYVQIPVGIAGPLLLDGKEYTVPMATTEGCLVASANRGCKAIYASGGATSVLLRDGMTRAPVVRFPTAKRAADLKFFMEDPDNFDTIAVVFNKSSRFARLQSVQCAIAGKNLYMRFSCSTGDAMGMNMVSKAVQNVIDYLQNDFPDMDVIGLTGNFCADKKAAAVNWIEGRGKSVVCEAIIKEEVVKKVLKTNVAALVELNMIKNLTGSAVAGSLGGFNAHASNMVTAVYIATGQDPAQNVESSHCITMMEAVNDGKDLHISVSMPSIELGTVGGGTQLASQSACLNLLGVKGASKDSPGSNSRLLATIVAGSVLAGELSLMSAIAAGQLVNSHMKYNRSAKDVSKITF

SEQ ID NO: 30181 - protein, 416 aa, Ehrlichia chaffeensis str. Arkansas
MVKEAVLELDGQRIKLPVLYDTHGNKAVDITSLYKNTGILTYDPGFMSTAACESRITFIDGNKGILCYRGHDIVNLVNNNKSFIEIVYLLFYGVLPGLEDLQNFISQISQEYNPPKIVHDVIKSFPRDSHPMSILMACFSALASCYHNQDNSADQLKCAKLAVAKVASIIALIYRYITNQDFVESDTKLSYSENFVHMMFDISSYKFTQVVAKALDIIFVLHADHEQNASTATVRLSGSSGADLFACLVAGTATLWGPAHGGANEAVINMLMAIEKPSNVKQFIQKVKDGNKSTRLMGFGHRVYKNYDPRAKIMYKICREVLNNLNVNDPLLEIALELENIALQDSYFIDRNLYPNVDFYSGIVLKAIGIPVRMFTTLFALARTSGWSAQWYEMVAEENYKICRPRQLYTGNIAEC

SEQ ID NO: 30182 - protein, 508 aa, Nicotiana plumbaginifolia
MAAATIIAATVGILVAIFCGKFLYTIWWWPKMIEKKLKKEGIYGYPYKLLFGNLKEIMKMSKEAKKQPLLTHDIIPWVNPFLQHVANTYKKIFVLWYGPTPRVTVTDPKLIRELLNRYTEFHKPEANAFIHLFVTGLASYDGEKWDTHRKLLNPAFHVEKLKRMFPAFAMCCDEMLNRWEESVGKTGSCELDVLNEFLNLGGDVISRAAFGSNIAEGRSIFLLQKEQCELILASPFTLFFPSLRFLPTASNRKAKYIHKKVISLIRGIIEKREDAVRRGISDNDDILGLLLKARNADNKSRAGGLTTEDVIEECKEFYFAGQDTTTALLSWTMVVLSMHPEWQDKARNEVFQVIGKNKPKFDDLNQLKLMNMIFQEVLRLYPAIFLIRSTSKSTKLGDMTIPAGVQVCVPTHLVHRDPEVWGDDALLFNPERFSEGVSKAAKEQMYFPFGWGPRMCIGMNFGMLEAKLILSQILQRFWFELSPSYTHAPLLTLIMRPQYGAQIIVHKL

SEQ ID NO: 30183 - protein, 144 aa, Oryza sativa
  misc_feature (64)..(64): Xaa can be any naturally occurring amino acid
  unsure (1)..(144): unsure at all Xaa locations
GRINGSLNLTRAIGDMEFKQNKFLPLEKQIVTANPDINVVELCDNDDFLVLACDGIWDCMSSQXLVDFIHEHIQKESSLSAVCERVLDRCLAPSTIGGEGCDNMTMVLVQFKKPITQNKKADVGEQSAKGVEEAEINAAEENGS

SEQ ID NO: 30184 - protein, 143 aa, Triticum aestivum
MVHGTLEVLLVGAKGLENTDFLCNMDPYALLKCRSQEQRSSIASGKGSNPEWNESFVFTVSDQATELVIKLMDSDSGTSDDFVGEATIPLEAVYTEGSIPPTVYNVVKGEHYCGEIKVGLTFTPEDGRQRGLPEDFGGWKQSH

SEQ ID NO: 30185 - protein, 534 aa, Desulfotalea psychrophila
MFASYKSIQETCAFEKLSELAQSPYDLTQPGALQADNRLQRYQVAGQAFKLFYATEQVDDRVLAGLQAVADECQLVSQYRAMRTGAVMNKIDGFVSENRRVLHTATRDLFSGEPAEASMNSRAKRELEKLSHFLDALDAGEIVNEAGEAFTTIVQVGIGGSDLGPRAVYEALKSYTIVGRRAAFISNVDPDDVSMALADLDLGKTIFNIVSKSGSTLETVTNEAFVRRALLENGYDSARHCISITGEGSPMDDPDSYLASFYLYDCIGGRYSTTSMVGCVLLGFTLGFEQVMAFLRGAANMDNSADEVDILKNIPLLMALIGIWNRNFLDLSSLAIIPYSQALYRFPAHLQQCDMESNGKSVDRQGRAVQGKTGPIIWGETGSNSQHAFFQHIYQGTSPVPIEFIGFSESQRGKDIEVQGCTSQQKLLANLFAQMVALACGKKDQNLNKFFAGNRPSCLLFAKKLTPYVMGSLLACYEAKIVFQGFAWNINSFDQEGVQLGKELAKRFLREIGGEEEGFHGIESAFLNEVQRGV

SEQ ID NO: 30186 - protein, 523 aa, Nocardia farcinica IFM 10152
MRAGTRTRNPVAPSPVRARTARIALLLIAFVCAACGLVYELSLVTLGSYLLGDTAAQASITLSVMVFAMGIGALIAKPLRGHAAAAFVAVELALALLGGLSVLLLYAAYAWLNLYTTALIAAASVIGMLVGAEIPLLMELLQRIRRQAPGAAVADLFAADYVGALLGGLAFPFLLLPVFGQIRGSLLVGVLNAAAGLALVFVLFRDRLTRPARLLFTALTALVALVLGGSYVYADRFEATAQQALFAHPIVRHEQTRYQSIVLTESLSPFATPDVRLYLNGDLQFSSVDEYRYHEALVHPVLAGPRARVLVLGGGDGLALREILRYPDVAEVTLVELDPGMIHLARTEPRLLALNRHAFDDPRVRVINEDAFAWLRGQSGRFDAIIVDLPDPDQTSIAKLYTKEFYAMVAQVLAPGGTVAVQSGSPFFAPRSFWCIAATIRAGGLRVLPYHVDVPSFGDWGFVLATRDVEPVLRLDPPAPPRSIDAESLRAAAVFAPDRRDPGAPVSTLMHPVIVDLELREWR

SEQ ID NO: 30187 - protein, 740 aa, Oryza sativa (indica cultivar-group)
MRLLVPDGARGGGGGGGGGGLLPAAAASPAVGRGRRTVVVGIRRDAASRELLTWALVKVANAGDRVVALHVAAAAAAAAAGGAVGLEERSDAAEDSLVSVLAVYDGFCNLKQINLELKVCGGSSIRKTLVKEAASYGAAHLILGVAKNSLSFSRSSSISVAKYCAKRVPTGCSVLAVNNGKILFHKDAVQQEPYHSASTMTETPRRSYRKLLTSVIGEKLRDECEQDNRSIFRAVTMPPSSPAPTREVSLALVPMKVHRRESPEVATGWSFLRKKFLPDRKPASHDRSKMSVVQWAMRLPSRYSSASPVCSEYRTTTPDGITSASRILRDRVAVPSRSNSGKSSVVIEELDNSSDKEIPEELIALREKFPSVYSTFSHSELAKITSDFSPECIVGQGGTSQVYKGCLENGKELAVKILKYSDEVLKEFVSEIEIVSSLSHKNIISLAGFCFKDTDLLLVYEYLRRGSLEEILHGEKGCDNLFGWTERFNVALGVAHALDYLHGSGNNRPVIHRDVKSSNILISQDFEPKLSDFGLALWDTDATSQITCNDVAGTFGYLAPEYFMHGKVNDKIDVYAFGVVLLELISGKKPLCTGCPKGQESLVMWANSIIQGGKLTQLVDPNLPTEDHANKVERMTLAASLCIRPTPQRRPHIAVVLKLLNGDNGILKWARSEVGLSYESDGDEPVVTLPENNRNIQSYINLAFDVDDDSASVSSNDFIAANTSLEEYLRGRWSRSSSFD

SEQ ID NO: 30188 - protein, 425 aa, Clostridium perfringens ATCC 13124
MDRNKEIFEESKKYMPGGVNSPVRSFGSVGINPPVIKSGKGAMIKDENGNEYIDFVLAWGPMILGHCDEDVVKAIKKTSEESIAFGASTKLELDLAKLLCETLDNVDMIRMVNSGTEATMSAVKLARGYTKKDKIIKFAGCYHGHFDGFLIEAGSGVLTEGIPGCLGVPEESIKNTLIGIYNDEKQVEELFEKYGNDIAGIIIEPVAGNMGVVKCDPKFMRKLRELCDKYGALLIFDEVMCGFRVAYKGAQTLFDVKPDLVTYAKIMGGGLPCGAYGGRREIMENLSPLGGVYQAGTMSGNPIVMSAGLATVKKLYENPSYYDHIEKIGSKLEKGVLEIAKKKGLGLVVNRQGGMMTLFFTDLKEVKCYDDVKTCDGERFKRYFLHMLNKGFNIPPSQFEAMFLSVKHTEEHIDKFLEAFESFEG

SEQ ID NO: 30189 - protein, 489 aa, Arabidopsis thaliana
MMIMFFLLCSIIFVVTIIIFRKQKRGKKRNTLPSPPGLPLIGNLHQLGRHPHRSLCSLSHRYGPLMLLHFGRVPVLVVSSAELARDVLKTHDRVFASRPRSKIFEKLLYDKHDVASAPYGEYWRQMKSVCVLHLFSNKMVRSFREVREEEISLMMEKIRKSISLPVNLSKILVSLTNDVICKVALGRKYGGETDFKELMERLNKLLGTFSVGSYVPWLAWIDWIRGLDCQLEKTANDVDKFFERVVQDHVDGNRDMTDFVDVLLAIQRDKTVGFEINRVSIKAIVMNVFVGGTDTSSTLMEWAMTELLRHPKCLKRLQEEVRTICKDKSSVSEEEIQNMSYLKAVIKEALRLHPPLPLMVPHESTQDVRLGDHHIPAGTQVLINAWAIGREAATWGPDVEEFRPERHLDSSVDYRGQAFELIPFGSGRRICPAISFAVVLNEVVLANLVHRFDWRLSVESTEDQTEVAESTGIAIHRMFPLYAIASNTT

SEQ ID NO: 30190 - protein, 379 aa, Shewanella oneidensis MR-1
MSNEKPQFIKSKAAVAWGPRQPLKIEEVDVMLPKAGEVLVRIVATGVCHTDAFTLSGDDPEGVFPAILGHEGGGIVEQVGEGVTSVQVGDHVIPLYTPECGECKFCLSGKTNLCQKIRATQGKGLMPDGTTRFYKDGQPIFHYMGCSTFSEYTVLPEISLAKVNKTAPLKEICLLGCGVTTGMGAVMNTAKVEAGATVAIFGLGGIGLSAIIGATMAKASRIIAIDINESKFELARKLGATDCINPKNFDKPIQEVIVEMTDGGVDYSFECIGNVNVMRSALECCHKGWGESVIIGVAGAGQEISTRPFQLVTGRVWRGSAFGGVKGRSQLPKIVEQYLAGEFKLDDFITHTMGLEQVNEAFDLMHEGKSIRSVIHFDK

SEQ ID NO: 30191 - protein, 618 aa, Oryza sativa
MHTKLLLLPILASLQLLPGAANGATVDPSCPPATCGNLTITYPFWLGSQNQSSCGPPSFQLTCNDRASGPFLRNSYIKVLGFDYGRRSLVAVHALLAADAACTVMFNVSSAFAITDRFSISQSNRELYVLSRCRERLPPPDAVPVTNCRANSSGMYAYLGGSYGTGQTPVNNGGCELSVFLVLGSSNAADMTAANYRQLIAGGFLLEWEPVGDCNACTASGGRCRYDASTSAFACLCSDGGMRPSICVSLSAAAGLVFAFLAWLMYRQRQKFRSAICGVYSGNTKNEEEMLKKCESLALKRYKYSELKKITKSFEDNLGEGGYGVVFKGRLQNGRMVAVKILTVSKGNGEDFLNEVMSISRTSHVNIVTLLGFCLEGPKRALVYEYMPNGSLKNYIHSESSNLATGWEMLLKIVIGIARGLEYLHQGCNTRIIHFDIKPRNILLDHEFCPKIADFGLAKLCHLNESILSMAEARGTIGFIAPEVFSRGFGVVSTKSDVYSYGMLLLEIVKVRKNIKGIADNFSETFFPHWVYDSLVSEMQCCETAYGTEEIARKMTIVGLWCIQMTPETRPSMSRVIEMLERSISELEMPPKPFLCSPIHSTNVSSYKSVNFTMSASS

SEQ ID NO: 30192 - protein, 394 aa, Sulfolobus solfataricus P2
MSIKEVIRLFGPAWIVMMADVDAASVLTGVANGQEYGYRLIWLLLLLSIPLYIIQEAAGRLGAVNNGKGLGEIIRERYSGKIALLASLSMFVVDVFTYIVEYVGIAVGGLVLGIPPYITLPIFFVFHLVIISTRKYEKIEKFLLPISLLLAVAFVLQAMLRGIVNGENVLYFSPSKSFTFLVAANIGAVIMPFMIFYQTSATSYKYQNVESSIETKIKWSSIETLIGAIVSELIMVAIEMATTGISPSVDPLNYKEISYALSLVSGPFSPYIFGIGLICAAFLALIVESLGSAWGTLEALGKNSFNNFILLYISESIPALVITLLFTNNYDNVVNFALTLMSIAPFIVVIPCVLIGMLVKDKNLMMNYAYGRTRMLVYWITVAMILIGGILAVI

SEQ ID NO: 30193 - protein, 229 aa, Rhodococcus sp. RHA1
MPPHFIDGEPHDHQHDRPRRVRVAGEPVRIGIGGPVGSGKTALVAALCRQLREELSLAVLTNDIYTTEDADFLRRHAVLPDERIAAVQTGGCPHTAIRDDITANLDAIDDLIAANPPLDLILVESGGDNLTATFSSGLIDVQIFVVDVAGGDKVPRKGGPGVTFSDLLVINKTDLAPMVGADLGVMRRDAERVREGRPTALISLTEDPSSGPALEWVREQVRTLADVHQ

SEQ ID NO: 30194 - protein, 136 aa, Bdellovibrio bacteriovorus HD100
MEKVDISMRNVVFFDGVCHLCNGFVDAVISKDKNHTFLFAPLQGTTAEEVLSAQDRTNLDTVIYFESGKLYYRSAAILKILTGLGGAYKLFGLAWIIPGPLRDVLYKLIAKNRYSWFGEREFCRLPTPAERSYLLP

SEQ ID NO: 30195 - protein, 386 aa, Gibberella zeae PH-1
MATQTMKAVNYQGPYKVTVEDVELPKLEHPDDVIVKVTTAAICGSDLHMYEGRTAAQPGITFGHENMGIVEQLGEGVTLLKKGDRVVMPFNVADGRCRNCEEGKTAFCTGVNPGFAGGAYGYVAMGPYRGGQAQYIRVPYADFNALKLPAGKEHEADFILLADIFPTGWHGVEISGFRSGESVAVFGAGPVGLMAAYSAVLRGASRVFVVDRVPERLQAAEKIGCTPIDFSKGDAVDLIIKANGGEEVDRSVDAVGYQAVGNSGDTEQPNIVLENMIRVTRPCGGLGIPGLYVPSDPGASDEASAKGMISLSFGKLFEKGLTIGTGQCNVKSYNRYLRDLIISGRAKPSFVVSHEINIDEAEVAYEKFDKRIDGYTKVLIHPNGGF

SEQ ID NO: 30196 - protein, 215 aa, Synechococcus sp. WH 8102
MFGFLKQVGDYTRDAVDAARNLAQGFSVTFDHMKRRPVTVQYPYEKLIPSERYRGRIHYEFDKCIACEVCVRVCPINLPVVDWVMNKATKKKELRNYSIDFGVCIFCGNCVEYCPTNCLSMTEEYELAAFDRHSLNYDNVALGRLPTSVTTDPSVQPLRELAYLPAGEMDPHGVPNDRPRAGQLPSQVLETLAPPAKVGAKNEGQSTGTTQEGEA

SEQ ID NO: 30197 - protein, 676 aa, Magnaporthe grisea 70-15
MSDAVATLIGLQAATGGTTIQDILNRTAPGLSFIPSFLRRWLQIDISAIIGLLSLIGAMSSGFHFLNHIGLKLYWTLTRFCTASVAVAASDRLNREVLSWISSTVLMRQGTRVLAARSEMVDDERYYYQRPKTIRDDCANETRRPVEYMPTFGTTWFWHRKRLFIVRCVRTHNHRGGAFSRDSPEEFFDAPTGEEPLVVMCFGRSVAPIKQFLNDCRDWGEAQRARYVTVRTCKKSYNGAHWDSTILRPTRPIQTVHFDEQVKKDLIADIINYLDPHTRDFYHQRGIPYRRGYLLHGPPGTGKTSLSLALASMFKLELYLLHVPSLANDGELESMFDELPPRCIILLEDIDAVGIPRRNELAARMTGLDDKDDDEDDEDEENGSGRGRSTLSGLLNVLDGVASQEGRIVFMTSNLADKLDPALVRPGRIDRKIFLGNINQESARLMFLRMYAESDDSQFADLGPAAEMEMSELSGQTTPAIISPGPPTSLDEKVNTVELEKVAAEFASHIPDDAVTPALIQGFLLSHRSDPLAARDGIQDFIKDEMLKLEEAREKALRARETKARKRKSKALAQLGALATLTAKTRAAVSTDSEEPVGNATVEALAKTATSGAAGGLGSPSDSKAAPGATEGAEAIKNDGSHTNHTEGAGKDTPSGKQSKAGEDGSIGNGTTEVGV

SEQ ID NO: 30198 - protein, 358 aa, Staphylococcus aureus subsp. aureus MRSA252
MSQAVKIELRETLKEKPDTSQLGFGKYFTDYMLSYDYDADKGWHDLKIVPYGPIEISPAAQGVHYGQSVFEGLKAYKKDGEVALFRPDENFKRLNNSLARLEMPQVNEGELLEGLKQLVDLEREWVPEGEGQSLYIRPFVFATEGVLGVGASHQYKLLIILSPSGAYYGGETLKPTKIYVEDEYVRAVRGGVGFAKVAGNYAASLLAQTNANKLGYDQVLWLDGVEQKYIEEVGSMNIFFVENGKVITPELNGSILPGITRKSIIELAKNLGYEVEERRVSIDELFESYDKGELTEVFGSGTAAVISPVGTLRYEDREIVINNNETGEITQKLYDVYTGIQNGTLEDKNGWRVVVPKY

SEQ ID NO: 30199 - protein, 396 aa, Synechococcus sp. WH 8102
MAQKQSGDLRHARTGIELRPGLDGVPATQSAICDIDGEQGLLTYRGYPMQDLAANSSFLETAFLLIWGELPSRDQLAEFEHAVQMHRRVSFRVRDMMKCFPASGHPMDALQSSAASLGLFYSRRAIDDPQYVYDAVVRLIAKIPTMVAAFQLIRKGQDPIQPRDDLAYSANFLYMLTEREPDPLAARIFDRCLMLHAEHSLNASTFSARVTASTLTDPYAVVASAVGTLAGPLHGGANEDVLAMLEEVGTAENAGAYLDEAMAAKRKIMGFGHREYKVKDPRAVILQALVEEMFARFGHDELYDVAVAIEREAESRLGPKGIYPNVDFYSGLVYRKLGIPRDLFTPVFAIARVAGWLAHWREQLGANRIFRPSQIYSGSQLRAWMPIDERVTAPAA

SEQ ID NO: 30200 - protein, 2216 aa, Candida albicans SC5314
MAQLSVPITPPMESTGDVLMTLETQDGIALQGYSFGAAKPAAGEVVFQTGMVGYPESITDPSYEGQILVITYPLVGNYGVPDRELLDEDYEPALPKYFESNKIHIAGLVVAHYTEEYSHWLAKSSLGKWLQEQGIPAIYGVDTRSLTKRLREKGSTLGRLAIQNSDYKSEEIISQSKSNPQNWKKFFNVPEFDDPNVKNLVAKVSTDKPILYTPKKTNENIKLGKNGKPIRILAVDVGMKYNQIRCFVRRGVELLVVPWDYDFTTEEYDGLFISNGPGDPAVMDKTVERLQKILKEGKTPVFGICLGHQLLARATGASTLKLKFGNRGHNIPCTSTISGRCYITSQNHGYAVDTATLSNGWKELFVNANDGSNEGIYHESKPFFSVQFHPESTPGPRDTEFLFDVFIKSVVDFNQSGGVYKQVEFPGGKLAENRAAHPKVDVKKVLVLGSGGLSIGQAGEFDYSGSQAIKALKEEGIYTVLINPNIATIQTSKGLADKVYFLPVTPEFVRKVIKHERPDGIYCTFGGQTALSVGIALKDEFEGLGVKVLGTQIDTVITTEDRELFASAMAEINEKCARSEACNTVKEAVDAANAIGYPLIVRAAYALGGLGSGFADNEEELVALCNKAFATSPQVLVERSMKGWKEVEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAYTAAKLGLNIPLNEIKNSVTKSTSACFEPSLDYCVVKIPRWDLKKFTRVSALLSSSMKSVGEVMAIGRTFEEAIQKAIRSTDYHNLGFNKTAALMSIDIDQELQTPSDQRLFAIANALSDGYSVDKVWKLTNIDKWFLNKLDGLIKFGNKIASYGAKEDVPMSILRQAKQLGFEDRQIAKFLGSNEVAIRRLRKDAGIIPFVKQIDTVAAEFPAFTNYLYVTYNADSSDVKFDDNGVIVLGSGVYRIGSSVEFDWCAVRAIRTLRENNVKTVMINYNPETVSTDYDEADRLYFEPINLERVLDIYDLEQSSGVIISMGGQTSNNIALPLYRQNVKILGTSPEMIDSAENRYKFSRMLDRIGVDQPAWKELTSIDEAEDFAEKVGYPVLVRPSYVLSGAAMNTVYSKDDLASYLGQAVDVSPDYPVVITKYIENAKEIEMDAVAKDGKMIMHVVSEHVENAGVHSGDATLIVPPQDLDPETVRRIVEATAKIGKALDITGPYNIQFIAKDNDIKVIECNVRASRSFPFVSKVVGVDLIEMATKAMLDLPIVPYPGERLPEDYCAVKVPQFSFSRLAGADPVLGVEMASTGEVATFGKNKYEAYLKSLISTGFKLPKKNILFSIGSFKEKQELLPSIAKLHELGYKIFATAGTADFIKEHGIPVHYLEVLSKDEDQKSEYNLSQHLANNLIDLYVNLPSANRFRRPASYMSKGYESRRMAVDYAVPLVTNVKNAKLLVEAIARNISLEVSNRDAQTSHGTAILPGLINITSFATSFDDFEQTTKESLAAGFTFNAFLPHTQAGASVTDYRSLIDAIDAVGASAYTDYSVSIAASETNSQSVSDAADNAGSLFLPFNDFANSKVSALTAQFSSWPNNKPIITDAKTTDLASVLLLASLYNRSIHITGVSSKEDLDLIKMAKEKTLQVTCDVAVHSLFLSKDELDYPFLPNKQDQEYLWENLKDVDCFSIGVLPYLIAKASGTEIAPGMGIKEAVPLLLTAVKAGKLTIGDIVSKFHDNPAKIFNLPKQDAQVVLDLDRFATVEPVYPEFSKLRLRGAVERVSFHNETVVLDGSVLSQIALGKNEVVPRSRFGSTAGIPESPRLGNKRVSFSSDMRRPSLAPETPEPQPAIFEKLGSELVSQPIAGSLGEIAALSDYIRHNNTFLRNNIISVKDITRSDLHSLFTVAQEMRLAVERQGVLDLLQGRVLATMFYEPSTRTSTSFDAAMQRLGGRVVAVDHGSSSVKKGETLQDTIRTLSCYSDAIVLRHPSEESADIAAKYSPVPIINAGNGTKEHPTQALLDLFTIREELGTVNGITVTFMGDLKYGRPVHSLCHLLRHYQVRVQLVAPKELQIPAEIRQQLIDNNMLIAESEELTKEILARSDVLYCTRVQEERFADKEQYQRLKDTYIVDNKILSNAKQHMCVMHPLPRTNEIREEVDFDQRAAYFRQMRHGLFIRMALLAMVIGVDF

SEQ ID NO: 30201 - protein, 308 aa, Arabidopsis thaliana
MAEENLELSLLCTESNVDDEGMIVDETPIEISIPQMGFSQSESEEIIMEMVEKEKQHLPSDDYIKRLRSGDLDLNVGRRDALNWIWKACEVHQFGPLCFCLAMNYLDRFLSVHDLPSGKGWILQLLAVACLSLAAKIEETEVPMLIDLQVGDPQFVFEAKSVQRMELLVLNKLKWRLRAITPCSYIRYFLRKMSKCDQEPSNTLISRSLQVIASTTKGIDFLEFRPSEVAAAVALSVSGELQRVHFDNSSFSPLFSLLQKERVKKIGEMIESDGSDLCSQTPNGVLEVSACCFSFKTHDSSSSYTHLS

SEQ ID NO: 30202 - protein, 527 aa, Aspergillus nidulans FGSC A4
MADAVIAGQRVEAPVTWKAYLMCVFAAFGGIFFGYDSGYINGVMGMDYFIQEFTGKVKSETPAAQFVISSSNKSLITSILSAGTFFGAIIAGDLADWYGRRITIINGCGVFMAGVAFQIASTTVPMLVVGRLIAGVGVGFVSAIIILYMSEISPRRFRGAIVSGYQFCITIGLMLASCVNYGTENRNDSGSYRIPIALQLLWAIILGIGLFVLPESPRYYVRKNNLAEAAKTLARVRGQPPESEYITQELAEIVANNEYEMQVIPQGGYFATWLNCFRGGLRSPNSNLRRVILGTSLQMMQQWTGVNFVFYFGTTFFQNLGTIDDPFLISMITTIVNVFSTPISFYTMEKLGRRPLLLWGALGMVVCQFIVAIAGTVDGDNSKTVSAQISFICIYIFFFASTWGPGAWVVIGEIFPLPIRSRGVALSTASNWLWNCIIAVITPYMVDIDKGNLKSRVFFIWGSLCACAFVYVYFLIPETKGLTLEQVDKMMEETTPRTSAKWKPHSTFATEMGMTEKNASTTVESAA

SEQ ID NO: 30203 - protein, 896 aa, Xylella fastidiosa Dixon
MNRLKEALHNDPNPLETQEWLESIKAVIDIAGPERAHQLLEGVAEQIHRTGTNLPFSPITEYVNTIPTADEAKNPGDPALERSIRSIIRWNAMATVVRANRKPGDLGGHIASFASSATLYDVGFNHFWRAPSPQHPGDLLYIQGHSSPGIYARAFLEGRISESQLDHFRMEVDGKGISSYPHPWLMPQFWQTPTVSMGLGPLSAIYQAQFMKYLEHRGLIAPSDRKVWCFIGDGESDEPETLGAIALAGREGLDNLIFVVNCNLQRLDGPVRGNGKIIQELEGVFRGGGWNVIKLLWGAHWDPLLAQDTQGVLRKLMMETVDGEYQNCKAFGGEYTRKHFFDKYPETAAMVAHLSDNDIWRLNRGGHDPHKIYAAYHRAVNTQGMPTVILAKTVKGYGMGTAGESLNPTHQTKKLDHDAIKHFRDRFNIPISDQQLDAADHIPFYHPGPDSPEIKYMLARREALGGFLPQRRTKSSKSFIVPGLDKYERLLTSSGERTYSTTMAFVQSLNITLRDKALGPHIVPIVADEARTFGMEGLFRQIGIYAPFGQKYKPVDADQLMYYREDESGQVLQQGITEPGAIASWMAAGTSYSVSDVPMLPFYIYYSMFGFQRIGDIAWQAADMRTRGFLLGGTAGRTTLNGEGLQHEDGHSHLMAGAIPNVRSYDPTFGYEVTVILQHGMKAMMQDQIDEYYYLTLMNENYAHPDMPAGVEQGIIKGMYLLKDAGKPKKGELRVQLLGSGTILREAIAAAELLHQDFGITADIWSCPSFSELRKDGFDAERWNRLHPDNEPRTPYVTQQLENRQGPAIAATDYVRLFADQIRAFVPMHYTVLGTDGFGRSDTRSNLRRFFEVDRYFIAHAAIAALAKEGKMTGKDVARAIEQYNINPEKPNPVDI

SEQ ID NO: 30204 - protein, 323 aa, Arabidopsis thaliana
MPTLYKKAGFMVRGDDQLNGLQGGKRALDILCVATERTVSAFAYEEIGETSTEGDKRRERLRRLRRLINYSLSTTMNSSLSKRLKIDECKNQDPEQNPNRVASSPSSCHLESKRPQKVVSNKPVRNRKPVIVTDEDRTPTEWLIDVMREVNGMDAKLIFVKVLPNSDVDELQTRLMMPWKQILDMDFLNEEELEKIDRHHKKISASDKGADVIVVNSKGLQRKLKLKRWDMTSTSNYVLGLGWNKVVTDNILQRGTRLRIWSFHSPDMLFFAFVLSDPDPAPTECLNLLAKLCEETTCLEALQEANRMSSLVSDTELDLELRL

SEQ ID NO: 30205 - protein, 483 aa, Zea mays
MATSVRGFSSAPCRDVPGSYGLPLVGAVRDRLDFYYFQGQDKYFESRVERYGSTVVRMNVPPGPFMARDPRVVAVLDAKSFPVLFDMDKVEKKDLFTGTYMPSTSLTGGHRVCAYLDPSEPTHAKVKQLLFSLLLSRKDDVIPVFRSNFSSLLATVESDLAQGGKAEFNKLNDVTSFDFIGEAYFGVRPSATDLGKGGPTKAAKWLIWQLHPLLTLGLPMVLEEPLLHTFHLPPFLVKGDYGALYKYFSTVAKQALDTAEGLGLSREEACHNLLFATTFNSYGGLKVLFPGILANVASAGEKLHERLVAEIRGAVAEAGGKVTLAAVEKMELVKSVVWESLRLDPPVKFQYGHAKKDLQVQSHDAVFQVKKGEMLFGYQPCATKDPRVFGATAKEFVPGRFLGEEGSKLLQYVYWSNGRETENPTVDNKQCPGKNFVVLVGRLFLVELFLRYDTFTADIGKDLLGSSVVFTSVTKATSGPGSE

SEQ ID NO: 30206 - protein, 493 aa, Legionella pneumophila str. Paris
MNKLENALYRCDQIKACEQQAATLYQKDENALMALAGAEAFSFLQKIYPHVRHIAVFCGAGNNAGDGYVLARLAHEQGFSVTVYQCKSIEDLPSAARNAARLALTSGVHCQSADEPLDGDAELIVDALLGIGLQGAVHGVIANAIHQINASGLPVLSIDIPSGLNADTGLVENICVNATATITFIGLKTGMYTLDGPDYCGVIHCAHLNLEACRTKLTRFASLLRDSTLPLPLAARKKNSHKGDYGHVLVIGGGPGMPGAVSLAAKAALKTGAGVVTVATWPDYAKSALPLIPEAMIWGIKTAGELMPLLAKATVCVIGPGLGDSDWAKTLFLTAITTQLPMIIDASALRLLSQHPQMDDNWILTPHPGEAASLLSCTARDVQMDRYHAASAIQKQYGGVVVLKGVGTVIQTAERNIFVCPQGNPGMATAGMGDILSGIIAAFCAQGFTLSDAAKLGVWVHAVAGDKVAEKSGEVGVLASDLLDEIPSILNCI

SEQ ID NO: 30207 - protein, 540 aa, Novosphingobium aromaticivorans DSM 12444
MQLSHLSLHLDRNGQCAYRPAMSIQPSESILIVDFGSQVTQLIARRVREAGVYSEIAPFSQAEAAFHRMKPKGIILSGSPASVPADGSPRAPQVLFDSGLPILGICYGQQVMSEQLGGKVEPGDSGEFGRAFLTVTEPCVLFDGLWAVGERHQVWMSHGDKVTQFAPGFRIVAVSDGAPFAVIANDEKKYYGTQFHPEVVHTPDGGKLIANFVRHVCGCAGDWSMAEFRRTKIAEIREQVGDSRVICGLSGGVDSAVAAVLIHEAIGDQLTCVFVDHGLMRMGEAEQVVSLFRNHYNIPLVHKDVSALFLGGLAGVTDPEAKRKFIGKTFIDVFEAEARQVGGADFLAQGTLYPDVIESVSFTGGPSVTIKSHHNVGGLPERMNMKLVEPLRELFKDEVRALGRELGLPEIFVGRHPFPGPGLAIRIPGEVTKERCDILRKADAIYLEEIRNAGLYDAIWQAFAVLLPVKTVGVMGDGRTYDSVCALRAVTSTDGMTADIYPFDAGFLSRVATRIVNEVKGINRVVYDYTSKPPGTIEWE

SEQ ID NO: 30208 - protein, 506 aa, Arabidopsis thaliana
MELSLLRPTTQSLLPSFSKPNLRLNVYKPLRLRCSVAGGPTVGSSKIEGGGGTTITTDCVIVGGGISGLCIAQALATKHPDAAPNLIVTEAKDRVGGNIITREENGFLWEEGPNSFQPSDPMLTMVVDSGLKDDLVLGDPTAPRFVLWNGKLRPVPSKLTDLPFFDLMSIGGKIRAGFGALGIRPSPPGREESVEEFVRRNLGDEVFERLIEPFCSGVYAGDPSKLSMKAAFGKVWKLEQNGGSIIGGTFKAIQERKNAPKAERDPRLPKPQGQTVGSFRKGLRMLPEAISARLGSKVKLSWKLSGITKLESGGYNLTYETPDGLVSVQSKSVVMTVPSHVASGLLRPLSESAANALSKLYYPPVAAVSISYPKEAIRTECLIDGELKGFGQLHPRTQGVETLGTIYSSSLFPNRAPPGRILLLNYIGGSTNTGILSKSEGELVEAFLVGHFDILDTAKSSLTSSGYEGLFLGGNYVAGVALGRCVEGAYETAIEVNNFMSRYAYK

SEQ ID NO: 30209 - protein, 518 aa, Mycobacterium tuberculosis CDC1551
MMQPDAPALRFVGNTMTWADLRRRVAALAGALSGRGVGFGDRVMILMLNRTEFVESVLAANMIGAIAVPLNFRLTPTEIAVLVEDCVAHVMLTEAALAPVAIGVRNIQPLLSVIVVAGGSSQDSVFGYEDLLNEAGDVHEPVDIPNDSPALIMYTSGTTGRPKGAVLTHANLTGQAMTALYTSGANINSDVGFVGVPLFHIAGIGNMLTGLLLGLPTVIYPLGAFDPGQLLDVLEAEKVTGIFLVPAQWQAVCTEQQARPRDLRLRVLSWGAAPAPDALLRQMSATFPETQILAAFGQTEMSPVTCMLLGEDAIAKRGSVGRVIPTVAARVVDQNMNDVPVGEVGEIVYRAPTLMSCYWNNPEATAEAFAGGWFHSGDLVRMDSDGYVWVVDRKKDMIISGGENIYCAELENVLASHPDIAEVAVIGRADEKWGEVPIAVAAVTNDDLRIEDLGEFLTDRLARYKHPKALEIVDALPRNPAGKVLKTELRLRYGACVNVERRSASAGFTERRENRQKL

SEQ ID NO: 30210 - protein, 211 aa, Shewanella oneidensis MR-1
MSTQTNTKSDFSELDWDKQDGLIPAVIQNHLSGKVLMLGYMDKAALEQTLATGDVTFFSRSKQRLWTKGETSGHTLKLVAIDKDCDNDSLLVQVLPNGPTCHKGTESCWLDGNAHPFLNNLAELIASRKGQSPESSYTASLFARGTKRIAQKVGEEGLETALAAATHDKEELVNEASDLMYHLLVLLEDQALSLSDITANLLARHQKAQRK

SEQ ID NO: 30211 - protein, 804 aa, Parvularcula bermudensis HTCC2503
MAEVNGSSDAKTIPTDQDPRQDKAQGRELAPETDIPPRQASRSAVGLFPGLEPAPAAPTLTGKPPDFIRQYELVDRIRSYDPEVDEALLDRAYVFAMRAHGDQKRSSGDPYISHPLAVASILTELKLDQETIATALLHDVVEDTPVTIGEITDIFGPVIAELVDGVTKISKRELAPDADGKTENFAKFLLATAKDLRVLIVKLADRLHNMRTLHFVPSTEKRARIARETMDIYAPMAGRIGMQAVKEELEDLSFRYLYPEAFDRITDRLDLLSQRAGPHIVRLATRLRESLAEAGMVAEVYAREKRVYSIWRKMQRKGSTFEELADIYAFRVIVEDGDACYRALGIIHQAFKMIPGEFDDYVSTPKPNGYRSIHTAVLASSEDSEAGTRYEGQRVEIQIRTFEMHEVAERGIAAHWRYKASQNDGGRAGGPEAGKDDPYLWLRGMIETLATEGGKDLLLAQAKLDLYHDQIFPFTPKGRVIPLPTDGTVLDFAYGLHTELGDRCAGAKVNGALRPPRSRLRTGDVVEILTNENAPIPQAWESFVVSAAAKTGLRRRARALNKRDKIILGERVVAAAFAARHLPFSSRAVEGVVAKLGFDQVDALYEAAGEMTLPARQVVEAVYPDLDADTDQHTGEGRLVETGAPLPRRAVSIAGMTPGGAITLGLCCGPLPGQRIIGLRDGENDSITVHTIDCERLADRQEEEWIDLAWSDSLTDTFIVPIVLTVNNKTGALGDIGTLLGRYGADILDINVEKRDVDFTDLCLDISVRDVRHLQSVLTGLRVSDYVVSAEKTESREEGPYDRR

SEQ ID NO: 30212 - protein, 271 aa, Brassica oleracea var. botrytis
NWGFFELLNHGIPYDLMDNIERMTKEHYKEFMEQKFKEMLRSKNLDTLETEVENVDWESTFFLHHLPQTNLYDIPDMSDEYRAAMKDFGKRLENLAEELLDLLCENLGLEKGYLKKVFSGTKGPTFGTKVSNYPPCPKPEMIKGLRAHTDAGGLILLFQDDKVSGLQLLKDGVWVDVPPLKHSIVINLGDQLEVITNGKYKSITHRVMTQKEGNRMSIASFYNPGSDAESSPAPSLVEKDSDEYPSFVFDDYMKLYAGVKFQPKEPSFEAM

SEQ ID NO: 30213 - protein, 470 aa, Arabidopsis thaliana
MKVELVFIPSPGVGHIRATTALAKLLVASDNRLSVTLIVIPSRVSDDASSSVYTNSEDRLRYILLPARDQTTDLVSYIDSQKPQVRAVVSKVAGDVSTRSDSRLAGIVVDMFCTSMIDIADEFNLSAYIFYTSNASYLGLQFHVQSLYDEKELDVSEFKDTEMKFDVPTLTQPFPAKCLPSVMLNKKWFPYVLGRARSFRATKGILVNSVADMEPQALSFFSGGNGNTNIPPVYAVGPIMDLESSGDEEKRKEILHWLKEQPTKSVVFLCFGSMGGFSEEQAREIAVALERSGHRFLWSLRRASPVGNKSNPPPGEFTNLEEILPKGFLDRTVEIGKIISWAPQVDVLNSPAIGAFVTHCGWNSILESLWFGVPMAAWPIYAEQQFNAFHMVDELGLAAEVKKEYRRDFLVEEPEIVTADEIERGIKCAMEQDSKMRKRVMEMKDKLHVALVDGWIFELCSKEVCSRRGR

SEQ ID NO: 30214 - protein, 398 aa, Oltmannsiellopsis viridis
MAIEAIIKPKQVKNFTLNLGPQHPSAHGVLRLVLELNGEVIERADPHIGLLHRGCEKLIEYKTFVQALPYFDRLDYVSMMAQEHSYCLAIEKLVDCELPLRAQYIRVLFSEITRILNHLLALSCHALDVGALTPFLWAFEEREKLLEFYERASGARMHAAYFRPGGVAQDLPAGLCDDIHQFAKQFASRLDEIEEMLTNNRIWKQRLVDIGTVTAKEALDWGFSGVLVRGSGIPWDLRTAQPYEVYDRMKFSVPVGIRGDCYDRYLIRVEEMRQSLQIIMQALNQMPNGCVKVDDKKLTPPSRSQLKQSMESLIHHFKLYTEGFNVPASETYAAVEAPKGEFGVFLVSNGTNKPYRCKIRAPDYNSLQGLDFMARKHLLADVVTIIGTLDVVFGSIDR

SEQ ID NO: 30215 - protein, 859 aa, Legionella pneumophila subsp. pneumophila str. Philadelphia 1
MSGILIMQQVVIKFGGTSVSTRATWNNIAAITQKHLNTGVQPVIVCSALTQISNKLEKAIEAALLDEHHSLFNDIQSSHLNLAEQLEVNHQLIANDLHQLQQWLTGISLLKQAPAKTHAQILSLGELMMTRLGHAFLEKQGIKVKWYDARELLTSTPTLGGETMNYLSARCESEYDSALVEKFLSSGAQAIITQGFFAANPHGETVLLGRGGSDTSAALLAGKLQAASCEIWTDVPGIYTANPHQLPHARLLKQLNYDEAQEIASMGAKVLHPNCIPPVRKANIPMVVKYTHLPEHSGTLITKDIDESAPLIKSIQVKHSILLISIDTLNMWQQVGFLADVFAAFKKHGFSVDLLSSSEFNVTLSLDVNAKIHDRPAINALLDDLNQFGRAKLIEPCSAVSLVGHHIRTVLPHLGPALEVFEAKQVYLMSLASNDLNLTFVVDESHADKLCQRLHHLLIESNPQIFYYSKSWHEEFGKPNVRPTPWWEIERDRLLTTSAIHSPCYVYHSPTQATRARQLSALESIDSLFYAIKANPFPTILKTLEKEGIGFECVSIQELELVLKLFPNIKKERILFTPNFAPKSEYEFALQTGCYVTIDSLYPLENWPDLFKDREVIVRIDPGTGAGHHKHVSTGGNESKFGITQNDISKILSLTKVNHIKVIGLHAHSGSGILSTDLWQQTAVMLASLTDQFPEVRSINLGGGLGIVEKPGQHPIDFAALDAQLMAVKSQYPGLAIWLEPGRFFVAESGVILAKVTQCKEKGKVKFIGIETGMNSLIRPSLYGAYHEIVNLTRLHEEKAGFAHIVGPICESGDTLGYDRLLPVTREGDVILIANTGAYGHCMSSHYNLRPPAQEIVLE

SEQ ID NO: 30216 - protein, 836 aa, Saccharomyces cerevisiae
MAHRKLQQEVDRVFKKINEGLEIFNSYYERHESCTNNPSQKDKLESDLKREVKKLQRLREQIKSWQSSPDIKDKDSLLDYRRSVEIAMEKYKAVEKASKEKAYSNISLKKSETLDPQERERRDISEYLSQMIDELERQYDSLQVEIDKLLLLNKKKKTSSTTNDEKKEQYKRFQARYRWHQQQMELALRLLANEELDPQDVKNVQDDINYFVESNQDPDFVEDETIYDGLNLQSNEAIAHEVAQYFASQNAEDNNTSDANESLQDISKLSKKEQRKLEREAKKAAKLAAKNATGAAIPVAGPSSTPSPVIPVADASKETERSPSSSPIHNATKPEEAVKTSIKSPRSSADNLLPSLQKSPSSATPETPTNVHTHIHQTPNGITGATTLKPATLPAKPAGELKWAVAASQAVEKDRKVTSASSTISNTSTKTPTTAAATTTSSNANSRIGSALNTPKLSTSSLSLQPDNTGASSSAATAAAVLAAGAAAVHQNNQAFYRNMSSSHHPLVSLATNPKSEHEVATTVNQNGPENTTKKVMEQKEEESPEERNKLQVPTFGVFDDDFESDRDSETEPEEEEQPSTPKYLSLEQREARTNEIKKEFVSDFETLLLPSGVQEFIMSSELYNSQIESKITYKRSRDMCEISRLVEVPQGVNPPSPLDAFRSTQQWDVMRCSLRDIIIGSERLKEDSSSIYAKILENFRTLEMFSLFYNYYFAITPLEREIAYKILNERDWKVSKDGTMWFLRQGEVKFFNEICEVGDYKIFKLDDWTVIDKINFRLDYSFLQPPVDTASEVRDVSVDNNNVNDQSNVTLEQQKQEISHGKQLLKQLKQGKISV

SEQ ID NO: 30217 - protein, 188 aa, Triticum aestivum
  misc_feature (30)..(30): Xaa can be any naturally occurring amino acid
  unsure (1)..(188): unsure at all Xaa locations
IVAHAPPRGGLVGTPGGSFQGVKSTAGLPXSRRYKGGSLGSVSNGGRIRCMQVWPIEGIKKFETLFYLPPLSTEALLKQVDYLIRSKWVPCLEFSKVGFIFREHNAFPGYYDGRYWTMWKLPMFGCTDATQVINEVEEVKKEYPDAYVRIIGFDNMPQVQWVSFIAFKPPGCAPPPPGLNRSLTTGHI

SEQ ID NO: 30218 - protein, 361 aa, Pyrococcus furiosus DSM 3638
MQAVVLAGGKGTRLLPLTVYRPKPMIPFFNRPIMEYIVESLVKFGVDEIIVLVGYLKERIFEYFGNGEEFGVEIKYSNGENLKLGTAGALKKAEKLIQDTFLVVSGDILTNLDFRSLVEYHKKKGGPATIALTKVEDPSAYGVAVLDKEGRISYFKEKPKREEAPSNLVNAGIYVFEPEIFDLIPKGKNFDFSLDLFPKMLNENIPIYGYPFDEYWNDIGRPSTYLQATEDVFLGKLRLPQINVGSLKGNIEKGGSLFTGSRCILRRPRIIGFAVLGNNVEISKDVTIERSVIFSNVTIEEGAEIREAIIGENVYIGKGVVIEPGSVIGDNSIIEDFSKVGANVKIWADSRIGKESIILPD

SEQ ID NO: 30219 - protein, 571 aa, Staphylococcus aureus subsp. aureus COL
MFNEKDQLAVDTLRALSIDTIEKANSGHPGLPMGAAPMAYTLWTRHLNFNPQSKDYFNRDRFVLSAGHGSALLYSLLHVSGSLELEELKQFRQWGSKTPGHPEYRHTDGVEVTTGPLGQGFAMSVGLALAEDHLAGKFNKEGYNVVDHYTYVLASDGDLMEGISHEAASFAGHNKLSKLVVLYDSNDISLDGELNKAFSENTKARFEAYGWNYLLVKDGNDLEEIDKAITTAKSQEGPTIIEVKTTIGFGSPNKAGTNGVHGAPLGEVERKLTFENYGLDPEKRFNVSEEVYEIFQNTMLKRANEDESQRNSLLEKYAETYPELAEEFKLAISGKLPKNYKDELPRFELGHNGASRADSGTVIQAISKTVPSFFGGSADLAGSNKSNVNDATDYSSETPEGKNVWFGVREFAMGAAVNGMAAHGGLHPYGATFFVFSDYLKPALRLSSIMGLNATFIFTHDSIAVGEDGPTHEPIEQLAGLRAIPNMNVIRPADGNETRVAWEVALESESTPTSLVLTRQNLPVLDVPEDVVEEGVRKGAYTVYGPEETPEFLLLASGSEVSLAVEAAKDL

SEQ ID NO: 30220 - protein, 138 aa, Brassica napus
  misc_feature (19)..(19): Xaa can be any naturally occurring amino acid
  misc_feature (128)..(128): Xaa can be any naturally occurring amino acid
  unsure (1)..(138): unsure at all Xaa locations
MARTKQTARKSTGGKAPRXKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQXLARRIRGERA

SEQ ID NO: 30221 - protein, 450 aa, Clostridium symbiosum
MSKYVDRVIAEVEKKYADEPEFVQTVEEVLSSLGPVVDAHPEYEEVALLERMVIPERVIEFRVPWEDDNGKVHVNTGYRVQFNGAIGPYKGGLRFAPSVNLSIMKFLGFEQAFKDSLTTLPMGGAKGGSDFDPNGKSDREVMRFCQAFMTELYRHIGPDIDVPAGDLGVGAREIGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVSGFEMSQNSERLSWTAEEVDSKLHQVMTDIHDGSAAAAERYGLGYNLVAGANIVGFQKIADAMMAQGIAW

SEQ ID NO: 30222 - protein, 595 aa, Rhodococcus sp. RHA1
MTATLDAPVDTNIPQPGDIARRWLAGFGATLERGDARGAAQHFLVDGWWRDLLSFTWDLHTTHGRADIESRLADSVPVHEPRHLVLSPAHPAEAVADPEGDWIQAFFTFETTLARSRGFVRLRRDDDGEWRAWTLISAMEEIKGHEEKKGHRRVQGTNHGAHRGKINWLDRRTAKGEFETEQPAVVIVGAGQGGLALAARLGQLGVDTLLVERNDRIGDSWRKRYHSLVLHDPVWYDHLPYLNFPDHWPVFTPKDKLANWFEFYADAMELNVWTGTEFTGGSYDDATGEWTVTVARDDGSTRTLHPRHVVLATGMSGVPNIPRIAGADTFEGTIEHSSWFVGGREMQGKKALVVGCCNSGHDIAQELNEQGADVTILQRSSTYVMSSKHGIPGLFGGVYEEGGPAVQDADLIFASLPYPLLAGIHAGATEAIAEKDAEMLDGLRKAGFKVDFGEDGSGLFMKYLRRGGGYYIDVGASELIASGEVSVKQGTEIDHFTPDGVVFADGTEMPVDVVVLATGYKNMRESARKFLGDAVADRCQDVWGLDAEGELRTVWRRSGHPGFWFMAGNLHQSRHYSKYLAFQIKAQEEGLQPIR

SEQ ID NO: 30223 - protein, 363 aa, Shewanella oneidensis MR-1
MNPVFTPNVAQKILFIDRDGTLIEEPVTDKQVDNLAKLVFEPQVIPALLRLQKAGFRLVMVSNQDGLGTPSFPQEDFDAPHNMMMQILSSQGVKFEDVLICPHFNDENCSCRKPKLGLVKDFLTQGFIDFTQSAVIGDRHTDVELGNAMGIISFQYQRGSLGWNAIADALLNKGRSATVVRTTKETDIRVTVDLDNASKGTINTGIGFFDHMLDQIATHGNFKMEVNVDGDLEIDDHHSVEDTALAIGDALRQALGDKRGIARFGFSLPMDEAKGECLLDLSGRPFIKFAAQFEREKVGEMATEMVPHFFRSFADGLRCTLHVAAEGDNDHHKVEALFKVLGRALRQAVKVEGDVLPSSKGVL

SEQ ID NO: 30224 - protein, 459 aa, Debaryomyces occidentalis
MIKNGLPHEPEFQQAYNELVSALEESTLFTEKPEYKKVIPVVSIPERIIQFRVAWENDNGDVEVNNGFRVQFNSSLGPYKGGLRFHPSVNLSILKFLGFEQIFKNALTGLSMGGGKGGCDFNPKGRSDGEIRRFCVAFMRQLARYIGADTDVPAGDIGVGGREIGYLFGAYKQMQNNWYGVLTGKGLTWGGSLIRPEATGYVSFTTLKKMIEKATNGKESFKGKRVELSGSGNVAQYAALKVIELGGIVVSLSDSKGSIVSKNGIVPEQVLEIAAAKLKFKSLEEITKESVKLFSGENSVEYLAGVRPWAKVGHFDVALPSATQKEVSGEEEAKALVEAGCKYIAEGSNMGSTKEAIDVFEANRSNNVWYAPGKAANCGGVAVSGLEMAQNSQRVQWSAEEVDAKLKNIMYTCFDNCYDPAIKYSAEKNADGLPSLLKGANIASFIKVADAMFDQGDVY

SEQ ID NO: 30225 - protein, 535 aa, Populus tremuloides
MNPQEFIFRSKLPDIYIPKNLPLHSYVLENLSKHSSKPCLINGANGDVYTYADVELTARRVASGLNKIGIQQGDVIMLFLPSSPEFVLAFLGASHRGAMITAANPFSTPAELAKHAKASRAKLLITQACYYEKVKDFARESDVKVMCVDSAPDGASLFRAHTQADENEVPQVDISPDDVVALPYSSGTTGLPKGVMLTHKGLITSVAQQVDGDNPNLYFHSEDVILCVLPMFHIYALNSMMLCGLRVGASILIMPKFEIGSLLGLIEKYKVSIAPVVPPVMMAIAKSPDLDKHDLSSLRMIKSGGAPLGKELEDTVRAKFPQARLGQGYGMTEAGPVLAMCLAFAKEPFDIKPGACGTVVRNAEMKIVDPETGVSLPRNQPGEICIRGDQIMKGYLNDPEATSRTIDKEGWLHTGDIGYIDDDDELFIVDRLKELIKYKGFQVAPTELEALLIAHPEISDAAVVGLKDEDAGEVPVAFVVKSEKSQATEDEIKQYISKQVIFYKRIKRVFFIEAIPKAPSGKILRKNLKEKLPGI

SEQ ID NO: 30226 - protein, 396 aa, Bacteroides thetaiotaomicron VPI-5482
MAEKRDYYEVLEVTKTATVEEIKKAYRKKAIQYHPDKNPGDKEAEEKFKEAAEAYDVLSNPDKRSRYDQFGHAGVSGAAGNGGPFGGFGGEGMSMDDIFSMFGDIFGGRGGGFSGGFGGFSGFGGGGGGSQQRRYRGSDLRVKVKMTLKEISTGVEKKFKLKKYVPCNHCHGTGAEGDGGSETCPTCKGSGSVIRNQQTILGTMQTRTTCPTCNGEGKIIKNKCKECGGDGIVYGEEVVTVKIPAGVAEGMQLSMGGKGNAGKHNGVPGDLLILVEEEPHPDLIRDENDLIYNLLLSFPTAALGGAVEIPTIDGKVKVKIDSGTQPGKVLRLRGKGLPNVNGYGTGDLLVNISIYVPEALNKEEKSTLEKMEASDNFKPSTSVKEKIFKKFKSFFD

SEQ ID NO: 30227 - protein, 216 aa, Campylobacter upsaliensis RM3195
MKNKTLLFDLDGTLIDSTPAILNSFHFAFEKLGLKPSLDEDIKRLIGLPLDEAFKVLCKEKAYLAEQFVDFYREKYRTIYLDQTTLLPLAKEALEMASKFADLAVVTTKGSQFTKPLLDFLGVGHFFKSIVGRNDVQFAKPHPEPILTALKRLNKDKTHAFMIGDTQFDVLAAKAAGISHIALSCGYESIESLQKYSDCIKNNAYEAVKYIENSNI

SEQ ID NO: 30228 - protein, 814 aa, Burkholderia thailandensis E264
MRKMKLVMVGNGMAGVRTLEELLKLAPDLYDVTVFGAEPHPNYNRILLSPVLAGEQTLEQIVLNDYAWYESHGITLHVGKKIVKIDRVKRVVIADDGTEAAYDRLLLATGSNPFMLPIPGADLDGVLGYRDIADTQAMIDAAARHTHAVVIGGGLLGLEAANGLKLRGMDVTVAHLAPTLLERQLDAKAGGLLRASLEARGLTFLMPKETQALVGDENGRVRAVRFKDGDTCKADLVVMAVGIRPNTALAESAGLYCNRGIVVNDTMQTYDPRIYAVGECVSHRGIAYGLVAPLFEQAKVAANHLAQFGIGRYAGSVTSTKLKVTGIDLFSAGDFLGGGDTEDITLSDPIAGVYKKLVIKDDKIVGACLYGDTADGAWYFKLLREGRNIADIRETLMFGETSLGDTGHSGATRATAMADDAEVCGCNGVCKGTIVAAIKEKGLFTLDDVRKHTKASASCGSCTGLVEQILMSTVGGDYSASPKAKPICGCTDHTHAEVRMAIREHKLLSVPDAMRFLEWRTPNGCASCRPALNYYCISTWPHDAKDDPQSRFINERAHANIQKDGTYSVVPRMWGGVTSADELRRIADVVDKYAIPTVKVTGGQRIDLLGVKKEDLPGVWRDLGMPSGHAYAKALRTVKTCVGSEWCRFGTQDSTLMGQQLERALWRMYAPHKVKLAVSGCPRNCAESGIKDVGVIGVDSGWELYVGGNGGIKTEVAQFFCKVKTHEEVLEYAGAFLQLYREEGWYLERTVHYLERVGLDHVKARVLDDAENRRALWERLQFALKDEPDPWRDTQDAKVDLRQFIPIAVAPADA

SEQ ID NO: 30229 - protein, 250 aa, Brassica napus
MNSVSTFSELLGSENESPVGSDYCPMLAASCPKKPAGRKKFRETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQVEVNDTTDHDLDMEETIVEAVFREEQREGFYMAEETTVVGVVPEEQMSKGFYMDEEWMFGMPTLLADMAAGMLLPLPSVQWGHNDDFEGVADINLWSY

SEQ ID NO: 30230 - protein, 327 aa, Parvularcula bermudensis HTCC2503
MPTNVSASDTIATGRAVLTTEANALHTLGEQLDDAFAAAVRHLTATSGFTVVTGVGKSGHIGRKMAATFASTGTPSFFVHPTEASHGDLGMLDPKGVLIAISNSGETRELRDILLYANRRHVPLIAMTARPDSFLAKRAEVTLLLPRTPEACPNGLAPTSSTTMTLALGDALAVAAMTARGFSKEDFGARHPGGRLGMQLQRIEEYLGLQAGRTIPTLPSAAPLTDVLQKISEGRVGAVAVVDAAGLLEGIVTDGDVRRGIMGYTDVQSLTAADLMSRSPITIAPHQRVSSAVEIFETRAISQILVIAEGQPIGVVHIKDLMADGYL

SEQ ID NO: 30231 - protein, 535 aa, Schizosaccharomyces pombe 972h-
MAKILTIVMLVFVSMAGWMFGADTGSIGGITNMRDFQSRYADRYDPVTDTYSYSSARQGLLVGMVNTGTTVGCLLSSPLGDRFGKRKCIMGWTLVYITGVIVQLTTIPSWVQMMVAKIWTGLGIGALSVIAPGYQSESSPPHIRGAIVTTYQLFITLGIFIAACINMGTHKYTTHPEAQWRVPIGINLLWGILMFFGMLFLPESPRYLAVKGRNEECMKILTRNAGLPADHPIMQKEYNAIQADVEAELAGGPCSWPQIFSNEIRYRTLLGMGVMAFQQLTGNNYFFYYGTQVFRGTGLNSPFLAALILDAVNFGCTFGAIFVLEYFGRRGPLIVGGVWQSICFFIYASVGDRALTRPNGTSNHRAGAVMIVFSCLFIFSFAQTWAPAAYVIVGESYPIRYRSKCAAVATASNWFWNFMISFFTPFISNSIGFKYGYVFAACNLCAAIIIFLFAKETKGLTLEEINQLYLSNIKPWNTGAYQRDREDIKQSDSEKERGPTSKLHEYVEHAPNSYASTHSTESENYPQQVTNPVGL

SEQ ID NO: 30232 - protein, 1073 aa, Bacteroides fragilis YCH46
MEKEMKKVLVLGSGALKIGQAGEFDYSGSQALKALKEEGINSVLVNPNIATIQTSEGIADKVYFLPVTTYFVEEIIKKERPDGILLAFGGQTALNCGAELYTKGILDKYGVKVLGTSVEAIMYTEDRDLFVKKLDEIEMKTPISQAVESMEDAIAAARRIGYPVMVRSAYALGGLGSGICANEEEFLKLAESSFAFSKQILVEESLKGWKEIEFEVIRDANDHCFTVASMENFDPLGIHTGESIVVAPTCSLDDKELKMLQELSTKCIRHLGIVGECNIQYAFNSDTDDYRVIEVNARLSRSSALASKATGYPLAFVAAKVALGYTLDQIGEMGTPNSAYVAPQLDYYICKIPRWDLTKFAGVSREIGSSMKSVGEIMSIGRSFEEIIQKGLRMIGQGMHGFVGNDDVHFEDLDKELSHPTDLRIFALAQAMEEGYTIERIHELTKIDPWFLGKLKNIVDYKAKLSAYDKVEDIPADVLREAKVLGFSDFQIARFVLNPVGNMEKENLMVRARRKELGILPAVKRINTIASEHPELTNYLYMTYAVQGYDVNYYKNEKSVVVLGSGAYRIGSSVEFDWCSVNAVQTARKLGYKSIMINYNPETVSTDYDMCDRLYFDELSFERVLDVIDLEQPRGVIVSVGGQIPNNLAMKLYRQSVPVLGTSPISIDRAENRNKFSAMLDQLGIDQPAWQELTSLEDVKGFVEKVGYPVLVRPSYVLSGAAMNVCYDDEELENFLKMAAEVSKEYPVVVSQFLENTKEIEFDAVAQNGEVVEYAISEHIEFAGVHSGDATLVFPAQKIYFATARRIKKISRQIAKELNISGPFNIQFLARNNEVKVIECNLRASRSFPFVSKVLKRNFIETATRIMLDAPYSRPDKSAFDIDWIGVKASQFSFSRLHKADPVLGVDMSSTGEVGCIGDDFSEALLNAMIATGFKIPGKGVMFSSGAMKSKVDLLEASRMLFNQGYKIYATAGTAAFLNAHGVDTTPVYWPDEKPGAENNVMKMIADHKFDLIVNIPKNHSKRELTNGYRIRRGAIDHNIPLITNARLASAFIEAFCDLKLEDIQIKSWQEYK

SEQ ID NO: 30233 - protein, 400 aa, Campylobacter upsaliensis RM3195
MFDEIHFNTIERLPNYVFAEVNAIKMAARRAGEDIIDFSMGNPDGKTPQHIIDKLCESANKDKTSGYSTSMGIYKLRLAICNWYKRKYSVNLDPESEVVATMGSKEGFVNLARAVINPGDVAIVPTPAYPIHTQAFIIAGGNVTKMPLFYNDHFELDENAFFESLNRALYESVPRARYVVVNFPHNPTTITCEKSFYERLVAMAKKERFYIISDIAYADLTFDGYQTPSILEVEGAKDVAVETYTLSKSYNMAGWRVGFVVGNKRLIAALKKIKSWFDYGMYTPIQVAATIALDGDQKCVEEICQIYDKRKDVLLDSFANAGWNLQKPKASMFIWARLPENKRHLKSLEFSKQLLQKANVAVSPGLGFGEAGDEFVRIALIENENRIRQAARNIKKFLKD

SEQ ID NO: 30234 - protein, 394 aa, Synechococcus sp. WH 8102
MTQLETRTEPMVVNFGPHHPSMHGVLRLVVTLDGEDVVDCEPVIGYLHRGMEKIAENRTNVMFVPYVSRMDYAAGMFYEAVVVNAPEKMADIPVPKRASYIRVLMLELNRIANHLLWLGPFLADVGAQTPFFYIFREREMIYDLWEAATGQRLINNNYFRIGGVAADLPWGWLEKCRDFCDWFGPKIDEYEKLITNNPIFRRRIEGLGTIEKQDAINWSLSGPMLRASGVPWDLRKVDHYECYDDFDWQVASEKEGDCYARYRVRIEEMRQSLKILRQACDMIPGGPTENLEAKRLNEGKGSDAAGFDFQYVAKKVAPTFKIPNGELYTRLESGKGEIGVFIQGNNDVTPWRFKIRAADSNNLQILPHILKGHKVADIMAILGSIDVIMGSVDR

SEQ ID NO: 30235 - protein, 370 aa, Saccharomyces cerevisiae
MLLGYCGSGYYGMQYNPPHKTIEGEILTKLFDVGAISEENSLAPKKNSFMAAARTDKGVHAMLNLLSLKITLREDTVAKLNAALPPEIRVWGIQPVNKKFNARSACDSRWYQYLIPEFILIGPPRSSLLHRNVGGSYREDGSQEVWDTFLEQTRGRFSGDELCRLQDTAQKLSESDPLVQDYVGLLSGTLSGYCLSPSKLDAFEAAMQEYVGTHNFHNFTTGKLWGDPSAQRHIKKVVVSQASPGWICVRIHGQSFMLHQIRRMVALAVLAARCQLPPNIVRNYFNAGPRKYIPRAPAQGLLLEGPVFDGYNTKLRNLLYCEIRPDDITLERMCRFRERQICTAIAHEETQRHVFCHFVRQMNRLATPLI

SEQ ID NO: 30236 - protein, 312 aa, Pyrococcus furiosus DSM 3638
MIYAIGEILIDFIAKEEGKLKDVREFEKHPGGAPANVVVGLRRLGAKSALISKVGDDPFGEFLIEELKKERVETKYIIKDTNKHTGIVFVQLIGAKPEFILYDGVAYFNLRKEEIQWDFMRDAELLHFGSVLFAREPSRSTVFEVLRAVKGKVPISYDVNIRLDLWRGREKEMLKDIEEALKLADIVKIGDGELEYLNKNGIALEDFNFALVAITRGAEGSTIIHKDIRVDVPSFKVEPVDTTGAGDAFMAALLASLFYMGKLDILEFSKEELKELGSFANLVAALSTTKRGAWSVPSLEEVLKHRKFSFLP

SEQ ID NO: 30237 - protein, 883 aa, Arabidopsis thaliana
MPWWSKSKDEKKKTNKESIIDAFNRKLGFASEDRSSGRSRKSRRRRDEIVSERGAISRLPSRSPSPSTRVSRCQSFAERSPAVPLPRPIVRPHVTSTDSGMNGSQRPGLDANLKPSWLPLPKPHGATSIPDNTGAEPDFATASVSSGSSVGDIPSDSLLSPLASDCENGNRTPVNISSRDQSMHSNKNSAEMFKPVANKNRILSASPRRRPLGTHVKNLQIPQRDLVLCSAPDSLLSSPSRSPMRSFIPDQVSNHGLLISKPYSDVSLLGSGQCSSPGSGYNSGNNSIGGDMATQLFWPQSRCSPECSPVPSPRMTSPGPSSRIQSGAVTPLHPRAGGSTTGSPTRRLDDNRQQSHRLPLPPLLISNTCPFSPTYSAATSPSVPRSPARAEATVSPGSRWKKGRLLGMGSFGHVYLGFNSESGEMCAMKEVTLCSDDPKSRESAQQLGQEISVLSRLRHQNIVQYYGSETVDDKLYIYLEYVSGGSIYKLLQEYGQFGENAIRNYTQQILSGLAYLHAKNTVHRDIKGANILVDPHGRVKVADFGMAKHITAQSGPLSFKGSPYWMAPEVIKNSNGSNLAVDIWSLGCTVLEMATTKPPWSQYEGVPAMFKIGNSKELPDIPDHLSEEGKDFVRKCLQRNPANRPTAAQLLDHAFVRNVMPMERPIVSGEPAEAMNVASSTMRSLDIGHARSLPCLDSEDATNYQQKGLKHGSGFSISQSPRNMSCPISPVGSPIFHSHSPHISGRRSPSPISSPHALSGSSTPLTGCGGAIPFHHQRQTTVNFLHEGIGSSRSPGSGGNFYTNSFFQEPSRQQDRSRSSPRTPPHVFWDNNGSIQPGYNWNKDNQPVLSDHVSQQLLSEHLKLKSLDLRPGFSTPGSTNRGP

SEQ ID NO: 30238 - protein, 635 aa, Zea mays
MQGVTVQSPSTSSRGRIRPRHRPEASRSSSLLFEAPAFRRFATRRRRFGRASVPVPVGAVDDEVEVVSKVLRSRPKTKRAQIRLRPAQLRMASSKEDTMKSLVKVLVDCAEDATKSLRGLVDHALDHMHDEEILARTLFAMKEKLDLLHQDALEAKVQAFPEIAKYEGDDISVEPTSPSTPPTITEPSVDEEEFYCPDVSDEWYFSNSDSMDPASNATSSQAMSNPSNAQQFPPPPPLWPTGYMQQNPVDCNMMGNINFPSPGQGPTTMAPIQAGNTSSQSTMIPASQSALYWNHYMNFVRNPLGSVGMSPYTDSYPPSLSSTPLQGSNTIPQMPVNLESDAEHSVQDINSPEKNAPPVQKQKKSKEQNFTAPEDRLLCTTWLQISSDPIVNTGQRREGLWARIEKRALSSRWDKIRADVSKFSGYYARVLREKQSGLSDDDKTSKAATLFAHEEGKPFHYMHCWHQLKGEPKWESICQGHSFRGLHARSLPSSGCPSVQTPETDSGSAGLSGKRPHGRDFSKAERKKAGSSSSPEYLSRLQEITEKQIQRSIEKGEKKEMTSEEDREIQKKRLDLEAQKLSIRQRELKLEELKSAEQRLQMLLSTNEEDVDPEVWVVMKEQKKKLQQFIFTFEQ

SEQ ID NO: 30239 - protein, 236 aa, Brassica napus
  misc_feature (74)..(74): Xaa can be any naturally occurring amino acid
  unsure (1)..(236): unsure at all Xaa locations
MSSQICRSASKAARSLLSSAKNARFFSEGRAIGAAGAVTASGKLPLYASNFARSSSGSSKSWITGLLALPAAAXMVQDQEVFAAEMERTFIAIKPDGVQRGLISEIISRFERKGFKLVGIKVVVPSKDFAQKHYHDLKERPFFNGLCDFLSSGPVIAMVWEGEGVIRYGRKLIGATDPQKSEPGTIRGDLAVVVGRNIIHGSDGPETAKDEINLWFKPQELVSYTNNAEKWIYGDN

SEQ ID NO: 30240 - protein, 323 aa, Mycobacterium tuberculosis CDC1551
MWAEKSPRRSSAGSRPEFSASTLTSMSLRRVSDTLTGAAVTLPVMTTTRTERNFAGIGDVRIVYDVWTPDTAPQAVVVLAHGLGEHARRYDHVAQRLGAAGLVTYALDHRGHGRSGGKRVLVRDISEYTADFDTLVGIATREYPGCKRIVLGHSMGGGIVFAYGVERPDNYDLMVLSAPAVAAQDLVSPVVAVAAKLLGVVVPGLPVQELDFTAISRDPEVVQAYNTDPLVHHGRVPAGIGRALLQVGETMPRRAPALTAPLLVLHGTDDRLIPIEGSRRLVECVGSADVQLKEYPGLYHEVFNEPERNQVLDDVVAWLTERL

SEQ ID NO: 30241 - protein, 546 aa, Schizosaccharomyces pombe 972h-
MGKNLTIVMLVFVSMAGWMFGADTGSIGGITNMRDFQSRFADRYNPVTDSYSYSSARQGLITGMVNVGSFFGCFLSSPLMDRIGKRTSIMFWTIVYLIGIILQVTAVPSWVQIMVAKIWTGLSIGALSVLAPGFQSEVAPADLRGTIVTTYQLAVTGGIFIAACINMGTHKLHKTAQWRVSMGINLLWGIITFIGISFLPESPRYLISVGRDEEALQIMAKNNDLPIEHEVIQTEYHVIKSDCEAELAGGPATWPEIFGPDIRYRTFLGLGVMSLQQLTGDNYYFYYGFEVFEGTGMNSPYLSALILDAVNFGCTFGGLFVLEFFGRRMPLIIGALWQSITFFIYAAVGNRALTRKNGTSNHRAGAVMIVFSCLFIFSFAQTWGPAAYVIVGESYPIRYRSKCAAVATTGNWLWGFLISFFTPFITNSIGFKYGYIFAACNLCAACIIFLFAHETKGLTLEEINELYISGAKPWMPRPKNLGNFTKQQEEVREKSRGVQGESAAHLENVDGEEGIEDSSNDISSTTSSDGRAKPESSYHDQEEQFA

SEQ ID NO: 30242 - protein, 236 aa, Arabidopsis thaliana
MSVKARRISGRLETVVTKVNYAFDPVDDDKIIRNRLLTRTTTTRGEPPLKKLQKKFTSFVLEVDKEEENYNDCGRLAKAFLQELSTFEIPLLKSQAVVEANLREKESFNEVKDETERQIMQAKAEIEDLKKQLEESKIDRQHKEECETIRKLISAQPPRSETEKVIYELNKEIAELEAESTASWRLLELRKKQFALLMHVVDELQNTMEDEQKSLVDEIRSASEDQRNITDAMSVD

SEQ ID NO: 30243 - protein, 477 aa, Rhodococcus sp. RHA1
MTTTIHTTWDRSSILVGGDWIPVTDCTQVHDPATEAVIGRSASAGADHVDAAVAEARSAGTAWGAGAPGDRADILDDLCTHLRARRQLLVDTTVAEVGAPVTVAEEAHIDLGIEILASYARLARDLPFRERLGRTVLLRRPAGVVACITPWNYPFYQLAAKVGAALAAGCTTVVKPAELTPLSTYLFADAALDAGVPPGVLNLVPGSGRTVGAALAAHPGVDVVSFTGSTAVGRGVAHAAAESLKRACLELGGKSASVVLGDAPLPAAVTATVDAAMLNSGQTCSAWTRLLVPRARYEEAVELAADHADTLRVGDPRDRATQLGPVISAAQRRSIAEAVDAAVAGGARLAAGGSGVPAGLETGHYLRPTVLAEVGPHDPIVRDEIFGPVLVVLPHDGDEDAIRLANDSDYGLGGAVWSADPERALGVAARMDTGQVDINGAPFNPEAPFGGWKSSGLGRELGRFGVEEFTELTAVQH

SEQ ID NO: 30244 - protein, 483 aa, Ostreococcus tauri
  misc_feature (1)..(1): Xaa can be any naturally occurring amino acid
  misc_feature (446)..(452): Xaa can be any naturally occurring amino acid
  unsure (1)..(483): unsure at all Xaa locations
XGTRVHVRVSRAVARPGRVARAVTAPGVIELGDESDDAVVWKRIGQDTVDKACELWGQVNSEAAAAAKGAWAGVKPVRKVLFSDILASPKRNAFLRKWIPTDITYVSFIGAMHVGALLPPFYFTLGRVKVLFGRCTSSPLSHKSFRTPKWLEYVLAYCGVLAVQGDPLEWASSHRHHHQHTDTPKDPHTPYEGFWWSHMGWLLDNEATIERVGDRSNAQEMAAQPFYRFMEKTYMWHILASAVALFAIGGMPWLVWGFCVRTVWVYHITWAVNSVSHCWGSQEFNTGDLSRNNWPIGILAFGEGWHNNHHAFEFSARHGLRWWQIDMTWMMICLLKFLRLADKVKLPKEAQMERMHAIGGSCARHSPPERGRISRRPNFSPARATASTAASTAASTAASTAASTAASTTSAPISHARLPGERPREIFDIVIVIVIARDPIPRDEPXXXXXXXSKAEGPAIGIDLGTTYSCVGVWQHDRCAVTR

SEQ ID NO: 30245 - protein, 547 aa, Schizosaccharomyces pombe 972h-
MGKTLTIVMLVFVSMAGWMFGADTGSIGGITNMRDFQSRFADRYNPVTDTYSYSSARQGLITGMVNVGSMTGCILSSPLMDRIGKRVSIMFWTIVYLIGIILQVTAVPSWVQIMVAKIWTGLAIGALSVLAPGFQSEVAPATLRGTIVTTYQLAVTGGIFIAACINMGTHKLHKTAQWRVSMGINLLWGIIMFIGISFLPESPRYLIAIGKDEEALDIMCKNNVLPREHEIIQTEYHVIKTDCEAEMAGGPATWGDILGADIRYRTFLGLGVMSLQQLTGDNYYFYYGFEVFEGTGMNSPYLSALILDAVNFGCTFGGLFVLEFFGRRMPLIIGGVWQSITFFIYAAVGNRALTRKNGTSNHRAGAVMIVFSCLFIFSFAQTWGPAAYVIVGESYPIRYRSKCAAVATTGNWLWGFLITFFTPFISDSIGFKYGYIFAACNLCAACIIFLFAHETKGLTLEEINELYLSGAKPWMPRPENLGQAAKQQQEVLEKSRGVQGESAAHLENVDNEGMEDTSSNDITSSTSSSEGRAKPESNYVDEQDRYA

SEQ ID NO: 30246 - protein, 557 aa, Schizosaccharomyces pombe 972h-
MSKTLTITMLLFVSMAGWMFGADTGSIGGITNMRDFQSRFADRYNPVTDTYSYSSARQGLITGMVNVGSFFGCLISSPTTDRIGKRNSIIGFCVIYLIGVIIQVTAVPSWVQIMVAKIWTGLGIGALSVLAPGYQSEVAPPHIRGTIVVTYQLCVTAGIFIAACINMGTHKLYKTAQWRVSIGINLLWGIITLVGVSFLSESPRYLVSIGKDDEAIQVMCKNAELPPDSDIIQTEYKQIKSDCEAAVEGGPCTWPEIFGKEIRYRTFLGMAIMSFNQLTGCNYYFYYGTQVFKGTGMESPYLASLILDAVNFGCTFGGLFVLEYCGRRVPLIIGGVWQSICFFIYAAVGNRALTRKNGTSNHRAGAVMIVFSCLFIFSFAQTWGPAAYVIVGESYPIRYRSKCAAVATTSNWLWNFLISFFTPFITNSIGFKYGYIFASCNLCASIVTFLFAHESKGLTLEEINELYLSDAKPWMSRPKNLSEMAEAKEVEREETRPKGESARYLEHADSNSDSEDLSSSANNDVHEPVARQDPFNENEVEKSRTRPSQESYTTSSN

SEQ ID NO: 30247 - protein, 172 aa, Saccharomyces cerevisiae
MSTPARRRLMRDFKRMKEDAPPGVSASPLPDNVMVWNAMIIGPADTPYEDGTFRLLLEFDEEYPNKPPHVKFLSEMFHPNVYANGEICLDILQNRWTPTYDVASILTSIQSLFNDPNPASPANVEAATLFKDHKSQYVKRVKETVEKSWEDDMDDMDDDDDDDDDDDDDEAD

SEQ ID NO: 30248 - protein, 282 aa, Xylella fastidiosa Dixon
MPVSRFAVFGHPIAHSLSPRIHTEFGRQMGVALDYLAFDVAPDAFRVSLEHFVAEGGYGANVTLPLKEAAFEVCTTLSARARRAGAVNTLSRVDGVWHGENTDGIGLVRNLTERHGLDLRGRRALLLGAGGAARGVAPALLDAGITEMVIVNRSPERADMLCDALGEPGRVSARYWGDLGDLGNFELIVNATSIGNTSDMRTFSLPRSLLDSMTVAVDLNYGSAAVPFLAWAHAVETRYAIDGLGMLVEQAAESFSLWHGRRPDTDPVYTVLHSEYGVPGRS

SEQ ID NO: 30249 - protein, 510 aa, Saccharomyces cerevisiae
MPTSGTTIELIDDQFPKDDSASSGIVDEVDLTEANILATGLNKKAPRIVNGFGSLMGSKEMVSVEFDKKGNEKKSNLDRLLEKDNQEKEEAKTKIHISEQPWTLNNWHQHLNWLNMVLVCGMPMIGWYFALSGKVPLHLNVFLFSVFYYAVGGVSITAGYHRLWSHRSYSAHWPLRLFYAIFGCASVEGSAKWWGHSHRIHHRYTDTLRDPYDARRGLWYSHMGWMLLKPNPKYKARADITDMTDDWTIRFQHRHYILLMLLTAFVIPTLICGYFFNDYMGGLIYAGFIRVFVIQQATFCINSLAHYIGTQPFDDRRTPRDNWITAIVTFGEGYHNFHHEFPTDYRNAIKWYQYDPTKVIIYLTSLVGLAYDLKKFSQNAIEEALIQQEQKKINKKKAKINWGPVLTDLPMWDKQTFLAKSKENKGLVIISGIVHDVSGYISEHPGGETLIKTALGKDATKAFSGGVYRHSNAAQNVLADMRVAVIKESKNSAIRMASKRGEIYETGKFF

SEQ ID NO: 30250 - protein, 229 aa, Mesorhizobium sp. BNC1
MPKPDLVIFDCDGVLVDSEIVAARVEAEMLREAGYDITADEIAERYSGLTFKDIMIHIEKEAQMLLQASMIKQAEAKVDERLRAEVKAIPGVAEAAASLSVKKCVCSNSSEERIAIMLQRTNLARFFEGVIFSSLATPTKRPKPAPDVFLYAAEQMGAEPAGTIVIEDSVHGIMGARTAGMRVIGFTGASHSHPRHASMLMEAGAETTISRMADLKSTIAALSEWSEEG

SEQ ID NO: 30251 - protein, 337 aa, Solanum tuberosum
MMTRGATRMTRVVMGHMGPRYFSTTVLRNDPGTGVVGGAAAGLLHGFPANPSEKVAVTWVRHFSAMGSRSASTAALNDKQQEKESSDKKVENTATAAANGGAGKSVVSYWGVPPSKATKPDGTEWKWNCFRPWETYEADMSIDLTKHHAPVTFLDKFAYWTVKVLRFPTDVFFQRRYGCRAMMLETVAAVPGMVGGMLLHCKSLRRFEQSGGWIKALLEEAENERMHLMTFMEVAKPNVYERALVFAVQGVFFNAYFAAYLISPKLAHRIVGYLEEEAVHSYTEFLKELDNGNIENVPAPAIAIDYWRLPKDATLRDVVLVVRADEAHHRECQPLCI

SEQ ID NO: 30252 - protein, 693 aa, Aspergillus nidulans FGSC A4
MCGISAVLSLSEGSICPQALASQMNESLQLIKHRGPDARGQWLSSDYRVGLGHARLSVIDLNPAGNQPFHDPEGTVHAVVNGEIYDHKKYRAKLAHQYEFRSNSDCEIVTALYRHYGISFLNKLRGEFALVLWDAKRKLFLAARDRYGIKSLYYTVVNNRLLVATEIKSFLPFGWQPEWSIENLLRKGWLWDTEMYFKGVHRLEPGQYMVSQNYKFPVVKTYWDMDYPDKRTPFPQTEEQIVLELRKRMLESVRLRLRADVGVGFYLSGGLDSSAIAGMAKYLIQQGEPLGNDSSGDISKMSCYTIRFGEGSGVDESGIKDTFVPEVSDRRLTKSELYPVTLTEEDIASRFEDTVWYTETPIPDVNGMGRVAVGELAHSHGKKVILTGEGSDEHFGGYPDMLSKMFVEPDLSWHPPPFKMPNSSKVFEAGREAVPAAVESLASTKRMLNNSSIFARVDSFYMFPLASATVESEEPDPETAFAESLGAQTLSNISENWHPLNSASYQWTKSILANYILRYIGDGADMVYQIETRPPFLDHHVTEYANRIPPSLKIRYDPVKNDLREKYILREAMRPFITDEVMNRTKRAYLGPSNYREDGPLHRVVKSLLTEDNVNKLGFVDWDRLQEHIVKGFRDGDPRYFRSSLFVAQLVVLSQRFGVKVATTTDALPVTSEILDRTQNNDNMTTVQDRSRL

SEQ ID NO: 30253 - protein, 449 aa, uncultured archaeon GZfos13E1
MSKISKLVIIGCAGVGGPAAMTAKRMEPSLDVTLIREEENFLTRCAVPYISVEKATVEASVKDDGMFHAVGTKLVNVKATSIDRKEKTVTTAGGAVYPYDKLILATGGRAIVPPVPGVDLEGVFTICTSWDAVSIRDWINEKGARNAVVYGAGAVGLEMASVFAEKGLKVTMVIRSYIGEKVGLDLDMSSELEKYFEDKGTVIRSKEVITKIEGEQEVEAVELSSGDKIETNMVILSAGVHPNVELAEDAGLEIGEYGLEVNEYLQTSDPDIYAGGNLIEYEHMVTRKPILAQMRPNAVIGGRIIAKNALGYKIKFPRLLNSFASKLFDKSIASVGVTEAIAKEEGFDILVTKQAAKSKHVMMEGGKPYTVKLIFDRDTKKVIGAQIIADDERSVRYIDVIALAIRNGWTALDLTTLRCAGQPELSPEPSAEPIAVAAEGAFKELYPLA

SEQ ID NO: 30254 - protein, 700 aa, Salinibacter ruber DSM 13855
MHGDGHAAIPQIPSITSDGSIEVDELSPADFEPDDLRQRLRTMMLSRRLDEKMMTLLKQGEGHFHIGCAGHEAVQSALSRYSRPGEGPGHDWFCFYYRDLCMALSLGMTTKEALLAHLAKADDPNSGGRQMPEHFGLKHLNVMTTASSVGAQFNPGVGFGFGIQQRGEDSYVYISCGDGATSQGDFHEALNWAAREQAPALFLVQDNKYAISVPIEEQTAGGTPYKLAAGYEGLSRMRVDGTDFFASAAAAQAAIQHIRDGKGPVCLVADVVRLLPHSSSDDHTKYRTPDELEADRKIDPIDRLEAALIGEGILTEADAEALQEEVHEEVDEATEWAKRQDGPSPETAGDHVFFEGDLGLDYNSEDDLDEDAEPMVMVDAINRTLKEEMARDESVIVYGEDVAGDKGGVFTATKDLTDEFGGDRCFNSPLAEGSIIGTAVGYAASGFTPVVEIQFADYIWPAMQQLRNQVAPFRYRSDGEWSCPMVVRVPCGGYIHGGLCHSQNIESIFGHTPGLKVALPSTAADAKGLLATAIRSEDPVLFLEHKALYRAASARTPTPPEDYTLPFGKARIAREGSDMTIVTYGMMTQKSLNVAEELEQEGVDVEVVDLRTIVPLDSETILESVRKTNRALVVYEDHEFIGFGAELSAQIADDAFTYLDAPIRRVAGEFTPIPFAHSLERSVLPSDEGILEAARDLAAF

SEQ ID NO: 30255 - protein, 164 aa, Triticum aestivum
  misc_feature (54)..(54): Xaa can be any naturally occurring amino acid
  unsure (1)..(164): unsure at all Xaa locations
MAAAAPSATALAGAALPLPLSARPQPARFSVALPRTAPPPPALRLRSVRRLAAXGGGRTAGMKDTLDKVVSAHKVVLFMKGTKDFPQCGFSHTVVQILRSLDVPFETLDVLANDALRQGLKDYSSWPTFPQLYIDGEFFGGCDITLEAYKSGELQETLEKAMCS

SEQ ID NO: 30256 - protein, 356 aa, Prochlorococcus marinus str. MIT 9301
MKRNFFIKNCRDFSVNIKDNVGEAIQKINKGGFQICLVFNEQNYLEGIITDSDLRRGILNGVSKSSKLSDVINYQPIKVHEFLSEEKIYRLMIKNHIFHIPLVDENNKFKGIFVSNNLIEESFINETFFILAGGKGLRMRPLTKNLPKPMLHISGKPMIELIINNAKEFGFRNFVLSIGYLGEVIKEYFGNGDKFGINISYIQEEKPLGTAGSLAYLKKDLLTDYVFITNGDVVTSLEYSNMLNFAKYTKADGVIAVKEFGLQNPFGVIETSNDNFIGISEKPIYKSTINAGVYVVSKNLIGLIEKGKHIDMNQLFELGINKKKILKVFALHEEWTDVGRPEDYKRIRNSSKANEI

SEQ ID NO: 30257 - protein, 139 aa, Arabidopsis thaliana
  misc_feature (28)..(28): Xaa can be any naturally occurring amino acid
  unsure (1)..(139): unsure at all Xaa locations
HENGLKSSAAFPATRKANNDITSITSNXGGRVNCMQVWPPIGKVRKVRGTSLERPTRMPSKPARPLAKLRRRATALLDKANDAAAAAGASAQQVGKSISDAAVRGANFPKDKTGLHNVPIPANSRTPNFPSPNSFAGIL

SEQ ID NO: 30258 - protein, 392 aa, Asarum canadense
DLEPVNPSDVPVTAAGALKSYKLAAKAISKLQSLPSGNISLLCDVVVREVSDLTGYDRVMAYKFHEDEHGEVIAECKISDLEPYHGLHFPATDIPQASRFLFMKNKVRMICDCSAPPVKVIQDKRLAQPISLGGSTLRAPHGCHAQYMANMGSIASLVLSVTISEDDDETCDKQKGRKLWGLVVCHHTSPRFIPFPLRYACEFLIQVFGIQLNKEVELAAQMRETHILRTQIMLCDMLLRDAPMTIVTQSPNVMDLVRCDGAALYYRKESWLLGVTPTKAQIQDLAEWLLKYHNGTTGLSTDSLVEAGYPRAHNLGDMVCGMAAVRITSQDFLFWFRSHTGKEVKWGGAKHDPADKDDDRGKMHPRSSFKAFMEVMKRRSLPWEDMEMDAIQ

SEQ ID NO: 30259 - protein, 429 aa, Pseudomonas fluorescens Pf-5
MAKIVDIKGREVLDSRGNPTVEADVLLDNGIIGSACAPSGASTGSREALELRDGDKSRYLGKGVLKAVANINGPIRDLLLGKDPIDQKALDQAMIKLDGTENKATLGANAILAVSLAAAKAAAQDQDLPLYAHIANLNGTPGVYSMPVPMMNIINGGEHADNNVDIQEFMVQPVGAKSFSEGLRMGTEIFHHLKAVLKARGLNTAVGDEGGFAPNLASNEDALKVISEAVANAGYTLGTDVTLALDCAASEFYEDGKYNLSGEGQVFTAEGFAEYLKGLTQRYPIISIEDGLDESDWAGWKILTDKIGEKVQLVGDDLFVTNTKILKEGIDKKIANSILIKFNQIGTLTETLEAIQMAKAAGYTAVISHRSGETEDSTIADLAVGTSAGQIKTGSLCRSDRVSKYNQLLRIEEQLNGKAKYNGRGEFRG

SEQ ID NO: 30260 - protein, 484 aa, Debaryomyces hansenii CBS767
MSDKVEVADVTSLNALAAGTNKKNPRVVAAGLGGRLMGTKSLVDVTADEITKDSELSLAEKDRKDKEKWTKMTHISDQPWTWSNWSEHINWLNLILVVLVPTVGFVCALRHPPQLKTAVMGVILYILSGLSITAGYHRLYSHKAYDAAVPVKIFFALFGAGAVEGSIKWWGHSHRVHHRYTDTARDPYDARQGLWYSHMGWLLIKANPKNRARADISDLTGDWVVNFQHRHYLVIMIFMALVLPTLIAGLGWGDYWGGFVYGGIIRSFFIQQATFAINSLAHWIGSQPFDDRRTPRDNVITALVTFGEGYHNFHHEFPSDYRNALIWYQYDPTKITIWVLSKLGLAWGLKTFSQNAIEQGLIQQQQKKLDRMKSKLEWGTMLNELPLMDKEEFTARAKKDGLILISGIVHDVKQFIKQHPGGQALIRVSLGKDATKAFNGMVYAHSNAAHNMLANMRIAILKDHAVNGNTFDLQQEFLDKEKVN

SEQ ID NO: 30261 - protein, 483 aa, Schizosaccharomyces pombe 972h-
MLSANMLRRMHHGVAVTRMLLVSNGKVQVKKSALYPVMAKLARTYATKNYPAHTVINMPALSPTMTTGNIGAFQKKIGDKIEPGDVLCEIETDKAQIDFEQQDEGYLAKILIETGTKDVPVGKPLAVTVENEGDVAAMADFTIEDSSAKEPSAKSGEEKSAPSSEKQSKETSSPSNVSGEERGDRVFASPLARKLAEEKDLDLSQIRGSGPNGRIIKVDIENFKPVVAPKPSNEAAAKATTPAASAADAAAPGDYEDLPLSNMRKIIASRLAESKNMNPHYYVTVSVNMEKIIRLRAALNAMADGRYKLSVNDLVIKATTAALRQVPEVNAAWMGDFIRQYKNVDISMAVATPSGLITPVIRNTHALGLAEISTLAKDYGQRARNNKLKPEEYQGGTFTISNLGMFPVDQFTAIINPPQACILAVGTTVDTVVPDSTSEKGFKVAPIMKCTLSSDHRVVDGAMAARFTTALKKILENPLEIML

SEQ ID NO: 30262 - protein, 228 aa, Parvularcula bermudensis HTCC2503
MSDDKKQRAAAAALAHVRPGMTLGLGTGSTAAHFVKLLGDQGFEGQAIPTSEETARLAEAVGISLITPDETTRIDLAVDGADEADPSGALIKGGGGALLREKIIAQQAQTFIVIADDGKDVVQLGQFPLPVEVTGFAVGLTIQAIRSTLAALGYEDPSLTLRRGEGGFFQTDGGHLIVDIALGRIDEAEPLDAALTMIPGVVTTGLFVGLTDLMIFGTESGVREAVPT

SEQ ID NO: 30263 - protein, 457 aa, Parvularcula bermudensis HTCC2503
MAYDYDLFVIGAGSGGVRAANRSAKFGAKVAIAEQADVGGTCVIRGCVPKKLMVYASEFNDMIGDAAGYGWEIPDARFDWATLRDRIQTELGRLSSLYIKGLEGNGVTLFQCRAIVKDPHTVHLASENRDVTAEKILVAAGGVPFRDDEADPDRLGIVSDDVFHLDKRPDRLVVAGGGYIAIEFAHIFARLGTEVTLVYRGHRLLRAFDREISERVEQDLIASGIRYIPNTIFARIDRDGDDKTVELTTGEVLRTDEILWAIGRRPRTSGLGLEDCGVEKTANGAVIVDQDYRTACPSIFSLGDVTDRINLTPVAIREAMAFASTQFGGEPKRMDYRHVPKAVFCQPPVGSVGMTEDECLDEGHRIDVFEADFRPMKNVLAGNDKRMLMKLIVDAETDRVLGCHMVGEAAPEMVQIAAIAVKAGLTKAQFDETCALHPTSAEELVTLSSSRPGKAST

SEQ ID NO: 30264 - protein, 283 aa, Photobacterium profundum SS9
MASSFLDNDHMDKYVVFGNPIAQSKSPFIHTLFARQTAQKMEYTAELAPADGFKLAADNFFSAGGRGCNITAPFKEDAYQYATQLSERAKLAGAVNTLKKLDDGGILGDNTDGEGLVQDLLLNQVELAGKRILLVGAGGAARGVILPLLAQNPVELVITNRTLSKAQQLADLFAPFGSVSSAAIDTLNQPDFDVIINSTSAGLSGQLPGLSESLIKHDMVCYDMVYSAQITAFNLWARDLGAGKVIDGLGMLVGQAAESFMLWRGLRPGAKQVLRELRRILQE

SEQ ID NO: 30265 - protein, 678 aa, Debaryomyces hansenii CBS767
MSQDLDQLAISTIRLLSVDSVDKAQSGHPGAPLGLAPAAHAVWQKMKFNPKDTNWINRDRFILSNGHACALLYSLLVLYGYDLTVEDLKQFRQLNSKTPGHPEALDVPGCEVTTGPLGQGISNAVGLAMAQKQFGATYNKPDHKISDSYTYAFLGDGCLMEGVASETCSLAGHLQLNNLIAFWDDNHISIDGNTNVAFTEDVMLRFKAYGWHLIEIAEGDTDLDAIAKAIDEAKKVEDKPTLIRLTTTIGFGSLAQGTHGVHGAPLKADDIKQLKESMGFNPEETFVIPKEVTDYLKKHVEENQKVQEDWKKLFESYKQKYPELGAELQRRLDGKLPENWSDALPTYSPSDSAVATRKLSETVLTKILPVIPEIIGGSADLTGSNLTRAAGSVDFQPPATGLGDYSGRYIRYGVREHGMGAIMNGIAAFGANYKNYGGTFLNFVSYGAGAVRLSALSHHPVIWVATHDSIGLGEDGPTHQPIETLAHLRAIPNLSVWRPADGNETSAAYLQAIESTSTPSIIALTRQNLPQLEGSSIEKAAKGGYTLVKQDKPDVIIVSSGSEVSISADAAKKLESEGFKAGVVSMPDFLTFDKQPLDYRLSVLPDGVPIMSVEVMSSFGWSKYSHEQFGLNRFGASGKGPEIYKFFEFTPEGVADRAAKTIQFYKGKPLLSPLNRAF

SEQ ID NO: 30266 - protein, 296 aa, Saccharomyces cerevisiae
MNRQSGVNAGVQNNPPSRVVYLGSIPYDQTEEQILDLCSNVGPVINLKMMFDPQTGRSKGYAFIEFRDLESSASAVRNLNGYQLGSRFLKCGYSSNSDISGVSQQQQQQYNNINGNNNNNGNNNNNSNGPDFQNSGNANFLSQKFPELPSGIDVNINMTTPAMMISSELAKKPKEVQLKFLQKFQEWTRAHPEDAVSLLELCPQLSFVTAELLLTNGICKVDDLIPLASRPQEEASATNNNSVNEVVDPAVLNKQKELLKQVLQLNDSQISILPDDERMAIWDLKQKALRGEFGAF

SEQ ID NO: 30267 - protein, 478 aa, Capsicum annuum
MSSYSESPKLPVREIPGDYGFPIISAIKDRYDYFYNQGEDAWFHGKAEKYKSTVVKINMAPGPFTSNDYKLVAFLDATSFVYMFDNTLIDKTDTLGGTFKPGKEYYGGYRPVAFVDTKDPNHAALKGYILSSFAKRHNLFIPLFRNSLSDHLFNDLEKQVSEQGKSDFNALLPNMTFGFIFRLLCDQTNPSDTVLGAQGPEHLRKWLFPQLIPSLSARKLPSFIEDLLFHNFLIPFGFVKSDYQKLVDAFSKSAVSMLDEAEKLGIKREEAVHNMLFLVGINMFAGLNAFFPHLIRFVGEAGPNLHTRLANEIRTAIKEEGGAITLSAINKMSLVKSVVYETLRLRPPVPLQYGKAKKDFMVQSHDASYKINKGQFLVGYNPMASRDPKIFANPDEFVPDRFMGDGEKMLKHVLWSNGRETENPAPENKQCAGKDLVQLLGRLILVEFFMRYDTFTVEITPLFRAPNVAIKTLTKATS

SEQ ID NO: 30268 - protein, 887 aa, Mesorhizobium sp. BNC1
MTKWVYSFGDGKAEGRASDRNLLGGKGANLAEMCSLGLPVPPGFTITTEVCTHYYANGRAYPAELEAQVNAALDEVGRIAGRRFGDPDRLLLVSVRSGARASMPGMMDTVLNLGLNDETVGALAAESSDERFAYDSYRRFIQMYGNVVLDVEHEVFEEILADEKARRGYDVDTDFTAADWKEVVDLYKEKVESELGRPFPQDPHEQLWGAISAVFSSWMNPRAITYRRLHDIPESWGTAVNVQAMVFGNMGQTSATGVAFTRNPSTGEKALYGEFLVNAQGEDVVAGIRTPQCLTEAARREAGSDKPSLEKVMPQAFAAFVDIAEKLEQHYRDMQDLEFTIERGKLWMLQTRSGKRTTKAALKIAVDMANEGLISKAEAICRIDPASLDQLLHPTIDPSAKRDAIAVGLPASPGAATGEIVFSPDEAEEMAGRGKKVILVRVETSPDDIHGMHAAQGILTTRGGMTSHAAVVARGMGKPCVSGAGTLRVDTRAGTMVSMGRSFQRGDVITIDGSTGQVLVGAVPMQQPELSGDFSTLMGWADELRRMKVRSNAETPADARTARSFGAEGIGLCRTEHMFFDGDRILAMREMILSDTEEQRRAALAKLLPMQRADFTELFEIMAGLPVTIRLLDPPLHEFLPHGEAEIGEVAAAMGVDREKLRQKAESLHEFNPMLGHRGCRLAISYPEIAEMQARAIFEAAVDAAEKSGSPVVPEIMVPLVGISSELSFVKAIIDDVAKKVQAERGAAIEYLVGTMIELPRAALNAGEIAREAEFFSFGTNDLTQTTFGISRDDAAGFLEVYRKKGLIEHDPFVTLDVDGVGALVRIAAEKGGAARKGIKLGICGEHGGDPASIAFCEEVGLDYVSCSPFRVPIARLAAAQAACRKG

SEQ ID NO: 30269 - protein, 94 aa, Glycine max
MADTGGGDAVRPVVICDNKCGCTLPCTGGSTCRSLKFMISTKCTSAGTATGGGDHVTCSCGEHCGCNPCSCPKIAAAGSGCRCGTDCACASCRT

SEQ ID NO: 30270 - protein, 690 aa, Wolbachia endosymbiont of Drosophila ananassae
MNHSHLESMANAIRFLSIDAVQKANSGHPGMPLGMADVATVLFAKYLNHNPDDSKWFNRDRFVLSNGHGSMLLYSILYLTGYISIDELKNFRQMGSKTPGHPEFGLTSGVEATTGPLGQGFATAVGMALAESILKEQFGDSLINHYTYVMLGDGCLMEGISHEAASLAGHLKLNKLIALFDDNDISIDGATCLSCSDDVEKRFLAYGWNVDKIDGHDFDAISLAIEQAKKSDKPTMICCKTIIGKFSSRAGTSSVHSGAFSEEDIKQMREKLNWNYEPFHVPEDVKNAWKKTVERAKQNYTMSFQRVTRKEEKEWIPVSSTGMTRESTGMTEENAGMTGYHVELQRRLDKHLPDNIAGVLADLKKQICELMPNEATRSSFGKVMELLTKSMPELIGGSADLTGSNCTKYEHMQVIDSNNYSGSYVHYGVREHAMAACMNGMALHGAILPYGGTFLVFSDYCRPAIRLSALMKQQVMYVMTHDSIGVGEDGPTHQPIEHLASLRAIPNLYVFRPADAVETLECVSIALEKKESPALFALSRQNVSYMRKFYSDIDQSANLSKFGAYILCECSKELKVTIFATGSEVEIAVEAREKLQEKGIGTRIVSMPCWRLFDEQSDEYKAAILNNDSIKVAIEAGSEMGWHKYIGSNGIFIGMKSFGESAPYKTLYEHFNISADHVVKCVCEKLVYIQ

SEQ ID NO: 30271 - protein, 392 aa, Buxus sempervirens
DLEPVNPLDPPVTATGALKSYKLAAKAISRLQSLPNGNISLLCDVLVREVSELTGYDRVMVYKFHEDEHGEVVAETHRTNLEPYLGLHFPATDIPQASRFLFMKNKVRMICDCLAPPVRVVQDKRLERPLSLCSSTLRAPHGCHAQYMKNMGSIASLVMSVTINEDDDEMDSDQQKGRKLWGLVVCHHTSPRFVPFPLRYACEFLIQVFSIQLNKEVELAAQVREKHILRNQSMLCGMLLRESPVGIITQSPNVMDLVKCDGAALYYKDKFWLLGVTPTEAQISDIAGWLLEYHNGSTGLSADSLLEAGYPGASVLGDAVCGMAAIKLTSKDFLFWFRSRTGKEIKWGGAKHEPFDKDEGRKMHPRSSFKAFLEVVKWRSLPWEDIEMDAIQ

SEQ ID NO: 30272 - protein, 210 aa, Triticum aestivum
  misc_feature (126)..(127): Xaa can be any naturally occurring amino acid
  unsure (1)..(210): unsure at all Xaa locations
SDNLFHTISPPAAVNHGFWPEKPRGYREANEAYCGHMRRLTREVLERLSAGLGLEEGAMAEAFGGGDDGLVLMQKVNFYPPCPEPELVLGFAPHTDLCAFTVLVADDVPGLQVSKDGRWYDVGHVXXALIVNVGDQIEILSNGRYRAVLHRVTVSKEKTRMSWPVFVHPRLEYVVAPHPRLVAGEIPAKYDYKAKTFEDYMYCKINKLPQ

SEQ ID NO: 30273 - protein, 444 aa, Coprinopsis cinerea okayama7#130
MSITKIHARQIFDSRGNPTVEVDVHTAKGLFRAAVPSGASTGAHEAVELRDGDKNAYVGKGVSKAISNVNDIIAPELIKSGLKVTQQKEIDDFLIKLDGTPNKGKLGANAILGVSIAVAEAGAGEKGVPLYQHLADLAGVKPPFVLPLPCFNVINGGSHAGNKLAFQEFMLLPTEASSFTEALKIGTETYHTLKKVITAKYGIDAVNVGDEGGFAPNVSGADESLELLTEAIKKAGYEGKIKIALDVASSEFYKDGKYDLDFKNPNSDPTKWITGKELADLYLSYVEKYPIVSIEDPFDQDDWEAWTHFTSKSGIQIVGDDLTVTNPLRIKTAIEKKACNGLLLKVNQIGTISESIQAAQLSQSDGWGVMISHRSGETENTIIADLAVALGVGQIKTGAPARSERVAKYNQLLRIEEQLQGSGAIYAQGKGLSAGSTPPALLKK

SEQ ID NO: 30274 - protein, 394 aa, Carludovica palmata
ELEPVNPADVPVSAAGALKSYKLAAKAISRLQSMPSGNTSLLCDVLVKEVSELTGYDRVMAYKFHEDQSGEVISECRRPELEPYLGLHYPATDIPQASRFLFMKNKVRMICDCSAPPVKVIQDKRLAQPLSLCGSTLRAPHGCHAQYMANMGSIASLVMSVTINEDDDETGRDQQQKGRKLWGLVVCHHTSPRFVPFPLRYACEFLMQVFGIQLNKEVELAAQAKAKHILRTQTLLCDMLLRDAPIGIFTRSPNVMDLVKCDGAALFYRNQFWLLGTTPTEAQIRDIVAWLQEYHDGTTGLSTDSLAEAGYPGASELGDAVCGMAAINVTNKDFILWFRSHMAKEIKWGGAKRDSFNRNDEGRQMHPRSSFKAFLEVVKRRSLPWEDMEMDAIQ

SEQ ID NO: 30275 - protein, 429 aa, Rhodococcus sp. RHA1
MPGGAHTYARGPDQYPDYMAPVLVGGKGARVWDVDGNSFVEYGMGLRSVTLGHGYAPVVDAVCAAISRGTNFSRPTELELHAAEDFLQLVPGADMVKFAKNGSDATTAAVRLARAVTGRELVAVCNQPFFSVDDWFIGTTAMNSGVPSDVAAKTRSFRFNDLNSLVSVFDENPHRVACVVMEAATATAEPTPGYLDAVRSLCDERGALLIFDEMITGFRWSQGGAQTEYAVTPDLSCWGKAMGNGFPISALAGKREYMEFGGLNTDHDRVFLLSTTHGPECGALAAFRAVVHAYATEDPISRMEQSGRRIAEGVGATAADMGIADYVQVIGRPSCLIFVTRDLNYQPSQEFRTLFLQELLSGGVLCQSFVTSAAHRSADVDLTLEVIHRALEIYSRAIESGGVAGFLRGRPVAPALRRYAAPRRTDTSD

SEQ ID NO: 30276 - protein, 370 aa, Pseudomonas fluorescens Pf-5
MIKSRAAVAFEAKKPLEIVEVDVAMPKAGEVLLRVVASGVCHTDAYTLSGADPEGIFPAILGHEGGAVVEAVGEGVTSVAVGDHVIPLYTPECGKCKFCLSGKTNLCQAIRATQGKGLMPDGTTRFSYKGQPIFHYMGTSTFSEYTVLPEISVAKIPKEAPLEKVCLLGCGVTTGIGAVINTAKVKAGDTVAIFGLGGIGLSAVIGAVKAKAGRIIAIDINPAKFEIAKQLGATDCVNPKDFDRPIQEVIVDMTDGGVDFSFECIGNVQLMRAALECCHKGWGESVIIGVAGAGQEISTRPFQLVTGRVWRGSAFGGVRGRSELPSYVEMSQTGEIPLDTFITHTMGLEDINKAFDLMHEGKSIRSVIHF

SEQ ID NO: 30277 - protein, 495 aa, Artemisia annua
MKSILKAMALSLTTSIALATILLFVYKFATRSKSTKKSLPEPWRLPIIGHMHHLIGTTPHRGVRDLARKYGSLMHLQLGEVPTIVVSSPKWAKEILTTYDITFANRPETLTGEIVLYHNTDVVLAPYGEYWRQLRKICTLELLSVKKVKSFQSLREEECWNLVQEIKASGSGRPVNLSENIFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAISELIKCPKALEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNGVSYDQIDMTESSGATMQRKTELLLVPSF

SEQ ID NO: 30278 - protein, 460 aa, Euptelea polyandra
SGKPFYAIIHRIDVGLVIDLEPVSPAEVPVAAAGILKSYKLSAKAISRLQSLPSGNISLLCDVLVQEVSDLTGYDRVMVYKFHEDEHGEVVAECLRSNLEPYLGFHYPATDIPQASRFLFMRNKVRMICDCSARPVKVIQDKSLAQPLSLCGSTLRAPHGCHAQYMANMGSIASLVMSVTIDENDDEIQTDQQKGRVLWGLVVCHHTSPRFVPYPLRHACEFLIQVFGIQLNKEVELATQLREKHILQTQTVLCDMLLRDAPVGIVTQSPNVMDLVRCDGAALYYKNQFWLLGLTPTEAQIRDIAGWILEHHDGSTGVSIDSLMEAGYPGSSVLGDVVSGMAAIKITSKDFLFWFRSHTAKEIKWGGAKHDHVDKDDGRKMHPRSSFKAFLEVVKRRCLPWEDVEMDAIHSLQLILRGSLKDETVNDSKTIVNALMVDARIQGVDELCNVTNEMVRLMEK

SEQ ID NO: 30279 - protein, 565 aa, Schizosaccharomyces pombe 972h-
MPAGTKEQIECPLKGVTLLNSPRYNKDTAFTPEERQKFEISSRLPPIVETLQQQVDRCYDQYKAIGDEPLQKNLYLSQLSVTNQTLFYALISQHLIEMIPIIYTPTEGDAIKQFSDIYRYPEGCYLDIDHNDLSYIKQQLSEFGKSDSVEYIIITDSEGILGIGDQGVGGVLISVAKGHLMTLCAGLDPNRFLPIVLDVGTNNETHRKNHQYMGLRKDRVRGEQYDSFLDNVIKAIREVFPEAFIHFEDFGLANAKRILDHYRPDIACFNDDIQGTGAVALAAIIGALHVTKSPLTEQRIMIFGAGTAGVGIANQIVAGMVTDGLSLDKARGNLFMIDRCGLLLERHAKIATDGQKPFLKKDSDFKEVPSGDINLESAIALVKPTILLGCSGQPGKFTEKAIREMSKHVERPIIFPISNPTTLMEAKPDQIDKWSDGKALIATGSPLPPLNRNGKKYVISQCNNALLYPALGVACVLSRCKLLSDGMLKAASDALATVPRSLFAADEALLPDLNNAREISRHIVFAVLKQAVSEGMSTVDLPKDDAKLKEWIIEREWNPEYKPFV

SEQ ID NO: 30280 - protein, 395 aa, Joinvillea ascendens
DLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICECSAPPVKVVQDDRLAQPLSLCGSTLRAPHGCHAQYMANMGSIASLVMSVTINEDDDDDTGSEQQQKGRKLWGLVVCHHTSPRFVPFPLRYACEFLLQVFGIQLNKEVELAAQAKERHILCTQTLLCDMLLRDAPVGIFNQSPNVMDLVKCDGAALYYQNHFWLLGSTPSEAQIKNIAEWLLEYHDGSTGLSTDSLTEAGYPGAAALGEVVCGMAAIKISSKDFIFWFRSHTAKEITWGGAKHEPVDRDDGGRKMHPRSSFKAFLEVVRWRSVPWEDIEMDAIQ

SEQ ID NO: 30281 - protein, 135 aa, Coprinopsis cinerea okayama7#130
MSTTIKTHESLTPVSTSQAPAAIGPYSQAIKAGNLLFCSGCIPLDPTSMEIVPGGVEAQAEQALKNLKAVVEAGGAELGKVVKTTVFLKDMNDFVTVNGVYAKFFGEHKPARSAVEVARLPKDVLVEVEAIVSLA

SEQ ID NO: 30282 - protein, 392 aa, Knema latericia
DLEPVNPSDVPITAAGALKSYKLAAKAISRLQSLPSGNISLLCDVLIREVSELTGYDRVMAYKFHEDDHGEVIAECRRSDLEPYLGLHYPATDIPQASRFLFMKNKVRMICDCFAQPVKVIQDERLEQPLSLCGSTLRAPHGCHAQYMANMGSIASLAMSVTINEDGDDASGQQQQRGKKLWGLVVCHHTSSRFVPFPLRYACEFLIQVFGIQLNKEVELAAQRREKHILQTQTVLCDMLLRDTPVGIVTQSPNVMDLVKCNGAALYYRNQFWLLGTTPTETQIRDIAGWLLEYHDATTGLSTDSLTEAGYPGAPDLGDDVCGMAAIKITSKDFLFWFRSHTAKEIKWGGAKHDPVDKDDDGRKMHPRSSFKAFLEVVKQRSLPWEDVEMDA

SEQ ID NO: 30283 - protein, 606 aa, Debaryomyces hansenii CBS767
MSTRKLQQEFDKTNKKIAEGLTVFDDIYDKLMTTEISSQKEKLESDLKKEIKKLQRLRDQLKTWISDTSIKLDKSLIQDNRTKIEHAMDQFKDLEKSSKIKQFSNEGLELQSQKTKYNKFTDPEDAKKQEACNYIGDIIDQLNQQNESLELEIHLLATQLKKTKSANSYSVQSSIDDCKYNVERNNNHLSKLEMILRNIENENLDPERVDDIKDDLEYYVETNQEDDYVEYDDFYDQLEMSEENDILGSGQDANEDNEENKAEVKEGPKEEPKDGPKEEPKPETKTETKPEAKTESKRETKPEIKSEAKSEPKSSNESTSAASTLARKGKTTVVPAANPPPLNTAQSYSNIIKASMSSPAAAKVLPPGLNQAKSSTSSPQRTPQKLHQADDSKKRVVSQTQHIPSTQPETRSETQLPILNVNKPIFDTVNRLSTLPQSRLHNPLPFQSIVLLLESSLLNCPDSFDAEKPRQYHPTSIHPSSVDYPQEPMYELNSSHIMKKFDNDTLFFCFYYSEGIDNLAKWNAAQELSKRGWIFNTDVKQWFLKDNKNGGKNRSMSIIQKEEDEQNKQDDSANNEENYKYFDYEKTWLTRRKENYKFSQDFRESF

SEQ ID NO: 30284 - protein, 455 aa, Geobacter metallireducens GS-15
MNTSDTKTLREYDRAHVWHPFTQMKEWEESDPVVIVRGEGTWIVDSEGNRYLDGVAAIWTNVHGHCKREINEAIKAQVDTLEHSTLLGLANDKAVLLARRLVEIAPPGLCKVFYSDNGSTAVEISVKMAFQYWQHQGKPEKTKFISFKNAYHGDTIGAVSVGGIDLYHAVFRPLLFPTIQAPAPYCYRCEFGERDRANCGMRCLKELERLMEIHAHEVAGLVIEPLVQGAGGMIVQPDGFVRRVRELCDRYDILMIADEVAVGFGRTGAMFACEREGITPDIMALSKGITAGYLPLAATMTTQKIYDAFIGEYREMKTFFHGHTFTGNPIACAAALASLDLFENERLLDSLTNKIGYLAERLQALNEVRHVGEVRQCGMIAGIELVKDAETREPFPWEERVGIQVCLEARNRGIFLRPLGNIIVVFPPLSISLDELAFLMDGIEASIRAITELRT

SEQ ID NO: 30285 - protein, 447 aa, Triticum aestivum
HASEKVLLGRALGQPGLKRSVRVGETGFREVAAYLLDYDNFANVPPTVLVKISHPVFNVNEGVGSTNKKASVGDPRTVSKIASFQQFAPHDFDASDLGTSSFPVAAIHRIGILDIRIFNTDRHAGNLLVRKVTGADQFGNLTELIPIDHGLCLPECLEDPYFEWIHWPQASIPFSEDELEYIGKLDPVKDAEMLRMELPMIREACLRVLVLSTIFLKEGTLFGLCLAEIGEMMSREFNGMDDQPSQLEVVCMEARRLATEREECSTEHDSADEDVTQFELDCEDHEMPKTPPAYHFEFKGGSSRNPLSKLEEAIEEEEDDIQEEEESNAEKLACPKPVNKWLPNISKLSTSLSSVSLMDKSQRQVPAIPKGADSVKTSENNQVGNWRTANEQLPTSASFVKLADMGVDAWGLFLEKFQELLPGAFRAHKLGATGQRGRLRMGTSCQF

SEQ ID NO: 30286 - protein, 369 aa, Anabaena variabilis ATCC 29413
MEVKAAIAYGAGKPLTIETVQLEGPKAGEVLVEVKASGVCHTDAYTLSGNDPEGLFPAILGHEGAGVVVDVGAGVTSVKPGDHVIPLYTPECRQCAYCLSFKTNLCQAIRGTQGRGVMPDGTSRFSLNGQMIHHYMGTSTFANYTVLPEIAVAKIREDAPFDKVCYIGCGVTTGIGAVIYTAKVEAGANVVVFGLGGIGLNVIQGARMVGANMIVGVDINPSKRALAEKFGMTHFVNPQEVEGDLVAYLVDLTKGGADYSFECIGNVKVMRQALECCHKGWGVSVIIGVAGAGQEISTRPFQLVTGRVWKGSAFGGARGRTDVPKIVDWYMDGKINIDDLITHVMPIEKINDAMDLMHRGESIRSVVTF

SEQ ID NO: 30287 - protein, 402 aa, Synechococcus sp. WH 8102
MAKRSLASLNAGDLSGKRVLVRVDFNVPLNEAGAITDDTRIRAALPTINDLIGKGAKVILSAHFGRPKGQVNDAMRLTPVAARLSELLGKPVAKTDSCIGPDAEAKVNAMADGDVVLLENVRFFAEEEKNDAGFAEKLAGLAEVYVNDAFGAAHRAHASTEGVTKFLKPAVAGFLMEKELQYLQGAVDEPKRPLAAIVGGSKVSSKIGVLEALIDKCDKVLIGGGMIFTFYKARGLSVGKSLVEEDKLELAKELEAKAKAKGVELLLPTDVVLADNFAPDANSQVADVTAIPDGWMGLDIGPDAVKVFQDALGDCQTVIWNGPMGVFEFEKFATGTNAIATTLAELSGKGCCTIIGGGDSVAAVEKAGLADKMSHISTGGGASLELLEGKVLPGVAALNDAA

SEQ ID NO: 30288 - protein, 127 aa, Triticum aestivum
WIPRAAGIRHQGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 30289 - protein, 329 aa, Sorghum bicolor
LLAVPAVRWRAGVRARPNAAGSAGAGRGRLFFRAAAARPVATAVQAEQEDGEEEEEVVVEERYALGGACRVLAGMPAPLGATALHGGVNFAVYSSGASAASLCLFTPDDLKAETVTEEVPLDPLLNLTGNVWHVFIHGDQLHDMLYGYRFDGVFAPERGQYYDVSNIVVDPYAKAVVSRGKYGVPGPGDNCWPQMAGMIPLPHSTFNWQGDLPLKYHQKDLVIYEMHLRGFTKHDSSNAKHPGTYIGAVSKLDHLKELGVNCIELMPCHEFNELEYFSSSSKMNFWGYSTINFFSPMARYSSSGIRDSGRGAINEFKTFVREAHKRGIE

SEQ ID NO: 30290 - protein, 200 aa, Chloroflexus aurantiacus
AGGIAKMAGLDKNARNVMDDLDAVGNTTKAVTKGIAIGSAVIAAVALYGSYFTDVNKVLQQMINEGRQGIELLASINVAAPPVFIGLLIGGAVPFLFSALTIRAVSRAAAQIVNEVRRQFRIPGLMEGKVQPDYARAVQISTTAAQKELISLGLIAVMVPIIVGFTLGVEALGGFLAGIILTGQLMAVFQANAGGAWDNN

SEQ ID NO: 30291 - protein, 189 aa, Agrobacterium tumefaciens
AGGIAEMAELGPEVRKTTDKLDSVGNTTAAIAKGFAIGSAALTALALFTAFAEEIAKNPKLTGLLVDGHLVVNLTEPGVIIGIFLGATLPFLVCAFTMEAVGKAAFEMIEEVRRQFREIPGIMEGTGRPDYAKCVDISTKAAIREMMLPGVFAVGAPLIVGFLLGAKALAGFLAGVTASGVLLAIFSPS

SEQ ID NO: 30292 - protein, 329 aa, Sorghum bicolor
LLAVPAVRWRAGVRARPNAAGSAGAGRGRLFFRAAAARPVATAVQAEQEDGEEEEVVVVEERYALGGACRVLAGMPAPLGATALHGGVNFAVYSSGASAASLCLFTPDDLKAETVTEEVPLDPLLNRTGNVWHVFIHGDQLHDMLYGYRFDGVFAPERGQYYDVSNIVVDPYAKAVVSRGKYGVPGPGDNCWPQMAGMIPLPHSTFNWQGDLPLKYHQKDLIIYEMHLRGFTKHDSSNTKHPGTYIGAVSKLDHLKELGVNCIELMPCHEFNELEYFSSSSKMNFWGYSTINFFSPMARYSSSGIRDSGRGAINEFKTFVREAHKRGIE

SEQ ID NO: 30293 - protein, 141 aa, Anaplasma marginale
  misc_feature (81)..(81): Xaa can be any naturally occurring amino acid
  misc_feature (117)..(117): Xaa can be any naturally occurring amino acid
  unsure (1)..(141): unsure at all Xaa locations
NGSIMGALYKGLIATGLLSIVGLGVANTLTVGWGEIGTVAGKSITGTNLFVCGLIGLIVTGLIVVITEYYTGTNKRPVNSXAQASVTGHGTNVIQGLAVSLESTALPAIVIVGGIIXTYQLAGLFGTAIAVTAMLGIAGMI

SEQ ID NO: 30294 - protein, 214 aa, Ochrobactrum anthropi
TVVATMVLGAIFFNGSDVLSSVMLYPLMICGACVITSIVGTFFVKLSVDGSIMGALYKGLIATGLLSIVGLAVANTLTIGWGEIGTVAGKSITGTNLFICGLIGLIVTGLIVVITEYYTGTNKRPVNSIAQASVTGHGTNVIQGLAVSLESTALPAIVIVGGIISTYQLAGLFGTAIAVTAMLGIAGMIVALDAFGPVTDNAGGIAEMAGLDPE

SEQ ID NO: 30295 - protein, 394 aa, Liriodendron tulipifera
DLEPVNPADVPVTAAGALKSYKLAAKAISRLQSLPSGNISLLCDVLVREVSELTGYDRVMAYKFHEVEHGEVIAECRRSELEPYLGLHYPATDIPQASRFLFMKNKVRMICDCLALPVRVIQDKKLAQPLSLCGSTLRAPHGCHSQYMASMGSIASLVMSVTINEDDDDTSSEQQQKGRKLWGLVVCHHTSPRFVPFPLRYACEFLVQVFGIQLNKEVELAAQMRERHILRMQTVLCDMLLRDAPVGIITQSPNVMDLVKCDGAALYYRNQFWLLGTTPMEAQIRDIAGWLLEYHDSTTGLSTDSLTEAGYPGAADLGDDVCGMAAIKITSKDFLFWFRSHTAKEIKWGGAKHDPVDKDDDGRKMHPRASFKAFLEVVKRRSLPWEDVEMDAIQ

SEQ ID NO: 30296 - protein, 573 aa, Vibrio cholerae O1 biovar eltor str. N16961
MISGILASPGIAIGKALLLQEDEIVLNTNTISDDQVEAEVERFYTARDKSSAQLEVIKQKALETFGEEKEAIFEGHIMLLEDEELEEEILALIKKEKMSADNAIHTVIEEQATALESLDDEYLKERATDIRDIGTRFVKNALGMHIVSLSEIDQEVVLVAYDLTPSETAQINLNYVLGFACDIGGRTSHTSIMARSLELPAIVGTNDITKKVKNGDTLILDAMNNKIIVNPTQAQIEEAKAVKAAFLAEKEELAKLKDLPAETLDGHRVEVCGNIGTVKDCDGIIRNGGEGVGLYRTEFLFMDRDALPTEEEQYQAYKEVAEAMNGQAVIIRTMDIGGDKDLPYMDLPKEMNPFLGWRAVRISLDRREILRDQLRGILRASAHGKLRVMFPMIISVEEIRELKNAIEEYKAELRTEGHAFDENIEIGVMVETPAAAAIAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNANYAEIKAMAEEALALPTAAEIEACVDKFIAAKA

SEQ ID NO: 30297 - protein, 396 aa, Meliosma squamulata
ELEPVNPDDVPVTAAGALKSYKLAAKAISRLQSLPSGNITLLCEVLVREVRDLTGYDRVMVYKFHEDEHGEVIAECRRSDLEPYLGLHYPATDIPQASRFLFMKNKIRMICDCSSQPVKIIQDKRLAQPLSLGGSTLRAPHGCHAQYMANMGSIASLVMSVTINDDDDDDDDTSESDKKKGRKLWGFVVCHHTSPRFVPFPLRYACEFLSQVFGIQLNKEVELAAQLKEKHILKTQTMLCDMLLRDAPMGIITQSPNVMDLVKCNGATLYYNNKFWLLGITPTEEQIRDIIGWLFENHDQSTGLSTDSLVEAGYPGALFLGNAVCGMAAIKITSKDFLFWFRSHTAKEIKWGGAKHDPIDKDDGRKMHPRSSFRAFLEVVKWRSIPWEDIEMDAIQ

SEQ ID NO: 30298 - protein, 389 aa, Platanus occidentalis
DLEPVNPDDVPVTAAGALKSYKLAAKAISKLQSLPSRNISLLCDVMVREVSDLTGYDRIMVYKSHEDEHGEVVAECRRPDLEPYLGLHYPATDIPQLSRFIFLKNKVRMICDCSAPPVKVVQDKKLAQPLSLGGSTLRAPHGCHAQYMANMGSIASLVMSVTINEDDDEGDQQNGRKLWGLVVCHHTSPRFVPFPLRYACEFLIQVFGIQLNKEVELAAQSREKHILRIQTMLCDMLLRDAPVGIVTQSPNVMDLVKCDGAALYYRNKFWLLGITPTEAQIKDIAGWFLEYHDQSTGLSTDSLMEAGYPGALVLGDAVCGMAAIKITSKDFLFWFRSHTAKEIKWGGAKHDPVDKDDGRKMNPRSSFKAFLEVVKRRSLPWEDVEMDAI

SEQ ID NO: 30299 - protein, 225 aa, Mycoplana dimorpha
AIGSAGLGALVLFAAYSNDLSYFAANGDKYPYFANIGEISFDLSNPYVVAGLIFGGLIPYLFGGIAMTAVGRAAGSIVEEVRRQFKEKPGIMQGKDKPNYGRAVDLLTKAAIREMIVPSLLPVLAPLVVYFGVLLISGSKASAFAALGASLLGVIVNGLFVAISMTSGGGAWDNAKKSFEDGFVDKDGQRHMKGSEAHKASVTGDTVGDPYKDTAGPAVNPAIKI

SEQ ID NO: 30300 - protein, 208 aa, Mycoplana dimorpha
MVLAAIFFGGTPILATAMAYPLAICAACVITSIIGTFFVKLGTNNSIMGALYKGLIVTGALSILGLGAATSFTIGWGSIGTVGGIEVRGGNLFVCGLIGLVVTALIVVITEYYTGTNKRPVNSIAQASVTGHGTNVIQGLAVSLESTALPAIVIVGGIIATYQLAGLFGTAIAVTAMLGLAGMIVALDAFGPVTDNAGGIAEMSHLSP

SEQ ID NO: 30301 - protein, 700 aa, Schizosaccharomyces pombe 972h-
MERYVTIASCQLNQWAMDFEGNRLRIIDSIKEAKRQNASLRVGPELEVTGYGCEDHFLESDTYYHSWEMLCSIIHDPDCQDILLDIGMPVMHKAMRHNCRILALNGKILLIRPKIWLCDDGNFRESRWFTPWLRPRVVETHYLPTFVAKSLNQTTVPIGDAILQCNETVVGVETCEELFTPNSPHIDMALDGVEIFINASGSHHELRKLTTRVNLIQNATEKCGGIYLYSNQRGCDGGRLYYDGSSMIFANGKMLAQGHQFSLKDVEVISATVDVDTVRSYRFQPSHGIQGVTRPSYERIHVNFSLSSYQQDYDIYRKPTDPIEVTIPLPEEEITFGPACWLWDYLRRSHAAGFFLPLSGGLDSCSTAVLVYSMCRIVCKAMEEDDAQVLSDVRRIVGDPSYSSTDPKKLLNHLFYTAFMGSEHSSKETRSRAKELSSLIGSYHTDVNIDTMTSAVVKLFALVTGKTPQFRSNGGTNAENLALQNIQARSRMLLGYLFAQLLPWVRGYSGSLLVLGSSNVDECLRGYLTKYDCSSADINPIGGISKTDLKSFLRYAKEALDLPILQEFLDATPTAELEPTTESYVQSDEADMGMTYAELSVFGRLRKISKCGPYSMFTQLMHQWGDRLSPSQVAEKVKRFFHYYGINRHKMTTLTPSYHAETYGVDDNRYDLRQFLYPSWTWQNKKIDALASKFEQHQRK

SEQ ID NO: 30302 - protein, 393 aa, Sabia swinhoei
DLEPVNPDDVPVTAAGALKSYKLAAKAISRLQSLPSGNISLLCDVLVREVSDLTGYDRVMVYKFHEDEHGEVIAECRRSDLEPYLGLHYPATDIPQASRFLFMKNKVRMICDCSARPVKVVQDKRLARPLSLCGSTLRAPHGCHAQYMANMGSIASLVMSVTINEDDDDEMESDQKKGRKLWGFVVCHHTSPRFVPFPLRYACEFLIQVFGIQVNKESELAAQLREKHILQTQTMLCDMLLRDAPVGIVSQSPNVMDLVKCSGAALYYKNKFWLLGVTPTEEQIRDIIGWFVENHGQSTGLSTDSLMEAGYPGASVLGDAVCGMAAIKITSKDFLFWFRSHTAKEIKWGGAKHDPVDKDDGRKMHPRSSFKAFLEVVKRRSLPWEDIEMDAIQ

SEQ ID NO: 30303 - protein, 394 aa, Tofieldia calyculata
DLEPVNPADVPVTAAGALKSYKLAAKAISKLQSLPSGDISLLCDVLVREVSDLTGYDRVMVYKFHEDEHGEVLAEFKRSDLEPYLGLHYPATDIPQASRFLFMKNKVRMICDCAAIPVKVIQDERLAQCLSLCGSTLRAPHGCHAQYMANMGSIASLVMSVTISEDDNETDSDQQEKGRKLWGLVVCHHTNPRFVPFPLRYACEFLIQVFGIQLNKEVELAAQTREKHILQTQAVLCDMLLRDFPIGIFTQSPNVMDLVKCDGAALYYRNQFWLLGITPTEKQIRDIAGWLLEYHGCSTGLSTDSLLEAGYPGASVLGDAVCGMTASRINSKEFVFWFRSHTAKEIKWGGAKHDPVDKGDDGRKMHPRSSFEAFLEVVKRRSLPWEDVEMDAIQ

SEQ ID NO: 30304 - protein, 273 aa, Mycobacterium tuberculosis CDC1551
MRALIVVAGLRMSRTPPDIEVLTLESGVGVRLYRPAGSNEPAPALLWIHAGGYVMGTAQQDDRLCLRFSSRLGITVASVDYRLAPENPYPAALGDCYSALTWLASLPAVDPARVAIGGASAGGGLAAALALLARDRGGITPAFQLLVYPMLDDRPSIAPANPHYRLWNGRANRFGWRAYLGDADARVAVPGRRDDLGGLAPAWIGVGTHDLLHDEDLAYAERLTAAGVPCQVEVVEGAFHGFDRVAPNVGVSQRFFTSQCNSLRAALALSNRT

SEQ ID NO: 30305 - protein, 315 aa, Ostreococcus tauri
MTTPMTTRTIASTSSASTWSRTTRASGHGVGSSRGVSSHRHRWRTEAVHEDASAEILANRALEMIEDDDVIGLSRGEHCAELARRLGERRREGLAPRNVRVVPLEAIAAKECAVHGLEVRSIDEAPAIMKTFAQPSECALAEVNGKTSIAAIFGRETTPVQPDIARVKAALKKSLKVVLLKEFVMDRIGGSIPLVVDAENWEEHAEELDDLFLGDAEVWRRGANFDANPRGGSNPYVSADGSHTLLDLRFEDPINGGRWECGLILDGEPCGPYELQYALENDVSGVSAHGIYTQADAVITINPESMEAVIISRDE

SEQ ID NO: 30306 - protein, 116 aa, Triticum aestivum
HKSLVRLDAVEPSLMNVVHHFKLKPAFKSIWTALARVNHYKYQAWPEFKVKFKRRVSAYVADWKDPINLDSKDRAPGLGVDDTEPKGWAQRYCEVKDNILQLLTARWFGVGFGNPH

SEQ ID NO: 30307 - protein, 408 aa, Mycobacterium avium 104
MSQAGDDSVRTPPALPDGVSQATIGVRGGLLRSGFDETAEALYLTSGYVYESAAVAEQSFTGELDHFVYSRYGNPTVTMFEERLRLLEGAPAAFATASGMAAVFTSLGALLAAGDRLVAARSLFGSCFVVCNEILPRWGVQTVFVDGDDLAQWEEALSVPTAAVFFETPSNPMQSLVDIAAVTELAHAAGAKVVLDNVFATPLLQQGIPLGVDVVVYSGTKHIDGQGRVLGGAILGDRDYIDGPVQKLMRHTGPAMSAFNAWVLLKGLETMAIRVEHSNSSAHRIAEFLETHPAVRWVRYPYLPSHPQYDLAKRQMSGGGTVITFALDCPDDKAKQRAFEVLDKLTLIDISNNLGDAKSLVTHPATTTHRAMGPEGRAAIGLGDGVVRISVGLEGTDDLIADIDRALG

SEQ ID NO: 30308 - protein, 169 aa, Rhizobium leguminosarum bv. trifolii
GSAGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKAFAFAALGAYLLAVIMNRVLVAICMTLVGSS

SEQ ID NO: 30309 - protein, 215 aa, Rhizobium leguminosarum bv. trifolii
AAIFFAGTPILESAMVYPLAICGACILTSIAGTFFVKLGTNNSIMGALYKGLIATGVFSVAGLAVATYATVGWGTIGTVAGMEITGTNLFFCGLVGLVVTALIVVITEYYTGTNKRPVNSIAQASVTGHGTNVIQGLAVSLESTALPAIVIVGGIIGTYQLGGLFGTGIAVTAMLGLAGMIVALDAFGPVTDNAGGIAEMAGLDPDVRKRPTRWM

SEQ ID NO: 30310 - protein, 275 aa, Myxococcus xanthus
MLGGTAVVMTVDAYGPISDNAGGISEMSGLGPEVRAITDELDAVGNTTAAIGKGFAIGSATLTVIALFSAFNLEVNHTRIAAGLPEMSLQLTNPNVIVGLLLGSILPFLVGASTMLAVGRAAGAIVEEIGRQFREIPGLMELKADPDPKKIVDIATKSALQEMVFPGIIAVAAPPLVGYLLGPGALAGLLAGSLVVGATMALYMANAGGAWDNAKKFIEKGKLPGHAKGSAVHKAAVVGDMVGDPFKDTSGPGVAILIKVMSVVSLLVASLIALR

SEQ ID NO: 30311 - protein, 119 aa, Zea mays
  misc_feature (86)..(86): Xaa can be any naturally occurring amino acid
  misc_feature (90)..(90): Xaa can be any naturally occurring amino acid
  unsure (1)..(119): unsure at all Xaa locations
LNSTNPSATLLFNPKAFGDTINLFVERYIDQGITLVAGVETLDFIFGPTITLTIGAKFVPLTKPKKFPPYMISQEYSFEYRTDKIXMHVXIVHANHLALLFHNLISTGVTLFSYVKLIE

SEQ ID NO: 30312 - protein, 317 aa, Burkholderia vietnamiensis G4
MTTALDQLKQYTTVVADTGDFQQLAQYKPQDATTNPSLILKAVQKDAYKPILEKTVRDHRNESTDFIIDRLLIAFGTEILKLIPGRVSTEVDARLSFDTQRSIDKGRELIKLYEAAGIGRERILIKLASTWEGIRAAQVLQQEGIKCNMTLLFSLVQAAACAEAGAQLISPFVGRIYDWYKKQAGADWDEAKDGGANDPGVQSVRRIYTYYKTFGYHTEVMGASFRTTSQIIELAGCDLLTISPDLLQKLQDSNDPVERKLSPDALHDKPTERVAIDEASFRFQLNDDAMATEKLAEGIRVFAADAVKLEKLIAALR

SEQ ID NO: 30313 - protein, 489 aa, Salinibacter ruber DSM 13855
MPSTLFAYTCDQLFLAPMATDYDCVIVGSGPGGYETAIRATQLGMETAIVEKDKLGGVCLNVGCIPTKALLKSAEVMAETSHLDDFGLELDGSVSPDFPSVIERSRGAANQMNQGVRFLMQKNDIDVLRGHGRLTAPDTVEIEPSVNMDGEEVGEARTVTGEHIILATGARPNELPFLPIDGEKVMSSKEAMLQTEQPDSLVIVGAGAIGVEFGYFYHHMGTDVTIIEVQDRMVPAEDKDVSKELEKAYTKMGIEVMTGANVKGVDKDAEPLRVEVETGGSTEHIECDQVLSAVGVVGNVEDIGLETVGVETEGGDIVVDDYYRTNVDGVYAIGDVTGAPWLAHKASHEGILCIEKIAGHDVRPMDPNDIPACTYCQPQIASVGHTEEEAREAGYDVKVGTFPFKANGKAAALGHQEGFVKTIYDEKYGELLGCHIIGEDATELISEVVAARTLETTGLEIMESMHPHPTLSETVMEATREAYGQPINI

SEQ ID NO: 30314 - protein, 450 aa, Oryza sativa
MDELGIIEQGVDWRTRLGQDIRDCMINDILFSLQTKLQSTTTALIDLQKVAVRIEERIHTIASDYGDYLRRICLTRGDLDSYDVFLNDCQRQQASIRSSILLHQENKQGVLSNQVALNVHKEHSHPYEKDMISKLPNDLVQHIMSFLSMREAVRTSVLSHWWVNQWTFLKSIQLNIYWFHMDREKFSSFLDKLLLSRVQADAPMDTFELKSFAIDRANYWINHAIKHNAKVLKFAEYGKWEPFYLDPNLVELSSRYLETLELTNVALDATIFNQLANACPALQNMLLTDCLLEVEEISSSSLKNLDIIDCYILKDLSICTPSLVSLCIKNERTDNSSFRNSYLIFATAIIIDASNVSSMELLAMDRQFTFVEKDGGEPMFKNLRNLSLGLWCINNMFSPLRRFVRHSPMLRMVTLRISPLDWKSHLTKEHQEMLISIRDRRGLILYIDWY

SEQ ID NO: 30315 - protein, 312 aa, Photobacterium profundum SS9
MANTADYIWFNGEMVPWAEANVHVLTHAMHYGTSVFEGIRCYNTPNGPIVFRHKEHMDRLKNSAKIYRFPIPYSSEELMEICRETIRVNELESAYIRPLGYVGNVGLGVCPPVDTEMDLIVAAFPWGSYLGEEALESGVDAMISSWNRAAPNTIPTAAKAGGNYLSSLLVGSEARRHGYAEGIALSVDGYLSEGAGENIFVVRNGILSTPPATCAILPGITRDSIMVLAKEMGYEIREENIAREALYLADEVFMTGTAAEIVPVRSVDQISVGEGKRGPITKEIQAAYFGLFNGTTEDKWGWLDYVYPKSDK

SEQ ID NO: 30316 - protein, 172 aa, Prochlorococcus marinus str. MIT 9301
MLEKNLKNTIKSYPDFPKKGILFRDILPVFQNPSIFNKLIESMIDKKIYRKSEAILAIDARGFLFGSVIAYKLSKPLILARKPGKLPGKLSTYKYDLEYGSNSLSLQDDSIRNLDNFVIVDDLLATGGTVNSVSKILKDKDKNVLGLSVVVELKDLNGRSKLNFPVESEIIY

SEQ ID NO: 30317 - protein, 339 aa, Schizosaccharomyces pombe 972h-
MSYSFQGLLNRVNESAIVNTLKEYTGLNTPKWTFNDIPDLTGKVALVTGSSGGIGYVTALELARKGAKVYLAGRNEEKYQKVMKQIHDEVRHSKIRFLRLDLLDFESVYQAAESFIAKEEKLHILVNNAGIMNPPFELTKDGYELQIQTNYLSHYLFTELLLPTLRRTAEECRPGDVRIVHVASIAYLQAPYSGIYFPDLNLPHVLLGTFARYGQSKYAQILYSIALAKRLEKYGIYSVSLHPGVIRTELTRYSPTFALKLLEKSVFQYLLLDPIRGAMTSLYAATSPEISKEHLNGAYFTAIAQRGILHRAHDDAFVEELYRYTHKIFEDLKYLAPSP

SEQ ID NO: 30318 - protein, 272 aa, Parvularcula bermudensis HTCC2503
MIPDKVSLDLALFLPIYGWLLLIIWARYVFMAGIVHKSLWRPDATVRTGSALTGRAPGAAAMWREAKTSIGVSLIYALPAAVLFFLFEQGGTALTREIGGLGDLFWQPVALILYLVLHDTYFYWTHRAMHHPRLYKATHHTHHMSKQPTAWASFCFSPAEALIGAVIVPALAFVIPIHVATFLLLLSLMTFSAVMNHAGVEVWPRRFLDGPIGRHLITARHHNLHHTKFQRNFGLYFRWWDRLMGTDSLEGDPVSEAGRDKMAVRVPANAPL

SEQ ID NO: 30319 - protein, 431 aa, Shewanella sp. ANA-3
MAKIINVIGREIMDSRGNPTVEAEVHLEGGFIGMAAAPSGASTGSREALELRDGDKSRYLGKGVLTAVANVNGPIRAALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLSGEGKVFDSNGFSDFLKSLTEQYPIVSIEDGLDESDWDGWAYQTKIMGDKIQLVGDDLFVTNTKILTRGIENGIANSILIKFNQIGSLTETLAAIRMAKAAGYTAVISHRSGETEDSTIADLAVGTAAGQIKTGSLCRSDRVAKYNQLLRIEEQLGEKAPYRGLKEIKGQA

SEQ ID NO: 30320 - protein, 430 aa, Synechococcus sp. WH 8102
MIDSLDLVIDTIVAREVLDSRGNPTVEAEVLLEGGAMGRAIVPSGASTGAHEAHELRDGGDRYMGKGVSQAVTHIEERIAPTLCGLSALDQAAVDAAMLELDGSDNKSSLGANAILAVSMATARAAANGLGLPLYRYLGGPMANLLPVPLMNVINGGAHAANSLDFQEFMLVPHGAPSFREALRMGTEVFHTLKGLLKAKGMSTSVGDEGGFAPDLGNVEAGEILVEAITKAGYKPGEQISLALDVASTEFFENGRYAFDGGNYDSAEMVGQLEQLVEKFPIVSIEDGLAEDDWEGWKLLTERLGGKVQLVGDDLFVTNTKRLQQGIDNSTANSILIKVNQIGSLTETLQAIDLAGRSGYTSVISHRSGETEDTTIADLSVATRAGQIKTGSLSRSERVAKYNQLLRIEDELGSQAVYAGAVGQGPRGNA

SEQ ID NO: 30321 - protein, 339 aa, Medicago truncatula
MDPVSDPPFEEAYKILLNKTKNNRNNVPNDNKFPVVEECELPVIDLSRLEDDNEMVREACKYEIARASQEWGFFQVINHGIPNDIFSRLKCEQEKVFKLPFDKKTKEDKFLQFSSGSYRWGTPSATCVGQLSWSEAFHIPLKDVLESNAQPNTLRSTIEQFAIISSNLAQTLAHILAEKMGHESTYFKENCLPNTCYLRLNRYPPCPIASEIHGLMPHTDSDFLTILYQDQVGGLQLVKDKKWIAVKPNPSALIINIGDLFQAWSNGLYKSVEHRVVTNPKVERFSMAYFLCPSNESVIESCKKPSLYKEFSFQEYRQQVRDDVQKLGTKIGLPRFLLF

SEQ ID NO: 30322 - protein, 322 aa, Marinobacter sp. ELB17
MTAQRIYDTVADDFSRVNELIIQRLSSDVPMVEKIAQYIIESGGKRLRPLLVLLASRATGYNEDNHLKLAAVIEFLHTATLLHDDVVDTSDMRRGRSTANAKWGNAPSVLVGDFLYARAFEMMVELESLPIMKVLSHATAVIAEGEVMQLMNVKNPDLTENQYMQVIHNKTAMLFEASSHSGALLAGANHAQEEALKNYGKHLGLAFQLVDDVLDYRGDAETMGKNVGDDLAEGKTTLPLIYAIANSNDDEKKLIRRAIRKGGLDDLQPVLAIINTTGALNYAMDKAKNQAQQAKDCLQSLPASEHLDALHLLTDIAVARIS

SEQ ID NO: 30323 - protein, 376 aa, Escherichia coli K12
MAKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETPVGLNERQKQLLQELQESFGGPTGEHNSPRSKSFFDGVKKFFDDLTR

SEQ ID NO: 30324 - protein, 164 aa, Pyrococcus furiosus DSM 3638
MKVGVLSDTHIPKAYFPPQIFEFLKKRNVQYIIHAGDITSKEFLEKLEEVAPVIAVKGNMDRIDLPEEEKIEIGNFSILILHGHQFLSLNLDNLTYKALEEEVDILVFGHTHRPYYNVVRSYGREIILLNPGSPTLPRMSEPTFAILEVSNEDIDVHFYNVFSL

SEQ ID NO: 30325 - protein, 503 aa, Arabidopsis thaliana
MSNIQEMEMILSISLCLTTLITLLLLRRFLKRTATKVNLPPSPWRLPVIGNLHQLSLHPHRSLRSLSLRYGPLMLLHFGRVPILVVSSGEAAQEVLKTHDHKFANRPRSKAVHGLMNGGRDVVFAPYGEYWRQMKSVCILNLLTNKMVESFEKVREDEVNAMIEKLEKASSSSSSENLSELFITLPSDVTSRVALGRKHSEDETARDLKKRVRQIMELLGEFPIGEYVPILAWIDGIRGFNNKIKEVSRGFSDLMDKVVQEHLEASNDKADFVDILLSIEKDKNSGFQVQRNDIKFMILDMFIGGTSTTSTLLEWTMTELIRSPKSMKKLQDEIRSTIRPHGSYIKEKEVENMKYLKAVIKEVLRLHPSLPMILPRLLSEDVKVKGYNIAAGTEVIINAWAIQRDTAIWGPDAEEFKPERHLDSGLDYHGKNLNYIPFGSGRRICPGINLALGLAEVTVANLVGRFDWRVEAGPNGDQPDLTEAIGIDVCRKFPLIAFPSSVV

SEQ ID NO: 30326 - protein, 526 aa, Malus x domestica
MADRRAEENAVTGGPQNTSIEDFDPPMKPKTSKFAIACALLACTTSVLLGYDIGVMSGASLYIQKNLKISDVQVEVLAGTLNIYSLLGSAFAGRTSDWIGRKYTIVLAGVIFLVGALLMGFATNYAFLMVGRFVAGVGVGYGMMIAPVYTAEISPASFRGFLTSFPEVFVNVGILLGYIANYAFSKLPLHLGWRFMLGVGGVPAIFLTVGVLFMPESPRWLVMQGRLGDAKKVLQRTSESKEECQLRLDDIKEAAGIPPHLNDDIVQVTKSSHGEGVWKELILHPTPAVRHILIAAVGIHFFEQASGIDTVVLYSPRIFAKAGITSSNHKLLATVAVGFTKTVFILVATFFLDKFGRRPLLLTSVGGMVFSLMFLGVGLTIVDHHKGSVPWAIGLCMAMVYFNVAFFSIGLGPITWVYSSEIFPLKLRAQGVSIGVACNRVTSGVVSMTFISLYKAITIGGAFFLYAGISAAAWIFFYTMLPETQGRTLEDTEVLFGKYHRWRKANAMLKERKQVDGDDNNNAQVF

SEQ ID NO: 30327 - protein, 491 aa, Malus x domestica
MTSILLGYDIGVMSGAAIYIEKDLKVTDTQIEILLGILNLYSLIGSAMAGRTSDWVGRRYTIVISGAIFFTGAILMGLSTNYTFLMCGRFVAGLGVGYALTIAPVYAAEVSPASSRGFLTSFPEVFVNVGILLGYISNYAFSFCALDVGWRLMLGVGAIPSVILAIGVLAMPESPRWLVMQGRLGDARQVLDKTSDSKEESMLRLADIKEAAGIPEDCNDDIVQVTGHSHGEGVWKELFVHPTPTVLHIVIAALGFHFFQQASGIDALVLYSPRVFEKAGITNSNQLLLCTVGVGLSKTVFTFVATFFLDRVGRRPLVLTSMAGMVASLVCLGTSLTIVDQHEGARMTWAVVLCLCCVLAFVGFFSTGIGPIAWVYSSEIFPLRLRAQGCGMGVAVNRVMSGVLSMTFISLYKAITMGGAFFLYAAIGAVGWIFFFTMLPETQGRTLEDMEVLFGKFHKWRKANKLLEKERQVARGDGGTSDPDNRVNLLA

SEQ ID NO: 30328 - protein, 217 aa, Sorghum bicolor
ETVTEEVPLDPLLNLTGNVWHVFIHGDQLHDMLYGYRFDGVFAPERGQYYDVSNIVVDPYAKAVVSRGKYGVPGPGDNCWPQMAGMIPLPHSTFNWQGDLPLKYHQKDLVIYEMHLRGFTKHDSSNAKHPGTYIGAVSKLDHLKELGVNCIELMPCHEFNELEYFSSSSKMNFWGYSTINFFSPMARYSSSGIRDSGRGAINEFKTFVREAHKRGIE

SEQ ID NO: 30329 - protein, 535 aa, Malus x domestica
MADRTTDDNTVSSQPQKTIADFDPPQKPKRNKYAFACAILASMTSILLGYDIGVMSGAAIYIKDDLKISDVEVEVLLGILNLYSLIGSAAAGRTSDWVGRRYTIVLAGAIFFVGALLMGFATNYSFLMFGRFVAGIGVGYALMIAPVYTAEVSPASSRGFLTSFPEVFINSGILLGYVSNYAFSKLPTHLGWRLMLGVGAIPSIFLAVGVLAMPESPRWLVMQGRLGDATRVLDKTSDSKEESMLRLADIKEAAGIPEHCTDDVVQVPKRSQGQDVWKELLLHPTPAVRHILICAIGIHFFQQASGIDAVVLYSPRIFEKAGITNSDKKLLCTVAVGFVKTVFILVATFFVDKVGRRPLLLASVAGMILSLTGLGLGLTIIDQNHERILWAAVLCLTMVLLYVAFFSIGMGPITWVYSSEIFPLKLRAQGCSLGVAMNRVVSGVLSMTFISLYEAITIGGAFFLYAAIASVAWVFFFTMLPETHGRTLEDMEVLFGKFHKWRKANALLKQKKNASHGDGITNNGQVQLGTRGQVN

SEQ ID NO: 30330 - protein, 308 aa, Shigella flexneri 2a str. 2457T
MLELQEASRLPERLGDDFVRAANIILHCEGKVVVSGIGKSGHIGKKIAATLASTGTPAFFVHPAEALHGDLGMIESRDVMLFISYSGGAKELDLIIPRLEDKSIALLAMTGKPTSPLGLAAKAVLDISVEREACPMHLAPTSSTVNTLMMGDALAMAVMQARGFNEEDFARSHPAGALGARLLNKVHHLMRRDDAIPQVALTASVMDAMLELSRTGLGLVAVCDAQQQVQGVFTDGDLRRWLVGGGALTTPVNEAMTTGGTTLQAQSRAIDAKEVLMKRKITAAPVVDENGKLTGAINLQDFYQAGII

SEQ ID NO: 30331 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKIANLFPSIVTGSVITTIGLTLIPVAIGNMGNNVPEPTGQSLLLAAITVLIILLINIFTKGFIKSISILIGLVVGTAIAATMGLVDFSPVAVAPLVHVPIPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30332 - protein, 879 aa, Schizosaccharomyces pombe 972h-
MTELLADEVFKDRVRIFQEYLEHDTDDANVTLYQEAILRMLNMGQRRLIVNIDELRDYNRELADGVLLKPLEYVEPFDEALRNVVSTLIDPVVHKDLKDKLFYVGFRGSFGDHHVNPRTLRAMHLNKMISLEGIVTRCSFVRPKVIKSVHYCEATKRHHFKQYADATMNGGLSFQSTVYPTQDENGNPLSIEFGFSTFRDHQSISLQEMPERAPPGQLPRSIDILLDDDLVDTVKPGDRVNIVGQYRSMGSKTSGNTSATFRTVLLANNVVLLGNKPGLGNVGGGALDITDADIRNINKLARKKNVFELLSTSLAPSIYGYEYVKQAILLLLLGGTEKNLTNGTHIRGDINILMVGDPSTAKSQLLRFVLNTAPLAIATTGRGSSGVGLTAAVTTDKETGERRLEAGAMVLADRGVVCIDEFDKMSDIDRVAIHEVMEQQTVTIAKAGIHTSLNARCSVIAAANPIYGQYDIRKDPHQNIALPDSMLSRFDLLFIVTDDIDDKKDRALSEHVLRMHRYLPPGVEPGTPVRDSLNSVLNVGATNAAGVSTENVEQEVETPVWETFSSLLHANARTKKKELLNINFVRKYIQYAKSRIHPILNQATAEYITNIYCGLRNDDLQGNQRRTSPLTARTLETLIRLSTAHAKARLSSVVEVKDAKAAEKILRYALFREVVKPKRKKHKKQRLEAGEEFDSEDDNSDDMDIEESEEEMDTNMVIDSGSRRVTRSQNATSQSQESGSEIGSSIAGTAGSYNVGTSNTQLSWPSTHSTLPATSRELASSDRNINTGTSVASEVSASVSEQSTVSLPREKMSVFMARLASLTKSELFSEECASLEDVLESINNIEDDVGFSREEAIVALKEMDAQNKIMFSDNVVYRI

SEQ ID NO: 30333 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLSAITVLIILLINIFTKGFIKSISILIGLVVGTAIAASMGLVDFSPVAAAPVVHVPTPFYFGMPTFEISSIVMMCIIATVSMVESTGVYLALSDITKDPIDSTRLRNGYRAEGLAVLLGGIFNTFPYTGFSQNVGLVKLSGIKTRLPIYYAAGFLVLLGLLPKFGALAQIIPSPVLGGAMLVMFGFVSIQGMQILARVDFANNEHNFLIAAVSIAAGVGLNNSNLFVSMPTAFQMFFSNGIVVASL

SEQ ID NO: 30334 - protein, 877 aa, Ashbya gossypii ATCC 10895
MDLNHAYKASNGESNNSLDSSLDVKPMEKPATDDAVRTEKRKYHGAAVMSHHQISVMSQPLTKGVRELIKKTTAFMSCSKSKPQKLMELGPMTYAHSVLTASEKPLCHMELESSSVNGFADTLQDNGVSDATLVEMWLIRVTRRKRVRYCFRISNGVLTWKDNRMLELDTIKDIRMAEMAKNYREQYDIMDAFASRWITIIYQVSPTKLKALHLIAPTQLECAKFYNAVLTVARQRRELMESISVPSSEAFANIHWKVNVSSKKADESRDTLSFEDVQRLCTKFHIYCSSNYLKRVFKIADVNRNGLLNFSEFCTFVRMLKKRHEVTEIWQKIAAETRAIDFEKFYSFLTDVQCEDMDAQLARDLFNEYSHEGYMDEDLLLKFLTAQPYAREIEEDYSRPLSEYFISSSHNTYLLGNQVGSMASVEGYIQALQQGCRSVEIDIWDSDDGPVVCHGKLTSSLPLRNVVDVINKYAFITSPYPLILSLEIHCRSEGQIIVKQLFDDILGPLIYVADHSVGWPSLRDLKHKIIIKSKKLRVNVDMAADIYHSTSSKGSSYDSEYDVQSQPSSPMPRRGMRGIHISKRKHRVIEQLLQISAIHGITFRNFSLPESKTPTHCFSLSERSFDNLANDDLQRLAIDKHNRRHLMRVYPHAFRYKSSNYDPIKCWRLGVQMVATNWQTYDLGQQLNQAMFRVTARDDWPWPSGYVRKPEYLLHTVPKTSFIRDIYEAVHSSVVALSLELLSAQLLPKPKLSSRDGEAHFAPYVVIEVLGDGLCGPIHVQNGLVTAPNQVTSCRCPENGFNPVWKTSLTATLNNTGFNFIRYIVKNADITLATCCIRLDYMKRGYRHIPLYSLESSRFIFSTLFVKTDYRIVRSLF

SEQ ID NO: 30335 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLSAITVLIILLINIFTKGFIKSISILIGLVVGTAIAATMGLVDFSPVAVAPLVHVPIPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30336 - protein, 585 aa, Xanthomonas campestris pv. campestris str. 8004
MIERNVTTPAWGAWPAGDGQVRFALWAPDAHTVEVIFDSGERAALQRQDDGFFSGVVACALDARYRYRVDGQTPVPDPASRWQPDGVHGSSAVQRVDGYHWTHTQWQGRPWDEAVIYELHVGACGGYAGVQAQLPQLAAMGITAIELMPLSAFPGAHNWGYDGVLPYAPAEAYGTPDELKALIDAAHGHGLMVLLDVVYNHFGPDGNYLGSYASAFFNEDKPTPWGAAIDFRKPPVQRYFLDNALMWLHEYGFDGLRLDAVHAITPNAFLDTLRETIEASLPAGRHVHLVLENEANQASQLDRGYTAQWDDDFHNALHVLLTGEEEGYYAAFADQPTQHLARVLGEGFAYQGQPDPRGHVRGEPSGALPPHKFVIFAQNHDQIGNRACGERLSVLVSPQRLRAALALTALTPMIPLFFMGEPWGATQPFLFFTDFGPPLDDAVREGRRREFAHFAAFADPAKRETIPDPNSHATFAASRAPIEDAAHGDGAQWAAWFQALLGVRRQWLVPGLAQARALRTSVLADGAVTATWELPGGLWHIAFNVGAEAVPLPPLRGRVAHAENVTADAQTLPTDSFIAWYEEHA

SEQ ID NO: 30337 - protein, 310 aa, Oryza sativa (japonica cultivar-group)
MTKHGAVVVPVAAAAADAEHDEWMEKHPSALGKFEALAAAAKGKRIVVFLDYDGTLSPIVEDPDRAVMTDEMRDAVRGVAARFPTAIVSGRCRDKVLSFVGLEELYYAGSHGMDIQGPTNAAASKGGEEEEESVLCQPAREFLPMIGEAYAALVEKVEGVIPGAKVENNKFCLSVHFRRVDERRWGAVADQVRAVLRGYPRLRLTQGRKVLEVRPAIKWDKGEALRFLLSALGFSAAGDVEDDGDDDDAFPIYIGDDRTDEDAFRVLRARGHGAGILVSRFPKDTCASFSLRDPGEVKDFLRKLVTCAAA

SEQ ID NO: 30338 - protein, 504 aa, Synechococcus sp. WH 8102
MSSGLGATPLFMEVLPRFASNPFRLLTTPAPLQQALDQEYAQMDFQPVQEKLERDPGYQADVIAGISSVRSRTPDLRYAPMSEGLMGLAYAQLTPLMEEWAGQPLERSFGYGVRSYGPGSWLHMHRDRVDTHVVSCIVHVADQSNIPWALDFVDHEAEHHQVLFNPGTMLFYESLCPHGRASEFDGNFYRNMYFHWRPKVWNPGLYQDLACKFANVEEARKSNQQLKDIASIPETWREWLRLNQERGCDREGMLERAMAHGFSRQALEQVLDASRVSLSVATPVQSAPTTRSNFLEWFEAPLTRPEHQPRAWRLDTPLAQVYELPGLLHRDECDEVMEAINGSLQPSTVTRGASDYRTSRTCHLRQNHPELAERLDERFAALLGVDSGLSEPIQGQRYDPGEYFKEHTDWFGPGTKEFTEHTACGGQRTWTLMVYLNAVERGGETCFKRLGRCFTPAPGLALAWNNLQADGTPNPFTLHEAMPVEVGSKWVITKWFRQRAGRND

SEQ ID NO: 30339 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLAAITVLIILLINIFTKGFIKSISILIGLVVGTAIAATMGLVDFSPVAVAPLVHVPTPLYFGMPTFEISSIVMMCIIATVSMVESTGVYLALSDITKDPLDSTRLRNGYRAEGLAVLLGGIFNTFPYTRFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30340 - protein, 275 aa, Bacillus clausii KSM-K16
MTRQFGLIGHPLGHSKSPVMHEAAYKDMGLDAVYCAYDISPQELGNAIRTMKAQGIDGFNVTIPHKVAIIDYLDEIDEDAEAMGAVNTVVCQDGRWVGKNTDADGYIESLLPVVSDQSLTGRRVLVIGAGGAARAVIHALGKQRATISVSNRTAEKAQELAQLFSHLTIEAIPLNEAESTLGTYDVLINTTSVGMYPDTSKQPIALDRLKQATIVSDLIYNPYETALLQEAKQRGNRILNGIGMFVNQGALSIEHWTGRKPNRKCMERVVRMHLT

SEQ ID NO: 30341 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLAAITVLIILLINIFTKGFIKSISILIGLVVGTAIAAAMGLVDFSPVAVAPLVHVPTPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30342 - protein, 151 aa, Synechococcus sp. WH 8102
MAERTFIAIKPDGVQRGLVGEILGRFERKGFKLVGLKQITPSRALAEQHYGVHKERPFFAGLVDFITSGPVVAMVWEGDGVIASARKLIGATKPLEAEPGTIRGDLAVNIGRNVIHGSDAPETAEFEIGLWFDAAELNDWTPSDQTWRVEA

SEQ ID NO: 30343 - protein, 310 aa, uncultured archaeon GZfos14B8
MFEPEKFIERQVDEVKETIGDGKAVIAVSGGVDSTVCAVLTHRAVGDRLVAVFIDDGLMREGEAEQVMNFFKARNMNARQVDAANEFFDALKGIVDPEEKRKAFRNTFYSVLARVVREENANCLVQGTIAADVAETVKGIKTQHNILEQIGIDPGSYGLTIVEPLREIYKPEVREVARSFGVPPEFSERPPFPGPGLATRVLGEVTPERVEIERRATKIVEEETSDVESFQSMAVLMNDMATGIRGGKRAYGYITVVRLVKSKDAITAEAVNVPWEVLKRIDKRITSEIPEVVHVLYSLTDKPPATIEFQ

SEQ ID NO: 30344 - protein, 338 aa, Glycine max
VKEGGGKSKRWRLWRSSSGDTGGSWKGFKGGNHSAVASSEVGSDSSPHVVAAAAATGAAFTAAVATVVRAPPKDFRLVKQEWAAIRIQTAFRALLARRALRALKGVVRIQALVRGRQVRKQAAVTLRCMQALVRVQARVRARRVRMSIEGQTVQNLLNERRSKLDLLKQAEEGWCDSRGTLEDVKTKIQMRQEGAFKRERAMAYSLAHKQCRSIPSPNPRTRASFTSLKSHEMNKANCGWSWLERWMAAKPWESRLMEQSQSQAEALDKTPPPKKFVESFVSSNSKQSMVKVKKNNVTTRISARPPLVGQATRLSSSPAWLLPPVESVPVLLPHPFVL

SEQ ID NO: 30345 - protein, 467 aa, Propionibacterium acnes KPA171202
MSSHFDVVVLGAGPGGYVAAIRAAQLGKKTAIIEKEYWGGVCLNVGCIPTKSLLRNAELAHIVTKEAKTFGIGGDITVDFGKAFSRSREVSARMVKGIHFLMKKNKITEFNGWGEFTGPKAISVKDSDGKVTDEITFDNAIIAVGSVVKTLPGTQLSGRVVTYKEQILSDTVPGSIVIAGSGAIGTEFAYVLANYGCDVTIVEFLDRMVPNEDKEVSAELAKAYKKLGIKVLTSTKVDSIDDSGDKVKVTISPSKGGESKVIEADRVLQAVGFAPRVEGYGLEKTGVKLTERGAIEIDDFMRTNVDGIYAIGDCTAKLMLAHTAEAQGVVAAETIAGAQTMPINYDMIPRATYCQPQVGSFGYSEDQAREKGYDVKVSKFPFAANGKAWGLGDGTGFVKIVADARHGELLGASLVGHDVSELLPELTLAQLWDITAEEIGRNIHAHPSLSEALKDAAEGVEGHMINF

SEQ ID NO: 30346 - protein, 527 aa, Arabidopsis thaliana
MVEGAILVVDAGEGPLAQTKFVLAKALKYGLRPILLLNKVDRPSVTEERCDEVESLVFDLFANCGATEEQLDFPVLYASAKEGWASSTYTKDPPVDAKNMADLLDAVVRHVQPPKANLDEPFLMLVSMMEKDFYLGRILTGRVTSGVVRVGDRVNGLRKTDSGSEKIEEAKVVKLMKKKGTTIVSIDAAGAGDIICMAGLTAPSIGHTVASAEVTTALPTVELDPPTISMTFGVNDSPLAGQDGTHLTGGRIGDRLMAEAETNLAINVIPGLSESYEVQGRGELQLGILIENMRREGFELSVSPPKVMYKTEKGQKLEPIEEVTIEINDEHVGLVMEALSHRRAEVIDMGPVPGNEGRTRLSLTCPSRGLVGYRCVFSSDTRGTGFMHRAFLTYEKYRGPLGNVRKGVLVSMARGTITAHSLMSLEARGILFVSPGLDSYDGMIIGEHSRETDLDLNPVKAKELTNIRSAGKDENVKLSPPRLMTLEEAIGYVASDELIEVTPKTIRLRKRCLDVNKRKSQSKRAKD

SEQ ID NO: 30347 - protein, 569 aa, Shigella flexneri 2a str. 2457T
MSEEKLGQHYLAALNEAFLGVVLDHAWQTKDQLTVTVKVNYLPEVVEFLYYKQGGWLSVLFGNDERKLNGHYAVYYVLSMEKGTKCWVTVRVEVDANKPEYPSVTPRVPAAVWGEREVRDMYGLIPVGLPDERRLVLPDDWPDELYPLRKDSMDYRQRPAPTTDAETYEFINELGDKKNNVVPIGPLHVTSDEPGHFRLFVDGENIIDADYRLFYVHRGMEKLAETRMGYNEVTFLSDRVCGICGFAHSTAYTTSVENAMGIQVPERAQMIRAILLEVERLHPHLLNLGLACHFTGFDSGFMQFFRVRETSMKMAEILTGARKTYGLNLIGGIRRDLLKDDMIQTRQLAQQMRREVQELVDVLLSTPNMEQRTVGIGRLDPEIARDFSNVGPMVRASGLARDTRADHPFVGYGLLPMEVHSEQGCDVISRLKVRINEVYTALNMIDYGLDNLPGGPLMVEGFTYIPHRFALGFAEAPRGDDIHWSMTGDNQKLYRWRCRAATYANWPTLRYMLRGNTVSYVPLIIGSLDPCYSCTDRMTVVDVRKKKSKVVPYKELERYSIERKNSPLK

SEQ ID NO: 30348 - protein, 287 aa, Triticum aestivum
  misc_feature (263)..(263): Xaa can be any naturally occurring amino acid
  unsure (1)..(287): unsure at all Xaa locations
MERKPNKHARTRSGALVSFLRSTAASFSSSTATTFGSRPAGGGKASFNHRNAFSGPMVSIVPPEARGGGRRRGGNKQGDGSGYRTPEASSPKVSCIGQIKRSKSKTSKARKAAKNVAPAAACGMDGGACPMPPRPSAHRPKSSLVKRMFSRRSRSRPSSSSSSHKSSGAADLYKGRPESSAAVAAEPVSWTRMAGLGQMKRFTSVREASQDFHWREAERRGSDVYVDDDYADDGVVSFSAPMMLGDGVLASDPRREVTVWWRXPMSPPIPLKLPESGPGASKNILQA

SEQ ID NO: 30349 - protein, 269 aa, Glycine max; identical to SEQ ID NO: 1059

SEQ ID NO: 30350 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLAAITVLIILLINIFTKGFIKSISILIGLVVGTAIAATMGLVDFSPVAVAPLVHVPIPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30351 - protein, 465 aa, Oryza sativa
MAELPLAAGLLDLRPCKLAPPPPPPLPVSPSPRHHRRPHSTATACRAAPDLHSSTELADGSIVFRFARPRDDDDEEQQQRRADAVAPGAAAVVESGLDGDAAAAAEPEARDGGGEGEVTATATGLGAEEVVASGGAEATATSGLEDAGEEASDGSTARDSDTDVDTESSASTAADDDQPAEFAVPPPPAEEVCNKVDWEKDTSEVKNTDRMVPVASSTLVLASGAAILPHPSKAATGGEDAYFIACDGWFGVADGVGQWSFEGINAGLYARELMDGCKKFIMENQGAADIKPEQVLSKAADEAHSPGSSTVLVAHFDGQFLNASNIGDSGFLVIRNGEVYQKSKPMVYGFNFPLQIEKGDNPLKLVQNYTIELEDGDVIVTASDGLFDNVYEQEVATMVSKSLQADLKPTEIAEHLAAKAQEVGRSAAGSTPFSDAALAVGYLGFSGGKLDDIAVVVSIVRKSEI

SEQ ID NO: 30352 - protein, 406 aa, Streptococcus pneumoniae
MQAQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGVYVVLVSGIFSKVANLFPSIVTGSVITTIGLTLIPVAIGNMGNNVPEPTGQSLLLAAITVLIILLINIFTKGFIKSISILIGLVVGTAIAATMGLVDFSPVAVAPLVHVPTPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30353 - protein, 556 aa, Ashbya gossypii ATCC 10895
MRISRSSSSRVPPSKTQRTHREEQTMYQVEAERLVSAAEERGTAALAHGGSSDRMWQRARGVARVLGKYVRFVGPGLLVSVAYMDPGNFSTAVAAGSAHRYQLLFSVLVSTVLAAFWQCLCAKLGAVTGLDLAQNCRAHFPHNVNVVLYALAEMAIIATDLAEVVGTAISLNILFGIPLPLGVVLTVVDVLVVLMAYKPNGSLRVVRWFEMFVSLLVILTVVCFTVEVFSVDVGSPQEVLRGFLPSRTVFEGDGLYLSLAILGATVMPHSLYLGSGVVQPRLRDFDIRKGYYVPSDHDRENNHPNYKPSLEAIDDAMHYTVAELLVSLFTVALFVNCSILVVAGATLHGRLSDEDTGDLFSIYNLLCSTLSKAAGTIFVLALLFSGQSAGIVCTLSGQMVSEGFLSWTIAPSVRRTLTRAVAITPCLILVLVAGRTGLSAALNASQVVLSLLLPFVSAPLLYFTGNKQIMRVPLDNTCYHVLPDDEIPLTTLRPNSAESDRSALPPLASSASPAPGFRDMSNSTLTNVLAWLLWVFVSALNFYLLISFTSGKDIHI

SEQ ID NO: 30354 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLAAITVLIILLINIFTKGFIKSISILIGLVVGTAIAATMGLVDFSPVAVAPLVHVPTPLYFGMPTFEISSIAMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30355 - protein, 289 aa, Candidatus Kuenenia stuttgartiensis
MFKGSLVALVTPFNNGQVDYKKLKELVEFHIENGTNGIVPCGTTGEAATLSFEEHEQVVSEVVNYVSGRIPVIAGAGSNNTKEAIHLTKHARKTGADGALVITPYYNKPTPEGLYRHYKAIAEEVDIPIVIYNVPSRTGISILPETVARLAEMKNIVAIKDASGNIDQATKISQLCNITVLSGEDSLILPIMSVGGKGVISVTANIAPSDTAALVRHCLEGNFGKALEYHYKLFPLCKGMFIETNPIPVKTAMKLLGRLNGEMRLPLCEITKENEERLKTVLEDYGLLS

SEQ ID NO: 30356 - protein, 281 aa, uncultured archaeon GZfos14B8
MPDRNSIIEKREAEKEKDKVVVLDFGGQYSHLIVRRCRELGVYTELLPYDMPLEELKRGIEGNIKGIILSGSPFSVHEPNSPKCSSEIVDLNIPILGICYGAQLIAYVNGGVVGEGRKSEFGRTELFFEDSDLFDGLTERGSEGGRINVWMSHGDVIERFDGADIIGYTMNSPVAAFRISNIYGVQFHPEVHHTDKGEKILWNFLYKICGCERNWTIESFVIDKIEEIRSAVGNDGRVICGLSGGIDSSTTALLINKAIGDRLTCIFVDMDYCEKKKKKRL

SEQ ID NO: 30357 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLAAITVLIILLINIFTKGFIKSISILIGLVVGTAIAATMGLVDFSPVAVAPLVHVPTPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30358 - protein, 243 aa, uncultured archaeon GZfos14B8
MRMVFVDAKERFLERLRGVKDAEAKRKVIGELFINIFEEEASKLGNVDFLAQGTIYPDRIESAGASSRNASRIKSHHNVGALPEKLGLKLIEPIKDLYKDEVREVAKELGMPPQILNQHPFPGPGLAARIIGEVTEDKLRICREASHVVEEELKRSGWYNKVWQAFAVVGDDVATGVLGDARSLGRIVTIRVVESREAMTADFVKLPYEVLESMSKRITNEVKGVTWVTYAISSKPPATIEPC

SEQ ID NO: 30359 - protein, 348 aa, Chromobacterium violaceum
MSTGLPEAWPRLLGDVGGSNARFALETAPGVIEDILTLSNERYPTLEDALRDYLAQVGARRVAHAAIGIANPLNGDLVRMTNCHWSFSIEATRRALGLSTLLLLNDFTALALALPRLPRRELAQVGGGAPRPDAPLALIGPGTGLGVSALVPHAGGWRALAGEGGHTSFAPANEREIGIWRYASARFGHVSHERLLSGSGLSLLHRALCALDGAEEAGLAPAEVSARGLSGADARCREALEIFCALLGSAAGNLALTLGARGGVYIGGGIVPRLSGFFEQSPFRRRFEDKGRMSAYLADIPVYLITSAYPALPGVAAHLADHLAPRSDPAPVAAPTHPRGGTAGDMHA

SEQ ID NO: 30360 - protein, 1066 aa, uncultured archaeon GZfos14B8
MPKAEDIKKVLVIGSGPIQIGQAAEFDFSGSQACRALREEGVEVVLVNSNPATIMTDLEMADVIYIEPLVADVVAKIVEKERPDGILAGLGGQTALNMTAELAELGVLSKYDVKVLGTPLEAIYDAEDRERFKQTMERINEPIPRGVTVNSVAEAEEVVGELGLPLIIRPSYTLGGTGGGIARTLEELRGIVSYGLQVSRIHQVLVEESVLGWKEIEYEVMRDAKDTCITICNMENLDAMGIHTGESIVVTPTQTLSDEEHQMLRSAAIKIIRALRVEGGCNIQLALKEGLYRVIEVNPRVSRSSALASKATGYPIARVAAKIAIGLHLDEIRNDVTEETPASFEPAIDYVVVKIPRWPFDKFPNADRTLTTSMKSTGEVMAIGRTFEEALQKAIRSLDIDKDFGAGYEKWSEAELKRLLEFPTDDRIFAIYEALKRDISIEEIAELSCIDSFFIKKIEKIVQQEARLKENPGGNLRKAKRMGFTDERIASLTGRSREEINDLRRKEGIIPTYKMVDTCAAEFEAKTPYFYSSYEDECELKPSARKKVLIIGAGPIRIGQGIEFDYCTVHAVKALKEEEIEAHIINNNPETVSTDYDTSDKLFFEPLTLEDVMNVIEKEKYDGVMVQLGGQTSVNLAVPLKKELERLGSKTVIMGTDPENMDMAEDRERFSKLLLRLQIPQADSGYATTLEGAKEVVLRIGFPVLVRPSYVLGGRAMEIVHDEEELVRYMREAVRVSKEKPVLIDKFLEKATEIDVDAVCDGEEVLIGAIMEHIEEAGIHSGDSACVIPPQSLSVDVIETVRDYVRRIALGLQIKGLLNIQMAVKDDVVYVLEVNPRSSRTIPYVAKATGIPLANLAAKVMLGHKLRDLGVKEVEPGHVAVKEVVLPFLKFTGVDTILGPEMKSTGEVMGIDDEFDKAFFKSELAADNPLPLDMGNTVFVSVCEEDKGAIVEVARKLKEAELSIVGTEGTVEYLRHRGIVSKKLRKLQEGSPNVIEMMHSQEIKLVINTPTDKQSYKDGYQIRRACIELSIPYITTMQAAKAAASAILGMKGSEIKVKSINEYFVK

SEQ ID NO: 30361 - protein, 145 aa, Pisum sativum
MESVQRSLSLLVLCFLIMGTTMLVSGQSANNVRATYNNYNPQNINWDYNRASVYCATWDANQPLSWRHYGWTAFCGPAGPTGRDSCGKCLRVTNTATGAQVTVRIVDQCSNGGLDLDVNVFNQIDTNGGGYQAGHLTVNYVFVNC

SEQ ID NO: 30362 - protein, 549 aa, Zea mays
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSSFIIMDDADVDHAVELAHFALFFNQGQCCCAGSRTFVHERVYDEFVEKAKARALKRVVGDPFRKGVEQGPQIDDEQFKKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGMGREKGVDSLKNYLQVKAVVTPIKNAAWL

SEQ ID NO: 30363 - protein, 303 aa, Oryza sativa (japonica cultivar-group)
IDMSRLINPEFSEEEIAKLGSACEDWGFFQLVNHGVDGELLQRIKDDITEFFRLPLQEKMSVAIPPNGLQGFGHHFVFSKEQKLDWVDLLFLTTRPVEDRTTEFWPTKPPTFRDSLDKYSLEIANVSAKLFKFMAINLGVDEEALLAAFKPEQPQSVRINHYPPCSQANKVLGLSPHTDGVGMTLLLQVNDVQGLQIRKDGRWFAVKNLPGALVVNVGDVLEILTNGKYKSIEHRAVINPDKERITLAAFQSVPLSSTVGPLQELLMKGEARYKTVDGAEFTKGYFAAKLEGRRYLESLKLGV

SEQ ID NO: 30364 - protein, 129 aa, Pisum sativum
MGTTMLVSGQSANNVRATYNNYNPQNINWDYNRASVYCATWDANQPLSWRSKYGWTAFCGPVGPTGRESCGKCLRVTNIATGAQTTVRIVDQCHNGGLDLDVNVFNQIDTNKQGYQQCHLQVNYVFVNC

SEQ ID NO: 30365 - protein, 130 aa, Pyrococcus furiosus DSM 3638
MTLLDPLANALSHITNSERVGKREVYIKPASKLIGEVLRVMQKYGYIGEFEFIDDGRAGVYRVQLLGRINKAGAIKPRFPVKVSEFEKWEKRFLPAFEFGILIVSTSQGVMSHKEAIEKGIGGRLIAYVY

SEQ ID NO: 30366 - protein, 1073 aa, Escherichia coli K12 [sequence omitted]

SEQ ID NO: 30367 - protein, 229 aa, Salinibacter ruber DSM 13855
MGAADTSASPLSVTYHTNRKRDRPTTCRGVPFPARVSAPYVHLDRRACLRSPSLLHSCVTAFLLPMDDEPAIPNSSVEDVLEAKGALHDPTTVLTAAPQDSVYDCIDRMAEIGVGSIVVTADGAIAGIFTERDHMRKMALEGRAPRDTAVQTVMTEDVATVTPAQSLEDALDRMRDLQCRHLPVVDADGQLSGIISMRDCMRQLSEAAKSKALQLIEYMEEEYVVRQYG

SEQ ID NO: 30368 - protein, 418 aa, Solibacter usitatus Ellin6076
MRIRVLGIVLAGGKGTRLSPLTRERAKPAVPFGGKYRIIDFVLSNFINSGIYSIYVLTQFRSQSLLQHLAEGWQFGSLLKNQFVIPVPAQMRSEDETWYQGTADAIYQNINLVEQADPHVVAIFGGDHIYRMNIASMIEYHVAKAAEVTIAAIPMPKKHADEFGVIEAADDDRILGFHEKNPDAPTMPGDPDQVYASMGNYIFSTRTLLSLLEEDSKLPHSHHDFGKDILPRLAGKGRMYAYNFETNRIPGEPADASPYWRDVGTIEAYYEANMDLRYVSPALNLYNREWPLRSTSYSDPPAKFTFDDANRRGQAIDSIVSGGCILSGGVVRNSVLGRGVRVHAGAMVEDSVILDNCDIGRRAKIRRAILDKNVRVAEDAMIGYDLEVDRAKGYHVTETGIVVVGGERSQVDITGLVV

SEQ ID NO: 30369 - protein, 533 aa, Oryza sativa
MAATAAETAAAATATAGGCRVVRWRRWTFASLGALLSNLGPVWFLIAPLLAAYAPRRLLLTYFNLVLRRRARRLLAAVDPYVTVDIPDPGAADAHQQYYHHRSRLGGRRAGDNAYEEVKAYLSAACSSEARELRAEAAAEGRGLVVSMRDGQDVADEFRGATMWWSSVDEEQQGGGARRRSQRLTFHQLHRRLVVDEYLPHVRRRGRELLFHNRRRRLYTNNKSLSYSSVYHKAWSYVNFDHPTTFETLAMEPAKKAAIMDDLDAFRRSGEFYRRAGKPWKRGYLLHSPPGTGKSTMIASMANYLDYDIYDVELTMVSDNNDLRKLLIETTSKSIVVIEDIDCSLDLTGDRATRRPGEIRGGGSMVTLSGLLNFIDGLWSASGGERVVVFTTNHVEKLDPALIRRGRMDMHIEMSYCRAAAFRTLAKNYLDVDAHHLFDAVDDILDKEDITPADVAECLMAAKRSSDSDVTSSLEFLVDELNKRAMENAKAVAEAKARAEAEAEAKAMADDDSEEDDDHYSDDYTDDDDYDDD

SEQ ID NO: 30370 - protein, 370 aa, Lactococcus lactis subsp. lactis Il1403
MPETTTILYRGGVFMRAARFYDRGDIRIDEINEPIVKAGQVGIDVAWCGICGTDLHEFLDGPIFCPSAEHPNPITGEVPPVTLGHEMSGVVNFIGEGVSGLKVGDHVVVEPYIVPEGTDTSETGHYNLSEGSNFIGLGGNGGGLAEKISVDERWVHKIPDNLPLDEAALIEPLSVGYHAVERANLSEKSTVLVVGAGPIGLLTAAVAKAQGHTVIISEPSGLRRKKAQEAQVADYFFNPIEDDIQAKVHEINEKGVDAAFECTSVQPGFDACLDAIRMGGTVVIVAIWGKPASVDMAKLVIKEANLLGTIAYNNTHPKTIDLVSTGKIKLDQFITAKIGLDDLIDKGFDTLIHHNETAVKILVSPTGKGL

SEQ ID NO: 30371 - protein, 520 aa, Candidatus Kuenenia stuttgartiensis
MGRQSFYLTTPIYYVNDIPHIGHSYTTIAADVLARYRRLQQYDVFFLTGSDEHGQKIQKAAEACNKTPNDFVDMVVGKFKDLWENLNISNDDFIRTTDERHVKRVKKIFQKLFENGDIYLGEYEGRYCVPCESFWTETQLDEGRCPECRRNVEKVKEKNYFFRLSKYQKPLIEHYDKHPEFIQPESRRNEILQRITSHIEDISISRSAVTWGIQVPMDTTQTIYVWIDALLNYITALGYDDDMELFQKYWPANVHIIGKEILWFHGAIWPAILMSLKIELPFKIFTHGWWTIEGQKISKSLGNAIDPLNIIQIYGTDAYRYFILREVPFGSDGNFSYTALTNRINSDLGNDLGNLLQRTLTMIEKYFDAVIPEYSEKDDVLKEISQNTLSKINKELDNLQFSKALEAIWEFVGSANKCIEEKKPWVLAKTSAYKPQLKNVISSLAKAIKDISIVIYPFMPNTCIEIQKQLGILENNESPCLEYQQIIKSGVIVKKGKPLFPRIEKETENPGKNIAMNNKV

SEQ ID NO: 30372 - protein, 473 aa, Parvularcula bermudensis HTCC2503
MTIPVLMPALSPTMEEGTLAKWLKNEGDQVSAGDVIAEIETDKATMEVEAVDEGVLGKILVEAGTEGVKVNAPIAVLLEDGEDKSDIDEADLSAPAAADAAPKKGDTDKPKTSEIDQDTKKKALPDKPSRASAQAAAPEIPDDTPMVETTVRDALRDAMAEEMRRDEQVFVMGEEVAEYQGAYKVTRELLQEFGDRRVVDTPITEYGFAGLGVGAAFAGLRPIVEFMTFNFAMQAIDHIINSAAKTRYMSGGQMACPIVFRGPNAAASRVAAQHSQDYAPWYGHVPGLIVISPYSAMDAKGLLKAAIRNPNPVVFLEHELLYGEKGDVPEAEDFVLPIGKAKIARQGKDVTIVSYSRGVMFALQAADQLAQEGIEAEVVDLRTIRPMDVETVADSVRKTNRLVTVEESWGPMGIGAEIGWQVTRAAFDYLDAPPERVTQEDVPLPYAANLEKLSLPNAEKVVAAAKRVLYLDD

SEQ ID NO: 30373 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLSAITVLIILLINIFTKGFIKSISILIGLVVGTAIAATMGLVDFSPVAVAPLVHVPTPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30374 - protein, 313 aa, Avena sativa
VVVITGASSGLGLAAAKALAETGKWHVVMACRDFLKASKAAKAAGMADGSYTVMHLDLASLDSVRQFVDAFRRAEMPLDVLVCNAAIYRPTARKPTFTAEGVEMSVGVNHLGHFLLARLLLEDLQKSDYPSRRLVIVGSITGNDNTLAGNVPPKANLGDLRGLAGGLTGASGSAMIDGDESFDGAKAYKDSKVCNMLTMQEFHRRYHEDTGITFSSLYPGCIATTGLFREHIPLFRTLFPPFQKFVTKGFVSEAESGKRLAQVVGEPSLTKSGVYWSWNKDSASFENQLSQEASDPEKARKVWELSEKLVGLA

SEQ ID NO: 30375 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKIANLFPSIVTGSVITTIGLTLIPVAIGNMGNNVPEPTGQSLLLAAITVLIILLINIFTKGFIKSISILIGLVVGTAIAATMGLVDFSPVAVAPLVHVPTPLYFGMPTFEISSIAMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30376 - protein, 372 aa, Bacillus clausii KSM-K16
MSKRDYYEVLGVDRNASVEEVKKAYRKLARKYHPDVNKEEDAEAKFKEVKEAYDTLSDPQKKARYDQFGHADPNQGFGGAGASGDFGGFSDIFDMFFGGGGGRRNPNAPRQGDDLQYTMTLEFKEAVFGKETEIEIPREETCGTCHGSGAKPGTKPDTCSHCGGSGQLNVEQNTPFGRVVNRRVCNYCEGTGKIIKQKCATCSGKGKVRKRKKINIQVPAGIDNGQQLRVAGQGEAGANGGPPGDLYVVFQVKPHEFFERDGEDIYCEVPLTFPQVALGDEIEVPTLTGKVKLKIPAGTQTGTSFRLRGKGVPNVHGRGQGDQHVQVRVVTPKNLTENEKELMREFAGMSGGRPEEQNDGFFDKLRRAFKGD

SEQ ID NO: 30377 - protein, 422 aa, Staphylococcus aureus subsp. aureus MW2
MKNLILSVQHLLAMYAGAILVPIIVGTSLKFTPEQIAYLVTVDIFMCGVATFLQANKVTGTGLPIVLGCTFTAVAPMILIGQTKGIDVLYGSLFLSGILVIIIAPFFSHLVKFFPPVVTGSVVTIIGINLMPVAMNYLAGGQGAKDYGDVKNILLGLMTLIIILVLQRFTTGFIKSIAILIGLVLGTIGAGLLGMVDINQVNHAGWLGIPVPFRFSGFSFDVTSTLVFFIVAIVSLIESTGVYHALSEITGKKLERKDFRKGYTAEGLAIVLGSIFNSFPYTAYSQNVGLVSLSGAKKNNVIYGMVVLLLICGCIPKLGALANIIPLPVLGGAMIAMFGMVMAYGVSILGHIDFKNQNNLLIIAVSVGLGTGISAVPQAFKGLGEQFAWLTQNGIVLGAISAIILNFFFNGIKYKQTEENVK

SEQ ID NO: 30378 - protein, 513 aa, Staphylococcus aureus subsp. aureus MW2
MEMAKEQELILVLDFGSQYNQLITRRIREMGVYSELHDHEISIEEIKKMNPKGIILSGGPNSVYEEGSFTIDPEIYNLGIPVLGICYGMQLTTKLLGGKVERANEREYGKAIINAKSDELFAGLPAEQTVWMSHSDKVIEIPEGFEVIADSPSTDYAAIEDKKRRIYGVQFHPEVRHTEYGNDLLNNFVRRVCECKGQWTMENFIEIEIEKIRQRVGDRRVLCAMSGGVDSSVVAVLLHKAIGDQLTCIFVDHGLLRKGEGDMVMEQFGEGFNMNIIRVNAKDRFMNKLKGVSDPEQKRKIIGNEFVYVFDDEASKLKGVDFLAQGTLYTDVIESGTKTAQTIKSHHNVGGLPEDMEFELIEPINTLFKDEVRKLGIELGIPEHLVWRQPFPGPGLGIRVLGEITEDKLEIVRESDAILRQVIREEGLEREIWQYFTVLPNIQSVGVMGDYRTYDHTVGIRAVTSIDGMTSDFARIDWEVLQKISSRIVNEVDHVNRVVYDITSKPPSTIEWE

SEQ ID NO: 30379 - protein, 554 aa, Oryza sativa (japonica cultivar-group)
MGSVAAEEVVVFRSKLPDIEIDNSMTLQEYCFARMAEVGARPCLIDGQTGESYTYAEVESASRRAAAGLRRMGVGKGDVVMSLLRNCPEFAFSFLGAARLGAATTTANPFYTPHEVHRQAEAAGARVIVTEACAVEKVREFAAERGVPVVTVDGAFDGCVEFREVLAAEELDADADVHPDDVVALPYSSGTTGLPKGVMLTHRSLITSVAQQVDGENPNLYFSKDDVILCLLPLFHIYSLNSVLLAGLRAGSTIVIMRKFDLGALVDLVRKHNITIAPFVPPIVVEIAKSPRVTAEDLASIRMVMSGAAPMGKDLQDAFMAKIPNAVLGQGYGMTEAGPVLAMCLAFAKEPFKVKSGSCGTVVRNAELKIVDPDTGTSLGRNQSGEICIRGEQIMKGYLNDPEATKNTIDEDGWLHTGDIGFVDDDDEIFIVDRLKEIIKYKGFQVPPAELEALLITHPEIKDAAVVSMKDDLAGEVPVAFIVRTEGSEITEDEIKKFVAKEVVFYKRINKVFFTDSIPKNPSGKILRKDLRARLAAGIPDAVAAAAADAPKSS

SEQ ID NO: 30380 - protein, 361 aa, Escherichia coli O157:H7 EDL933
MMKTMRIAAIPGDGIGKEVLPEGIRVLQAAAERWGFALSFEQMEWASCEYYSHHGKMMPDDWHEQLSRFDAIYFGAVGWPDTVPDHISLWGSLLKFRREFDQYVNLRPVRLFPGVPCPLAGKQPGDIDFYVVRENTEGEYSSLGGRVNEGTEHEVVIQESVFTRRGVDRILRYAFELAQSRPRKTLTSATKSNGLAISMPYWDERVEAMAENYPEIRWDKQHIDILCARFVMQPERFDVVVASNLFGDILSDLGPACTGTIGIAPSANLNPERTFPSLFEPVHGSAPDIYGKNIANPIATIWAGAMMLDFLGNGDERFQQAHNGILAAIEEVIAHGPKTPDMKGSATTPQVADAICKIILR

SEQ ID NO: 30381 - protein, 275 aa, Zea mays
  misc_feature (184)..(184): Xaa can be any naturally occurring amino acid
  unsure (1)..(275): unsure at all Xaa locations
MRSPRGGGGLEHVDLIPGIPDDVAVDCLARVPHASHRAMRRVCRGWRSAAAAPAFASARAAAGANEDLVYLMQFGNPSADDGPKDGDDGPGNTPAYGVAVYNVTTGEWRRERGAPPVVPVFAQCAAVGTRLAVLGGWDPLSFEPVADVHVLDAATGRWRRGAPMRSARSFFACAEAGGRIYVAXGGHDKHKNALKTAEAYDAEADAWDPLPDMSEERDECDGMATVAGDRFLAVSGYRTARQGGFERDAEWFDPAARAWRRLERVRAPPSAAHVV

SEQ ID NO: 30382 - protein, 887 aa, Mycobacterium avium 104
MANADCIVIQGSNMAECHPVGFQWVEEARARGARVIHVDPRFTRTSAVSDRHIPIRAGSDVVLLGALINHVLTNDLWFSEYVVAYTNAATVINENFRDTEDLGGLFSGFDPETGQYDTSSWAYEEEDDGRSGGEIESPGGGHTHGATATHSAAGDEHGSGGPPLAHARVRRDETLQHPRTVFQILKRHYARYTPEMVKDVCGISREDFDYLARSIVENSGRERTTCFAYAVGWTQHTLGAQFIRTATILQLLMGNVGRPGSGIMALRGHATIQGSTDIPTLFNLLPGYLPMPKAGVHDTLADYLDAVGSKKQKGFWANADAYTVSLLKAWWGEAATADNDWAYDYLPRLTGPHGTYQTVMGMLADEVEGYFLLGQNPAVGSAHGRMQRLGMSHLKWLVVRDFNLIESATWWKDGPEIASGELKTEEIETEVFFLPAATHVEKAGSFTQTQRLVQWRHQAVEPPGQCQSELQFFYELGKRIRQRLAGSTDERDRPLLDLTWDYPTDEHGDPDGEAVLAEINGYRVGEPADPLASYTELRADGSTAAGCWIYTGVYANAVNQAARRVPNGGASPSQSEWGWAWPADRRVLYNRASADPDGKPWSERKRYIWWDPDQRRWVGYDVPDFVVDRAPGARPDPELGGPDALAGDDPFIMQADGKGWLFAPKGVVDGPLPTHYEPQESPVANALYPQQRNPARITFARKDNLSAPSAGEPGSDVYPYVFTTYRLTEHHTAGGMSRWLPYLSELQPEMFCEVSPELAAERGLQPYGWATIISPRAAIEARVLVTKRVAPLVINGHTVHQIGLPYHWGVGGDAVVSGDAANDLLGVTLDPNVQIQESKAGSCDIRPGRRPRGEELLRLIADYQSRSGVTAETGNVRVDDAVWERGS

SEQ ID NO: 30383 - protein, 561 aa, Escherichia coli O157:H7 EDL933
MKKVWLNRYPADVPTEINPDRYQSLVDMFEQSVARYADQPAFVNMGEVMTFRKLEERSRAFAAYLQQGLGLKKGDRVALMMPNLLQYPVALFGILRAGMIVVNVNPLYTPRELEHQLNDSGASAIVIVSNFAHTLEKVVDKTAVQHVILTRMGDQLSTAKGTLVNFVVKYIKRLVPKYHLPDAISFRSALHNGYRMQYVKPELVPEDLAFLQYTGGTTGVAKGAMLTHRNMLANLEQVNATYGPLLHPGKELVVTALPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVSPGQPGELCVRGPQVMLGYWQRPDATDEIIKNGWLHTGDIAVMDEEGFLRIVDRKKDMILVSGFNVYPNEIEDVVMQHPGVQEVAAVGVPSGSSGEAVKIFVVKKDPSLTEESLVTFCRRQLTGYKVPKLVEFRDELPKSNVGKILRRELRDEARGKVDNKA

SEQ ID NO: 30384 - protein, 394 aa, Photorhabdus luminescens subsp. laumondii TTO1
MRNQTFIIVGAGQAGAMAAATLRQQQFDGDIILIGKEYHAPYERPILSKDYLINPEEAPKYLFSEDFYLEKQIDLRIGQLVSQIMPSKHCVVLENGGKLRYDKLLLTMGARARRFPLLDQLGENIYTLRTLDDAQRLRQAVKKDKRILIVGGGVIGLELAATSCELGANVTVIEQADNIMGRCAPPLLQDYLLNRHQEKGVQFFLDTNIVSAQKQGSELVLILNTGEKVIGDIIIYGIGAEFRDQLAADAGLVTDGGIVIDSRCQTSEPDIFAAGDVCLQREPLTGDLQRRETWENANRQATIAAHAMMGLAPPQPGAPWFWTDQWGINIQMVGNMQAEEWHIQGDLQSDKAILFGTENEVLVGAVAINQGREMRNLRKLLANPAQVVSGVEWA

SEQ ID NO: 30385 - protein, 140 aa, Synechococcus elongatus PCC 7942
MTAVIRRLIWGMSLFAAIAPASWSFAQTTNAPAPAQADQSLTLFSDIQEANSKTGVVTARGNVVILYPARQLRATAAQAQYFSRERRIILTGNVFVQQEGGNSLRGETVTYLIETGKFVALPTPQGQVQSIYNLDSAESP

SEQ ID NO: 30386 - protein, 270 aa, Nostoc sp. PCC 7120
MFGILVAIIVIIGLNSFIIINPGQAGVLSILGKARDGALLEGIHLKPPLISAIDVYDLTVQKFEVPAESSTKDLQNLSARFAINFRLDPIQVVDVRRKQGTLENIVSKIIAPQTQEAFKIAAARRTVEEAITKRSELKEDFDNALGDRLDKYGIIVLDTSVVDLTFSPEFARAVEEKQIAEQRAQRAVYVAREAEQEAQAEINRAKGKAEAQRLLAETLKAQGGQLVLQKEAIEAWKTGGAQMPKVLVMGKESPGSVPFIFNLGNTQNLN

SEQ ID NO: 30387 - protein, 437 aa, Yersinia pestis KIM
MAYQQERIMSHRELEQRRKEATPRGIGVLCDFYAVRAENATLWDEQGREYIDFTAGIATLNIGHRHPKVMAAVRQQLDQFTHTAYQVVPYASYVTLAEKINSLAPISDSNMTAAGNSKTAFFTTGVEAIENAVKIARAATGRPGVIAFSGAFHGRTLLAMALTGRAVPYKVGFGPFPASIFHALYPNELYGVSVEEAISSVERLFRCDISPTQVAAILFEPIQGEGGFNIAPPEFVSALRTLCDEHGILLIADEVQTGFARTGKLFAMEYYPDTKVDVITMAKSLGGGMPISAVTGRADIMDAPLPGSLGGTYAGNPLAVAASLAVLDIIAEEKLCERALILGAKLVDVLEKAQMSNAAIVGIRARGSMVAVEFNDPVSGKPSPELTRAYQRQALEEGLLLLSCGVHSNVIRFLYPLTIPDKQFKQAMNILTRLLAS

SEQ ID NO: 30388 - protein, 335 aa, Debaryomyces hansenii CBS767
MAITIGINGFGRIGRLVLRIALQRSDIKVVAVNDPFIAPEYAAYMFKYDSTHGRYKGEVTSKDDSLVIDGQSIKVFGEKDPASIPWGKAGVDYVIESTGVFTTTEGAQKHIDGGAKKVIITAPSSDAPMFVVGVNEQKYTPDLKIVSNASCTTNCLAPLAKVINDKFGIEEGLMTTVHSITATQKTVDGPSHKDWRGGRTASGNIIPSSTGAAKAVGKVIPELNGKLTGMSLRVPTVDVSVVDLTVRLKKSATYEEISEAIKAASNGELKGILGYTEDAVVSTDFLGSDYSSIFDQKAGILLSPTFVKLISWYDNEFGYSTRVVDLLEHVAKASN

SEQ ID NO: 30389 - protein, 86 aa, Oryza sativa
  misc_feature (44)..(44): Xaa can be any naturally occurring amino acid
  unsure (1)..(86): unsure at all Xaa locations
MVGAKPFSTEIFVSRLSFYTTEEELKNVFSPFGAVEEARLVREXTGRPKGFGFVKYSSQADGEKAVKEMDGRIIRGRLIFVEIAKE

SEQ ID NO: 30390 - protein, 358 aa, Ashbya gossypii ATCC 10895
MAWPRRAAEVARSTMASRLDKLPEAVSRLQSLSHRQLLRLAQGVCIPALSPSLHKGQSGRVCVVGGSLEYTGAPYFSAHAAALMGSDLVHVLCEWNAATPIKAYSPDLMVHPHLRDSSSLARGLEPATEAVRALVDRVHVLVLGPGLGRDPAMLRSVAGILEYVADKHEGGIPVVLDADALLLLSEQATAAAARAALRRFPPDRVILTPNAVEAKRLAGAFELDDPARLSEYLNCTVVLKGGPDRIYAPGGSSPLSCSHEGSLKRVAGQGDTLRGCLPAMLAYNRAIHDFGIAEPDYTGLEGGTLSASERTALCCYVACAVARGASHRAYEAQGRAMQTSDLNGHVGAIFRDFFPERQ

SEQ ID NO: 30391 - protein, 306 aa, Mesorhizobium sp. BNC1
MILCCGEALIDMLPRETADGEAAFVPHVGGSVFNTAIALGRLEVPVSFFSGLSEDLFGVRLQDTLRASGVDLSHAIISTRPTTLAFVSLNEGQASYHFYDENTAGRMLFEADLPDLDESVEAMLFGGISLAPEPCGGTFEALMTRESPTRVTMLDPNIRQAFIRDPLAHKARMRRMMAIADIIKISEEDLAWFGGPASAGEAAQVLLAAGTRLVVVTSGGKGASAYWRGGSFVISAVNVKVADTVGAGDSFNAGILAALRKAGYLKKSRLASLTTEVVRDALSFATRVAAVTVSRAGANPPWADEV

SEQ ID NO: 30392 - protein, 447 aa, Trichodesmium erythraeum IMS101
MAYDYDLFVIGAGSGGLASSKRAASYGAKVAIAENDLVGGTCVIRGCVPKKLMVYGSRFSHFYKDAVGYGWSEVEPSFDWHKLIDAVNTEVLRLNKLHISFLEKAGVEIIEEYAKFIDPHTIEVGDRKVTADKILIAVGGKPEKIDIPGIEYSITSREIFHLKEQPKRMAVWGGGYIGVEFAGILNGVGTEVTQIIRRDSILRGFDTDISSNIQEGMVKHGINFRENTNVEKIEKVPEGLKVHLSGENAEPLIVDTFLCATGRKPNLAGLNLENAGVETLRGAVAVSNNCRTTQANIYAIGDCIDKVNLTPIAIAQGRAFADTEFGNIPRSISLENIPTAVFSEPEGGTVGLTEAAAREKFGDSIKCYRSKFRPMFHSFTGADEKVMVKLVVETNTDRILGVHMVGKDAGEIIQGMAIAVNMGATKADFDRTIGIHPSTAEELVTLN

SEQ ID NO: 30393 - protein, 200 aa, Zea mays
  misc_feature (188)..(188): Xaa can be any naturally occurring amino acid
  unsure (1)..(200): unsure at all Xaa locations
MPSAATPAISKAGITTSATGERHIPSSVRPDGSIRKEIRVRPGYRPPEDVELYKNRTAEGFRNRGKSGVPGAETITKEDETNKMSPAANKNAKRREARKKAAASASDSKEEPKPGSTENKDKDEANPEPGKVFDPEAEKEKEAKKLAKKLRQARELKDKKEKGDKLLPEQFEKVIKINELIRQLDTLXFDPQGERKKSET

SEQ ID NO: 30394 - protein, 352 aa, Oryza sativa (japonica cultivar-group)
MASAAIYSLFIINKSGGLIYYKDYGSAGRTDTNDSLRLASLWHSMHAISQQLSPTHGCEGIDLLQAHNFDLHCFQSLTGTKFFAVCETGAQNIETLLKVIYELYTDFVLKNPFYEMEMPIRCELFDLNLAQVRLPPPHGLTSQGSPNRFRRGYHHLTRLNGYRKVVAFVSFVNHQAALSAMSALNGTVFDPDTGDRLHIELAKSSSRKRHGDGGVYRVVDKRLKRKERAADHENAGDGGNDDDAWGEDDNGGNDVVVIDDWCFLSCTVVVNQGLSSIGGNLFQIYYLLEQDQPDKLSSDIPPCSTLFVANLGHSCTEEELKEVLSKQPGFHLLKMRRRGGMPVAFADFTLCV

SEQ ID NO: 30395 - protein, 358 aa, Brassica napus
MVAVERVESLAKSGINSIPKEYIRPKEELESINDVFQEEKKEDGPQVPTIDLQDIESEDETIREKCIEELKKAAMDWGVMHLINHGIPVDLMERVKKSGEEFFGLPVEEKEKYANDQAKGKIQGYGSKLANNASGQLEWEDYFFHLVYPEDKRDLSLWPKTPTDYIEATSEYAKCLRLLATKVFKALSIALGLEPDRLENEVGGIEELLLQMKINYYPKCPQPELALGVEAHTDVSALTVILHNMVPGLQLFYEGKWVIAKCVPDSIVMHIGDTLEILSNGRFKSILHRGLVNKEKVRISWAVFCEPPKDKIVLKPLPEMVSVESPAKFPPRTFAQHIEHKLFRNKQEELVTEKKDEV

SEQ ID NO: 30396 - protein, 476 aa, Propionibacterium acnes KPA171202
MTHMHVAGSVHADVAAAGPQWLTLPDDVNALDPALWSASTDRDDDGIVEVAGVTVTELLSQYGSPLYVLDESDLRQRARAFRDAFSEWDVYYAGKAFLTRTIASWIDQEGLFLDTCTGGELITALQGGMDPARIGLHGNNKSIDELKLALSVGVGRIIVDSLDEIMRIEQLCRENGWHARVMVRVTAGVEAHTHEYIATAHEDQKFGFSITNGAAMVAMVRCHTSDAIDLLGVHSHIGSQIFDTAGFEVAARRTMKLLEQFHQATGSALPELDLGGGFGIAYTSQDSPATVESLAGALREIVTLEARGRGMEVPHISLEPGRAIVGPTTMALYTVGTVKPVDLDTGAQRMYVSVDGGMSDNIRPALYAAEYSAVIANRTSEVAPVLCRIVGKHCEAGDILVRDVYLPGDVSPGDVIAVPGAGAYSRSMASNYNHVPRPAVVSVNEDRGVLVLLRRENIDDLLALDPGPIRAEVPCP

SEQ ID NO: 30397 - protein, 349 aa, Coprinopsis cinerea okayama7#130
MAPTRKVLSMPDPGTSIRPIYMYTEEQTKMIQALREYTSTICLPPSDPYHYWESRWLSRPDTHPRYMRAAKWNYGDAQKRIKATLEWRREFQPDLISPEDVRIEGETGKIILNGFDVDGRPVIYMRPGRENTETSPRQLRHLVWWLERAKDFMPPGQESLVIVVDYKSCTLRTNPSISIARKVLTILQQHYVETLGRACVTNLPFILNFFYKGIERFLDPVTRDKLRFNPNLTEIIPESQLDADFGGSYEFDFEPKCYWDQIIEICGIAPDGTRTRDIYSNPTEPFNTLPLANNVPRSRSDSSSGSDSDYKAPVTPKTTGSVRSLNINKADASVNVEEVSERRHTVMVG

SEQ ID NO: 30398 - protein, 198 aa, Triticum aestivum
MAGSDLSPPDPAATGVAIVIMGVSGCGKSTVAAMLADALGCGFVEADDHHSHANKDKMSNGVPLTDEDRLPWLESLRDTIRERLGRGEDVAVSCSALRLKYREVLRQGDVSYKPGSYGACRVKFVCLEASAEVIPERVRCRAAEGGHFMPASLVRSQLDLLEIDAAEGITVIDATVPAHAIVQATVAQFRDELASTAR

SEQ ID NO: 30399 - protein, 673 aa, Oryza sativa
MATGMLLRGLRSAASRTSPVFPTSASSPAPYVSPLLRRLYSAAAASAAASPALGPGGALDPSRIRNVAVIAHVDHGKTTLMDRLLRQCGADIPHERAMDSISLERERGITIASKVTSVSWKENELNMVDTPGHADFGGEVERVVGMVEGAVLVVDAGEGPLAQTKFVLSKALKYGLRPILLLNKVDRPSVSEETCNEVESLVFDLFANLGATEEQLDFPVLYASAKEGWASLEFTKSPPDNAKNMSALLDSILQHVPSPKADLEAPFQMLVSMMERDFYLGRILTGRVRSGVVRVGDKVHGLRSTDDGVQKIEDGKVVKLMKKKGTSMVIVEAAGAGDIISMAGLAAPAIGHTVSNSDILTALPTIELDPPTISMTFGVNDSPLSGRDGTHLTGAKIGNRLMAEAVTELGTRVLPGPLSESYEVQGRGELQLGILIENMRREGFELSVSPPKVMYRTDRGERLEPIEEVTVEVDEEHVGFVMETLTHRKGEVMDMGPVPGTTGRTRIFLTCPSRGLVGFKGIFSSFTRGTGFMHRAFQAYAKYRGQLGNVRKGVLVSVGKGLITSHALMSLEARGILFVSPGMEAYEGMIVGEHSRDSDLDINPVRTKELTNIRAPGKDENVRLSPPRLMSLEEAIGYVAADELIEVTPKVIRLRKKYLDATKRKMMKNKPMD

SEQ ID NO: 30400 - protein, 627 aa, Debaryomyces hansenii CBS767
MDSGHDDLYPLALLMDELKHDDVSNRVEAMQKLDTIAIALGPQRTLNELLPFLNDVAQDDEEEVFAVLANKLGDFVPLIGGRENCEPLIQILLILASMEEPIVRDKAIDSLNNISLELAHDQLIEIFLPMIQSLSQGNWFSKKIASCGLFKSIIIKVDSSTRRDLLNVFYKLICDESPMVRRSAANSLPNLINKLTWFTENYPNNEDKVTNKDWEIISQLFQHLINDEQDSVKFLSIDVLISILDFFQQVNDQSHNSEFLISSLKLINDESWRVRYTAADRFGKIAKNFATDESDLSKLIDPFISLMNDNEGEVRKAIAKQLPEFCELLSNFPTTNQAILNKIIPIVNKLSQDPHENVRSSLASSITNLSPILGKQSTIDNLLPIFLVMLKDEFPEVRLNIISNLSVVNEIIGINLLSINLLPAITELAQDNKWRVRLAIIEYIPKLANQLGESFFNDELLTLCMSWLWDPVFAIRDAAVNTLKELTIIFGSVWADNEIINRLLNNNNSGNENIDEDNKIDYSNFIIRITCLFAITKLIPVMNNDIIVSKLLPFINNFIDDSVPNIRFNIAKSYLVIAETLVKSKDNGAQKLINNEILPNLQKLQSDDDVDVRFFASKSIQGIKDLN

SEQ ID NO: 30401 - protein, 317 aa, Oryza sativa (japonica cultivar-group)
MVKEEEIITEAAGARGYMEMLGLGEEAADYLMCLSPSSYLSSPAASTTTAVASPTCASYLAPHPYHHLLSFSGQDQYHGDDVFGLQYYGGDQVIPAVVPQKSSPTTECSSSVSSMSSSPTATAISSSKSPAFKKKGSRGCDQRKATAPAAATTTNKRPRVRRERLGERIIALQQLVSPFGKSDTASVLHEALGYIRFLHDQVQVLSSPYLQRLPPSARVPEQERGTPAAEEQPPALRPSDLRSRGLCLVPISCTEHVAGAGAGTGHGNGADLWSVAAGMAKATATVTAAVERSKEAAAAAAATAALLRADRPGQQLA

SEQ ID NO: 30402 - protein, 935 aa, Debaryomyces hansenii CBS767
MLIIDSEPYEDKSNDKTVNGFRKKDVGLYAMNYGGCYVASVAIYSSYTQVLQAFIEAEKFNGPAIVLAYLPYHNEFDNTLSILKETKLAVDSGYWPLYRYDPTIEDESKSFILDSSNLRNQLKNFLDRENKLTLLAKKDPLLSRNLTSNATTEIKAKQLQAANDSYSKLLQGLSGPPLTVAFASDGGNAEAVAKKINRQALGRGLKSIVLAMDDISMEDLPNETNIVFIASTSGQGEFPTNGKQFWDGLKNSNDIDLSTIKFSVFGLGDSEYWPRKEDKHYYNKPSKDLFNKLKFYGGVELIDIGLGDDQDADGFNTGLNEWEPKLWKALGVDNVEGVEEPKPLTNEDMKIQSDYLRGTIVEGLNDQSTGAISAVDQQLTKFHGIYMQDDRDIRDDRKSKGMEPAYAFMVRVRLPGGIATPSQYLRMDELSNERGNGTLKLTTRATFQLHGVVKHDLKPAIRGMNAALMDTLAACGDVNRNVMVSALPHNAKVHSQISKTGALISEYLLPQTTAYHEIWLQGEDEGDKAGASKNWENRKEGPKKEKTLVAGNALTDFEPMYGPTYLPRKFKVVITVPPYNDVDVYAHDIGLIAIVEGDEVIGYNVLAGGGMGSTHNNKKTYPRTGSMFGYIAKDQIHIACEKIMLVQRDFGDRTNRKHARLKYTIDDLGVEVFKGKVEELLGFKFEKAKPFEIKSNVDYFGWCKDETGANHFTAFIENGRIEDTPELPQKTGLSKIAEYLLQNERPGEFRLTGNQHILISNINDDDLDTVKSLLAQYKLDNTDFSGLRLSSAACVAFPTCGLAMAESERYLPELITKLEEALEDYGLRHDSVVMRMTGCPNGCARPWVAEVALVGKAFGAYNLMLGGGHHGERLNKIYRYSIKEDEILSILKPLFKRWSLERNEGEPFGDFCIRIGIIKPTTEGKFFHDDLPEDA

SEQ ID NO: 30403 - protein, 291 aa, Haloarcula marismortui ATCC 43049
MADSFDVLTPLVTPFDADGNLDVAGIESLVQHVVAAGVDGIVPCGTTGEFETLSPQEYRTVVRTAATTAPDDCRVIVGTAATDVATVHKRMAFAAEQGADSTLVVPSYYGGQASGAGNEAFFDAVLADAPLPVYLYNIPGAVGQELSIETVAALAQSDAVAGLKDSSGDLPYVTAVMNQTPADFTVYQGHDGLFVPSIVLGGDGGISALSHLLFDELEQAGTAVASGNVAQARTVQRDVLSPLSDACAEFGFAPTVKALLADRGVIDHATVRPPRTSLSSDAVASVTERLE

SEQ ID NO: 30404 - protein, 485 aa, Triticum aestivum
  misc_feature (174)..(174): Xaa can be any naturally occurring amino acid
  misc_feature (254)..(254): Xaa can be any naturally occurring amino acid
  unsure (1)..(485): unsure at all Xaa locations
METPRGLLQSDASADQVASERSDSVQQHGVDKEHAMLAPFTAGWQTAISPTLIIERSEGCYIYDANGNKYLDALAGLLSTALGGSEPRLVKAATEQLNKLPFYHSFYNHTTRPSLDLANELISIFTARQMGKVFFTCSGSEANDSQGKLVWDYNNALGRPKKKKIIGRSQSDHXGTTYISASLSGLPTLHQDFDLPGNFVLHTDCPHYWRFHLPGETEEEFATRLANNLENLILKEGPDTIAAFIAEPVIGAGXVILPPKTYFEKIQEVVKKHDILFIVDEVITGFGRLGAMFGSDLYDIKPDLVSLAKALSSAYAPIGAILVSREISDVIYSHSNKLGTFAHGFTYSGHPVSCVVALEALKIYRERDIPGHVAHVAQRFQEGIKAFAAKSPIIGETRGVGLLIATEFTDNKSPYDLFPFEWGIGETFGAECKKRGMVVKVLGNLIAMSPPLIITLEEIDKLVSIYGEALKVTEERVAECKAKKE

SEQ ID NO: 30405 - protein, 472 aa, Arabidopsis thaliana
MAATRQLRTLQSQPENKVCVDCAQKNPQWASVSYGIFMCLECSGKHRGLGVHISFVRSVTMDSWSAIQIKKMEAGGNERLNKFFAQYGIAKETDIISKYNSNAASVYRDRIQALAEGRPWNDPPVVKEANKKPPLAQGGYGNNNNNNNGGWDSWDNDDSYKSDMRRNQSANDFRASGNREGAHVKSKSSEDIYTRSQLEASAAGKESFFARRMAENESKPEGLPPSQGGKYVGFGSSSAPPPRNNQQDDVFSVVSQGFGRLSLVAASAAQSAASVVQTGTKEFTSKVKEGGYDHKVSETVNVVANKITEIGHRTWGIMKGVMAMATQKVEEFTKEGSTSWNQQSENEGNGYYQNFGNGNKAANSSVGGGRPQSSSTSGHYNNSQNSNSWDSWGENENKKTEAVAPKGSSASNDDDGWTGWDDHDAKDDGFDGHYQSAGDKKSAGHNGKSDPLDWWRFSLRVIQNAGEKCIIN

SEQ ID NO: 30406 - protein, 309 aa, Polaromonas sp. JS666
MKTDILALGEAMVEFNQTSEDGGRKYLQGYGGDTSNAAIAAARQGASVGYVSAVGDDVYGQMLRELWTREGVNHSGVRTDARGFTAVYFVNHDERGHHFSFFRRGSAASRMTPDQLPAERIADARFLHLSGISAAISESACDTCFAAIDIARSAGVKVSFDTNLRLKLWPLARAGAVMRELIRQADICLPSYEDVVAISGLQDPDRLADFCLELGARVVALKLGSDGALLVDGNKRIRIPPFPCRPVDATGAGDTFGGALLARLAAGDDLETAGYYAAVAAALSTEGYGAVEPIPVAGQVRAAIERQAV

SEQ ID NO: 30407 - protein, 516 aa, Oryza sativa (japonica cultivar-group)
MASPPTASASASEAAESGRRSAPGPIDVPSPRDHLHHLLDRRDTPRVVHVEGTTMQRQRGEAAGDAGAAAAAKPEVKLVTGDGGYVLEDVPHVCDYLPDLPTYSNPLQDNPAYSVVKQYFVNPDDTVCQKAIVHKDGPRGNHFRRAGPRQRVFFESDEVHACIVTCGGLCPGLNTVIREIGGYRGFYACNTIDLSPKSVNDIHKRGGTVLGTSRGGHDTMKIVDSIQDRGINQVYVIGGDGTQRGAGVIFEEIRRRGLKVAVAGIPKTIDNDIPVIDRSFGFDTAVEEAQRAINAAHVEAGSAENGIGLVKLMGRHSGFIAHYATLASRDVDCCLIPESPFYLEGEGGLFRYLEKRLKENGHMVIVVAEGAGQKLINETKESMGKDASGNSILLDVGLWLSQKIKEHFKKIKTTINLKYIDPTYMIRAIPSNASDNVYCTLLAHSVVHGAMAGYTGFTVGQVNGRHCYIPFYPSFLSKKDVEDAKMEEERASKFFDGPPPNPKVEDKVASNGKAVK

SEQ ID NO: 30408 - protein, 990 aa, Ashbya gossypii ATCC 10895
MVDDIRNNEDKQIGSASGLQTPSAKKGKTKDQKQEEELSEDDLRLKADLETLVQRLLESDASLCEQSLAQLKEFIKNSTSSMTAVPAPLKFLRPSYPDLCAVYDKWVDPKLKSLLADVLSVLSMTYSDEGKHDSLRFRLLSNEKDIESWGHEYIRHLALEVGDVYNEQVENESDETYDQESKRAISDAEFPKDVLVQLALDIVPYFLKHNGEADAVDLLLEVESIDKLPQFIDENTFQRVCQYMVSCVPLLPPPEDVTFLQTAFSLYLSENQLTEALALAIRLGEESLIRSVFDATTDPVMHKQLAYILAAQKSSFEYSAVQDIIGSTKLSEHFLYLAKELNLTVPKFPEDIYKSHLDNSVRSAFASSGLDSAQQNLAASFVNGWLNLGYCADKMCLDDDNWVYKTKGDGMTSTVASIGSIYQWNLDGLQHLDKYLYADDVEVKAGALLGIGVSACGVHDGDVEPALLLLQDYVTNPNAKLSSAAILGLGIAFAGSRNDELLSLLLPIAADTSLSIETSAMASLALAHAFVGTCNGDITTSIMDNLLERSSIELKTEWTRFLTLALGILYMGQGDQVEDVLETISAIEHPITSAIEVLVNVCAYTGTGDVLLIQDLLYRLTPKKEEEEEDDDENEDGENDEDGDDAEGERDGSGQNIPEDIDSLVQEVMNTASTTEDSAISNEESTSTSKKADEDKMDVDNSKEEDAKNGDQGKHESKDDESSEKSMAHIDELTYSVLGIAMVAMGEDIGKEMSLRHFGHLMHYGNQHIRRVVPLAMGLVSVSDPQMKVFDTLSRFSHDPDLDVSINSIFAMGLCGCGTNNARLAQLLRQLASYYSKEQNTLFVTRLAQGLVHLGKGTMTLDVFNDAQVLNKVTLASLLTVLIGLTSPTFMLKHHQLFYYLNSGIRPKFILTLNEEGEPIKVNVRVGQAVDTVGQAGKPKTITGWITQSTPVLLNHGERAELETNEYISYASRIEGVVILKKNPNYKEEE

SEQ ID NO: 30409 - protein, 506 aa, Yarrowia lipolytica CLIB122
MNFYQEAAQFLEPSKKGSLQNRIFAQSKLLGKTRLRADPKHVFAVVFSALKYRPFLVDIIKAAEIPISDKPGKTKITMNMAILMAHDLLCSRSKRLTISKGPLKDMFLAHQTRLKSELTKFKLKHKVSDLDELVEEDSTPIRWIRINTVLSNEEEFHKTPLIARLKPIDKIEGGTIQPGQIYKDIHVPHLYGIHPREKLANCELYKQGKIIIQDRASCFPATILNPQPGQKLIDCCSAPGNKTTHLASFVAGTPGSIDAFEKDAIRAKLLTKMVKTAGCHNCIKVNVGDFTDTNPDDYPEVEGILVDPSCSGSGIFGRKHEDDAAAAEETNRDDQKDQFRLHKLSEFQYRIVKHALLFGSAKKVVYSTCSIHNIENEEVVQKLLLDSQVAAEGWQLAPKLRVLPLWTRRGDPNGFSDFPENQRAALAEGVVRALPKVDGGIGFFAACFEKRDIGEIGHRVPKVSEVESAQETSSDDHSEDAEQEDQDQDQDEEEVESEEEWTGFSD

SEQ ID NO: 30410 - protein, 350 aa, Oryza sativa (japonica cultivar-group)
MATTSSKNERWSLAGATALVTGGSKGIGRAIVEELASLGATVHTCARTEAPLNRCREELTAKGLAVTVSVCDVSLRADREALAGTVRELFGGKLSILVNCAGMSFLKPAVELTPDDCSQVMGMNFESCFHLSQLAYPLLKASQRGCIINISSIASVVAFCSLPNAVYSAAKDCSCLNSAGRATVVRNRGNRGMQGRVERRAMNQVTRNLAAEWANDGIRVNCVAPGFIRTPLLSEFVEGNELGRAEFSRVPMGRLGEPEDIASLVAFLSMPASSYITGRDDSVGHSNRCWKQSLGMVAFPLAALRKEASSSLPPLNSVGKQWHQGQDVDRSDRLALANGKDKVAKGAHHI

SEQ ID NO: 30411 - protein, 341 aa, Oryza sativa
MDHAAEAQRTDLMTITRHVLNEQGRHPESRGDFTILLSHIVLGCKFVASAVNKAGLAKLIGLAGDTNVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGSAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 30412 - protein, 323 aa, Arabidopsis thaliana
MEMNLRIEDLNEETKTLISSLPSDKDFTGKTICKYQGCWYTHNVLQAVLNFQKSFKPQDTDIIVASFPKCGTTWLKALTFALLHRSKQPSHDDDHPLLSNNPHVLVPYFEIDLYLRSENPDLTKFSSSPRLFSTHVPSHTLQEGLKGSTCKIVYISRNVKDTLVSYWHFFTKKQTDEKIISSFEDTFEMFCRGVSIFGPFWDHVLSYWRGSLEDPNHVLFMKFEEMKAEPRDQIKKFAEFLGCPFTKEEEESGSVDEIIDLCSLRNLSSLEINKTGKLNSGRENKMFFRKGEVGDWKNYLTPEMENKIDMIIQEKLQNSGLKF

SEQ ID NO: 30413 - protein, 704 aa, Triticum aestivum
  misc_feature (474)..(474): Xaa can be any naturally occurring amino acid
  misc_feature (494)..(494): Xaa can be any naturally occurring amino acid
  misc_feature (584)..(584): Xaa can be any naturally occurring amino acid
  unsure (1)..(704): unsure at all Xaa locations
MAMVAMRMRRSPALCYHLAAALLLLLLLAFLNAPLAGAQPLPWQLCDAAAGYYTEGSAYQANIRALASGLPRNASLSPALFAKGAAGAAPDAVYALALCRGDTNASSCAACVAAAFRNAQQLCAFNRHATMFDDPCILRYSGQDFLANVTDNSGRFVAFNGNNVTAGAAAAAFDAASGRLVNATADHAAEDPTRRFGTGEEGYDATYPKIYSLAQCTPDMAADDCRTCLRDIIEKFTPQYFVGKPGGRVFGVRCNFRFETYSFFSGRPLLQLPDVLPPAPAPAPAAAEEEGRRNRTGLILAITLPIVAALLLISTCVCFWRRRKPAERKPSVPLPYSATNPDDIQSIDSLLLDLSTLRAATDNFAESNKLGEGGFGAVYKGVLSEGEEIAVKRLSQSSTQGIEELKTELVLVAKLQHKNLVRLLGVCLEGQEKLLVYEYMPNRSLDTVLFDAEKSRGLDWGKRLKIVNGVARGXLQYLHEDSQLRIVHRDLKAXSNVLLDSDCNPKISDFGLAKLFGWDQSQAVTSHIAGTYGYMAPEYAMRGQYSVKSDAFSFGVLLLEIVTGRKNSSFASPDSEPSLDLLSXLVWEHWTSGTVEQLVDPSLGGRSPGGQMLKLVNIGLLCVQDSPADRPTMSVVNVMLSSSTVSLQAPSRPTFCVDDMEGFSGMYSGAYPRGSQSQSTGDSKPQAAMSPSPNEVSLTEIEPR

SEQ ID NO: 30414 - protein, 115 aa, Trichodesmium erythraeum IMS101
MSEQDTIFSKIIRREIPADIIYEDETTLAFKDINPQAPIHILVIPKKPIPNLANATSEDHILMGNLLLTAKQVAQEQGLQNGYRVVINNGIDAGQTVFHLHLHILGGRPMQWPPG

SEQ ID NO: 30415 - protein, 524 aa, Oryza sativa (japonica cultivar-group)
MKEDESPPHPHRSIPFHPSPPRDGSDSGGSVAAVPPSPRAAAAAAARPPVMTSLPGRGVSPSSSDPLCEGNAAPSSSSSSGQDLKQLKNSILSCVFSSPFSIFEAHQDSSANRSLKPHSGSYAWSRFLRRIACTGSMWRFLGASKALTSSDVWFLGKCYKLSSEELSNSSDCESGNAAFLEDFSSRIWITYRKGFDAISDSKYTSDVNWGCMVRSSQMLVAQALIFHHLGRSWRKPSQKPYSPEYIGILHMFGDSEACAFSIHNLLQAGKSYGLAAGSWVGPYAMCRAWQTLVCTNREHHEAVDGNGNFPMALYVVSGDEDGERGGAPVVCIDVAAQLCCDFNKNQSTWSPILLLVPLVLGLDKLNPRYIPLLKETLTFPQSLGILGGKPGTSTYIAGVQDDRALYLDPHEVQLAVDIAADNLEAGTSSYHCSTVRDLALDLIDPSLAIGFYCRDKDDFDDFCSRASELVDKANGAPLFTVVQSVQPSKQMYNEESSSGDGMDSINVEGLDGSGETGEEEWQIL

SEQ ID NO: 30416 - protein, 349 aa, Glycine max
  misc_feature (72)..(72): Xaa can be any naturally occurring amino acid
  unsure (1)..(349): unsure at all Xaa locations
MCQGLSAPSPPCSALLSFTLLLLLLSVVGPVSAWRPWPQSNKMNISDYAFGDSKKYEGSSEFVKLRYHMGPXVLTTNITVHTIWYGKWERSQKKIIREFINSISAANSPHPSVAGWWRTVQLYTDQTGANISKSVRLGEEKNDRFYSHGKSLTRLSIQSVIKSAITGKTRPLPINPRSGLYLLLTADDVYVQDFCTSVCGFHYFTFPSLVGYTLPYAGVGNSAKFCLGQCAYPFSVPAYIPNRKPFKSPNGDVGVDGMISVIGHEMAELATNPLANAWYAGQDPSFPVEIADLCEGIYGTGGGGSYTGQVFDARDGATYNMNGIRRKFLVQWLWSHVLNYCTGPNALDH

SEQ ID NO: 30417 - protein, 481 aa, Escherichia coli O157:H7 EDL933
MLVAQHTVYFPDAFLTQMREAMPSTLSFDDFLAACQRPLRRSIRVNTLKTSVADFLRLTAPYGWTLTPIPWCEEGFWIERDDEDALPLGSTAEHLSGLFYIQEASSMLPVAALFADGNAPQRVMDVAAAPGSKTTQIAARMNNEGAILANEFSASRVKVLHANISRCGISNVALTHFDGRVFGAALPEMFDAILLDAPCSGEGVVRKDPDALKNWSPESNQEIAATQRELIDSAFHALRSGGTLVYSTCTLNREENESVCLWLKETYPDAVEFLPLGDLFPGANKALTEEGFLHVFPQIYDCEGFFVARLRKTQAIPALPTPKYKVGNFPFSPVKDREAAQIRQAAASVGLNWDGNLRLWQRDKEVWLFPVGIEALIGKVRFSRLGIKLAETHNKGYRWQHEAVIALASPDNENAFELTPQEAEEWYRGRDVYPQAAPVADDVLVTFQHQPIGLAKRIGSRLKNSYPRELVRDGKLFTSNA

SEQ ID NO: 30418 - protein, 113 aa, Mycobacterium avium 104
MNRLDFVDQASLRDDIPVFGPGDTVNVHVKVIEGAKERIQVFKGVVIRRQGGGVRETFTVRKESYGVGVERTFPVHSPNIDHIQVVTRGDVRRAKLYYLRELRGKKAKIKEKR

SEQ ID NO: 30419 - protein, 306 aa, Photorhabdus luminescens subsp. laumondii TTO1
MNKRKVNWHGVFPAVTTQFNSDFSINLDATQKVMTNLIKDGVSGLVVNGSVGENTSLSMKEKRTIVELALDVAGGKVPVLSGIAELTTDNACKMVSECRQAGANGVMIMPPLVYTPTPKENRAYFRTIAASTDLPVMLYNNPLLYKNDITPKILTSLADCENIVAFKDSSGNTRPFSDIPNEAGDRFILFAGLDDVVLESVAVGAEGWISGMSNAFPREGETLFRLAKQKRYEEARELYRWFMPLLHLDFRPDLVQCIKLCEEMVGRGSAITRPPRLPLERETLAEVRAIVEQALANRPSLPDVGL

SEQ ID NO: 30420 - protein, 600 aa, Coprinopsis cinerea okayama7#130
MLASPTSPPSSGAQQDNPTPARPWLDKLKQAGSLTIHHVKRHTGVGVVCAVAYFDPGNWGVDLQAGSQFGYRLLFVVLLAGLFAVFLQVLASRLGCVTGLDLAGHSRLLLYNRPKHTLLYRWLGLYPLYVLAEVAIIATDLAELLGSAIALCMLFPSLELWHGVLITAFDVIVILAFGDPLRGRPVRLFELLIAGMVIAVLVCMCIVISKVDVHWGDAFLGYVPSKYIFQSGGLYTSVGILGATVMPHSLFIGSALATQDRIEFRELKKEDWHSMDSAEIPRSRLGYIWHSIKHHVQHAFAKPPPSFYDQATKHSEHENNPFAFVRAHLYHGIFDVAASLLGFAVLINSSILILASAVFYYGDQWSGDGDPASLFDCYDLIRDIVGQSAATLFAIALLASGQSSSLIATVAGQAVCEGFLRWRVSPLVRRLITRLLAIIPSMTVALVVGRPGIDALLVASQVVLSVVLPFITFPLLWCTSSKTIMSVRKPKKTVESFTAEPSTSDLAVPVLNREPSGAPSTKGDAKVPTSPTMTVSPPGTPASDGPSKIPDAGTAESADDYEMVDYSNNKLTIAVGVAIWLLVVAANVYVLIDLARGGSG

SEQ ID NO: 30421 - protein, 482 aa, Staphylococcus epidermidis RP62A
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDRIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 30422 - protein, 523 aa, Aspergillus oryzae
MLSRAVLPLTRPNTLASAVRLSALPITHSRWYAKNNKPKAPYKLPESVKSPKADQSSQQEYSASQAEFDTNADAQRNTANQTAESAESSQTGAEKAAPQQPLPDLTQGIPSTLAAELEARSKGRGPTALNLTEDPSRSEDYTDDGHGGDIPKDGYVSSLDRRRARMANLMYALFLLAGAGGAAYLGRNWDTEEEARLHPDVPSGWSFGLWYSRVKARFGDITSYYKDPAFPKLLPDEDPNLRQPYTLVLSLEDLLVHSEWSREHGWRVAKRPGVDYFLRYLNQYYELVLFTSVPSMMADQVLRKLDPFRIIRWPLFREATRYKDGEYIKDLSYLNRDLSKVILIDTKEEHARLQPENAIILNKWHGESKDKTLVALIPLLEYIAGMGVEDVRPVLKSFEGTDIPVEFAKREKAMRERFQKELGEEQQKRPKFSMGSLASAFGLKSTRTLDGETTPSEGLAQGKMLWDQIRERGQKNYEMMEKEIRENGEKWLAEMAAEEEKARQEQMNQMKGSLTSVFGAGKQ

SEQ ID NO: 30423 - protein, 937 aa, Oryza sativa
MPNHDMVIESAKKICRCFVATALNPWTHCAYSVTVFQDLRQAFEWMMNMDMAAAVLLEVEMYRPQWWSMFTSDTPNLKKFVLRLVDEANFTYATKDKDHGVPSSQRTNVTREGDNSNNSFTHHNIAIAYPISLAVDEKHSGLGDLLNSSAVFRVLNKTRDDVSQTLKMDIQCAYKTIPKLLIILLLHGCMSGKSPSGILNCTHCSVLLHKSRLPCKYRGYSAKPCGFSVTALLRGYGSPHPNGCIMLYRLLEYNISASLKLSLKFLLYWTKALNDDVWQEAQLALCSAMCRGSVLLLRVHAALLLLAALPALIAGQPWEICGENGNYTANSTYQANLKQLAAALHKNVSSGTGGGRLFASGAVGAVPDAVYALALCRGDINASACADCVGTIFQDAQQLCPYRKEVSIVYDSCYLRFSNLDFLSSADNSGVVDLYNTGTVSGDVGRYDRAVTGLLNATARYAAGNTNASSRLFATGVMVGFDAQFPKIYAMAQCSPDLSPAQCGLCLGAMVARWWQTFEPNTQGARSVGARCNMRVELYSFYNVPSMLQLQAEAVAPSPSPAPAPAGKPPAVPGTTGAASRSEDFESIESLFLDLSTLRIATDNFSENNKLGEGGFGVVYKGSLPHGEEIAVKRLSQSSVQGMGELKNELVLVAKLQHKNLVRLVGVCLEEHERMLVYEYMPNRSLDTILFDAEKSSLLDWGRRLKIINGVARGMQYLHEDSQLKIVHRDLKASNVLLDSDYNPKISDFGLARLFGGDQTQDVTNRVVGTYGYMAPEYAMRGHYSVKSDVFSFGVLVLEIVTGRRNSGSYYSEQSGDLLSIIWEHWTMGTIMEMVDRSMGERAAGGEIARCIHVGLLCVQENPASRPAMSAVNVMLSSGTVSLKAPSRPAFYIRKGGGDDGGGTGSYSGSFVGTLPSSGRSAPMSPNEVSITELEPR

SEQ ID NO: 30424 - protein, 108 aa, Synechococcus elongatus PCC 6301
MMTPELQERLTSIINGDKIVVFMKGNKLMPQCGFSNNVVQILNILGVPFTTVDVLADYDIRQGIKEFSNWPTIPQVYVNGEFIGGSDILIELYQNGELQQMLEVALAS

SEQ ID NO: 30425 - protein, 380 aa, Lotus japonicus
MSTTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMISDNQSRFSIKGKPIYHFVGTSTFSEYTVLHAGCVAKINPAAPLDKVCILSCGICTGFGATVNVAKPKPGSSVAIFGLGAVGLAAAEGARVSGASRIIGVDLVSSRFEGAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPNVVEMYMRGELELEKFITHTVSFSEINKAFDYMLKGESIRCIIRMEE

SEQ ID NO: 30426 - protein, 525 aa, Synechococcus elongatus PCC 6301
MPSTFALTTPLYYVNDVPHIGSAYTTIAADAIARFHRLQGDRVLMITGSDEHGQKIQRTAEKNGKPPQEHCNAIVARFQDLWQLLNIRYDRFSRTTDPRHQAIVEVFYRRVEAQGDIYVGRQQGWYCVACEEFKEERDLLEDKRCPIHTNQAVEWRDEENYFFRLSRYQEALEAHYAANPDFIQPESRRNEVLSFVERGLQDFSISRVNLEWGFAVPDNPKHTLYVWFDALLGYVTALLDPDAEPTLENALSQWWPINLHLIGKDILRFHAVYWPAMLLSAGLPLPDRVFGHGFLTKDGLKMGKSLGNTLDPFDLVDRFGSDAVRYYFLKEIEFGRDGDYQETRFVNVVNADLANDLGNLLNRTLSMAKRYCQLQIPLGSTAIAADNPLRQQGEALTDSVKSAYDRLAFSEACGQILALVQAGNRYLDQEAPWTRFKQGEQAKVEEILYTVLESVRLAAYWLSPLVPGISQEIYRQLGLVADFNDPAIAQQLDPESHGHWGFLPAAQQFLDPSPVFRSLELAPAD

SEQ ID NO: 30427 - protein, 489 aa, Polaromonas sp. JS666
MNLKRPSLFRQQCHIDGQWVDASDQATLAVVNPANDEVIACVPRLTDKDVQSAIRAADKALPAWREMSAKDRSKILRRWYDLCMTHQEDLATILTTEQGKPLSEARGEIAYGSGFIEWFSEEAKRVYGDIIPAPTADRRIIVIKQPVGVVAAITPWNFPNAMITRKAGAALAAGCTIVVKPASATPFSALALADLAVEAGIPPGVFNVVTGRSDVVGGALTSSPVVRKLSFTGSTEVGKQLMAQCAGTVKKVSMELGGNAPFIVFGDADLDAAVAGVMASKFRNAGQTCVCANRIFVQDMIYDVFAAKLKVAVEAQVVGDGMQAGVNLGPLIDAAAVNKVQEHISDAIALGANVLTGGQAHALGGHFFQPTILINVSSEAKLMNEETFGPVAPLIRFSTEEEVVSMANDTPFGLAAYFYTGSYERAWRVSEALECGIVGLNEGIISTELAPFGGIKESGVGREGSKYGIEDYVEVKYICAGGLGKKRAA

SEQ ID NO: 30428 - protein, 349 aa, Yarrowia lipolytica CLIB122
MTLLTTTSLLRTSRALAKVSVSVSRPTQFQHRFMATATSKEDYVKDPGDTKTLANTKMNDSSIYGADDSQKYETTPMWVHPIYTKEQMENLVVRHREAKTFSDKCALAAIRTMRWSFDLFTGYRHPKPGQENLKRFEMTPDKWYQRFLFLESIAGVPGMVGGMCRHLQSLRALKRDRAWIETLLEEAYNERMHLLTFLKMHKPGYFMRTMILLGQGVFFNLFFMAYLMSPRICHRFVGYLEEEAVITYTRCITDIDAGRLPEWEGHKVKIPEIAIDYWHMGPNPTMRDLIEYIRADEAKHCEVNHTLGNLDQDHDRNPFALKIDNGHPQPSKDLSTYKGQGWSRDEIAN

SEQ ID NO: 30429 - protein, 581 aa, Oryza sativa (japonica cultivar-group)
MRRLLELLPGELRRRVEGHPELPALVEVVMDLGRPPLARFPSGDFLLSQSPISFDDLRHATSQVGDFGADNRAGISRTLHRISAIRNRKGAIIGLTCRVGRAVPGSANLLQDLVKDGGSLLLIGPPGVGKTTVIREIARMLADDYRKRVMIVDTSNEIGGDGDIPHPGIGNARRLQVPNQDMQHKVLIEAVENHMPQAIVIDEIGTKLEAMAASTIAQRGIQLVATAHGITIENLIMNPSLDMLVGGVQSVTLGDEEANRRGVQKTVLERKGPSTFTCAAEIVSKIELRVHRSLEDTVDALLAGKMPNVEIRKVGSKGPVQEVYVQKERLDLGPSEGATQLDTDSLSNARRSLDSAFNLDPAEGHIGRSTEAEPDLNLYAYGISESTALQAIKQLELEDIVTLTYNISEADAVIALQSKLKKNTQIQAVVKSQDIPVFFTKTNSLVQIRRALRALVDDHTDGLMDFEDTEVRSSEETDALEEARLAIEQVVIPKGESVQLLPRPPSIIASQVDLVESFKLKWESIGQEPNACLRILPQFVGVEEGGKSVKQEAATELTDSDNSDDMDYKQNGVSRLPFLPE

SEQ ID NO: 30430 - protein, 265 aa, Solibacter usitatus Ellin6076
MEYALSRSARQLLAQLSCERTLYAFDFDGTLSPIVSNPDHAVMSRRTRGLLTCLAAARPCIVVSGRGRADLMQRVSGVGLAQAIGNHGAETSEASRAPRRRIAQWKAALEPALRDLPGVWVEDKDLSLAVHYRQAPKSSDARCRILAAARTLPHARVFGGKRVVNLVLDTAPHKGQALAAERDRLGCDWVLYVGDDKTDEDAFALCGNIVPVRIGVSQRSHARYYLRTQREIDRLLAVLVRKTKAVENALVGHTVSPADQPQGQL

SEQ ID NO: 30431 - protein, 420 aa, Lotus japonicus
MVLSNTASSGSESDLSIHSTFASRYVRTSLPRFKMPQESIPKEAAYQIINDELMLDGNPRLNLASFVTTWMEPECDKLIMASINKNYVDMDEYPVTTELQNRCVNMIAHLFNAPLGDSDTVGTVGSSEAIMLAGLAFKRTWQNRRKAEGKPHDKPNIVTGANVQVCWEKFARYFEVELKEVKLSEGYYVMDPQKAVDLVDENTICVAAILGSTLNGEFEDVKRLNDLLIEKNKETGWDTPIHVDAASGGFIAPFIYPELEWDFRLPLVKSINVSGHKYGLVYAGIGWVIWRNKEDLPEELIFHINYLGADQPTFTLNFSKGSSQIIAQYYQLIRLGYEGYKHVMENCRDNMLVLKEGLQKTGRFEIVSKDNGVPLVAFTLKDHTHYNEFQISDSLALRVDSAGIQHAPKYSARDRGPCSH

SEQ ID NO: 30432 - protein, 277 aa, Brassica napus
EEEEAVMDIDSCDKKNPLAVVDYIDDIYDFYKNNECRSCVPPNYMENQPDINERMRGILVDWLIEVHYKFGLMEETLYLTINLIDRFLAVHHHVARKKLQLVGVTAMLLACKYEEVSVPVVDDLILISDKAYTRREVLDMEKLMANTLQFNFCLPTPYVFMRRFLKAAQSDQKVELLSFFIVELCLVEYEMLQYAPSLLAASAIYTAQSTLKGFEEWSRTCEFYTGYTEEKLMECSRKMAGLHHEAGTGKLTGVYRKYNTSKFGYASRTEPAGFLLL

SEQ ID NO: 30433 - protein, 621 aa, Pseudomonas syringae
MSGMAGWVNLRHGVGQQANLPHSKVTKVILDMIAAMAGRGPDGQAVWLGPDLALGHCSTVASRYDFNEQPWIGEIRGATVAIMYTGQIYNMWQLQQELASFGPAPDRWSYAEIIRRAYGRWGTGFVQHLEGMFAIALWDGQKRELLLARDRLGLQPLYYTLTDGGIIFASVPTAIQAHPQFTAKLDRSALAIVLQPRMAMPGETPLKGLHELPPANVLSFSKRGHTQVRYWQLESAPHTDNFEQTSDHVRALLEGVVARQFEDQVPSAAMLSGGIDSTSVAALVMKQLATRGAGPALDTFCLKFDTDEDAFTSSELRPDIDAPFAALAAEYMGTRHTTLSATMQDLLNVIPATRTARGLPGWGQFDASMYLLFERMRDNFSVALTGEAADEIFGGYPYYFKPDLLARAQFPWLGDGPKLADYLSPALITAQQVAEDERARYDYWLSQVPRLPGESGEAARMREVLFLGMSGPLSVILDRKERMSMSQGLEVRVPFCDPELIQYVWNVPWEMKSRGGVKGLLKSAMRDILPPTTLSRKKSAYPHIQDTEYDRVLISEARWIATDPKSPIGWMFDTPRLSALIDQIAANQLNASMLPGGASPAHLLIQLVEMHRWIVDNRVAV

SEQ ID NO: 30434 - protein, 294 aa, Rickettsia conorii str. Malish 7
MHNIFKGLITALITPFKDNKLDLYALERIVKHQIKHEVDAVLIAGSTGESSSLSFEEYKLLLQTSVEIVNKCIPIISGCSSNNTTYARALAAESTKIGVDGFMASPPSYVKPTQHGIYKHFEALHEACNLPIMLYSAPTRSGVDFSDETILRLSKLPRILALKDCGVDLERPLRIRATVKKDFNILTGNDEVVLAFNAQGGVGWTSVASNIVPNICKELLEKWNKNDTKGALEIHQKLLPLYTALFVESNPIPIKYAAHYLGLCENEIRPPLTEASDSAKKQIENIITSLSIKI

SEQ ID NO: 30435 - protein, 547 aa, Arabidopsis thaliana
MELLLPHPSNSTPLTVLGFLDRAASVYGDCPSILHTANTVHTWSETHNRCLRIASALTSSSIGIKQGQVVSVVGPNVPSVYELQFAVPMSGAILNNINPRLDAHALSVLLRHSESRLVFVDHRSISLVLEAVSLFTQHEKPHLVLLDDDQENDSSSASDFLDTYEEIMERGNSRFKWIRPQTEWQPMVLNYTSGTTSSPKGVVLSHRAIFMLTVSSLLDWSVPNRPVYLWTLPMFHANGWGYTWGTAAVGATNICTRRVDAPTIYNLIDKHNVTHMCAAPMVLNMLINYPLSTPLKNPVMTSGAPPPATIISRAESLGFNVSHSYGLTETSGPVVSCAWKPKWDHLDPLERARLKSRQGVRTLGFTEVDVRDRKTGKSVKHDGVSVGEIVFRGSSVMLGYYKDPQGTAACMREDGWFYSGDIGVIHKDGYLEIKDRSKDVIICGGENISSAEIETVLYTNPVVKEAAVVAKPDKMWGETPCAFVSLKCDNNGDGSVPVTEREIREFCKTKLPKYMVPRKVIFQEELPKTSTGKIQKFLLRQMAKTLS

SEQ ID NO: 30436 - protein, 148 aa, Zea mays
MDTRPLLCRLVRRWQSDTASVLHEALGYIRFLHDQVQVLSSPYMQRRQPASAAHVQAQESAAGTVVEPALPSDLRSRGLCLVPVSYTDNFAGHGHGHGNGADLWSVVAGTGMGTAKAAVDNEGAAGGTLLPGGGGGAGHPRFTDYARV

SEQ ID NO: 30437 - protein, 667 aa, Oryza sativa (japonica cultivar-group)
MSMLPRFLLLVVLLAVPMTAAQQQYEANAQGDCYTDNGSSVLGYTCGTAASPPPPPCTAYLTFRSAPPSYASPITVSYLLNASVPAVAAANSVPVSPPVARDGLLLVPVPCACTAAGYYQHDAGYVIQFDDETYFVMANDTYQGLTTCQALMAQNPAHDSLDLYPGIRLTVPLRCACPSPAQAAAGVRYLVTYLLGWDDDSSTVADRFGADYQAVLFANNLTDDSTVYPFTTMLVPLKHRPKPDVTVLPEPGPPSPAPAPAVSAPPPPAVPSSESGSGRWKKSFRGRCIGIGVGVGFAVLASGALLALFLLRRRWRWRGNGELHDVPLAPDKEGAKATPPPWMLPTTVADVDVRDAVGSMAVYEYGELERVTAGFAEERRIGDSSVYRAVINGDVAAAVKRVAGDVGAEVSVLGRVSHSCLVRLFGLCVHRGDTYLVFELAENGALSDWIRGDNGGRALSWRQRMQAALDVADGLNYLHNYTRPPYVHKNLKSSNVLLDADFRAKVSNFGLARTVAGAGGQMTSRVVGTQGYMAPEYLEHGLIGPHLDVFAFGVVLLELLSGKEAAPARDGGEGGDGEALALLLWEEAEGQLVVDGDDDDARGKVAAFMDSRLRGDYPSEVALAMAALALRCVAREPRARPSMVEVFLSLSALHGTTLDWAPHATLS

SEQ ID NO: 30438 - protein, 1132 aa, Physcomitrella patens
MSTPKKTYSSTSSAKSKAHSVRVAQTTADAALQAVFEKSGDSGDSFDYSKSVSKSTAESLPSGAVTAYLQRMQRGGLTQSFGCMIAVEGTGFRVIAYSENAPEILDLVPQAVPSVGEMDTLRIGTDVRTLFTASSVASLEKAAEAQEMSLLNPITVNCRRSGKQLYAIAHRIDIGIVIDFEAVKTDDHLVSAAGALQSHKLAAKAITRLQALPGGNIGLLCDTVVEEVRELTGYDRVMAYRFHEDEHGEVVAEIRRADLEPYLGLHYPGTDIPQASRFLFMKNKVRIIADCSAPPVKVIQDPTLRQPVSLAGSTLRSPHGCHAQYMGNMGSIASLVMAVIINDNEEDSHGSVQRGRKLWGLVVCHHTSPRTVPFPLRSACGFLMQVFGLQLNMEVESAAQLREKHILRTQTLLCDMLLRDAPIGIVSQIPNIMDLVKCDGAALYYGKPFWLLGTTPTESQIKDIAEWLLEYHKDSTGLSTDSLADANYPAAHLLGDAVCGMAAAKITAKDFLFWFRSHTAKEIKWGGAKHDPGENHDGRKMHPRSSFKAFLEVVKRRSLPWEDVEMDAIHSLQLILRGSFQDIADSDTKTMIHARLNDLKLHDMDELSVVANEMVRLIETATAPILAVDSNGMINGWNAKIAQVTGLPVSEAHGRSLVKDLVTDESVAVVERLLYLALRGEEEQNVEIKLKTFGTQTEKGVVILIVDACSSIHVSENVVGVCFVGQDVTGQKMFMDKFTRIQGDYKTIVQNPHPLIPPIFGADEFGYCFEWNPAMEGLTGWKKDEVVGKLLVGEIFGMQMMCCRMKSQDAMTKFMIALNTAMDGQSTDKFTFSFFDREGKYVDVLLSTNKRTNADGVITGVFCFLQIASSELQQALKVQRATEKVAVAKLKELAYIVREIKNPLCGLTFTRQLLEDTDLSDDQQQFLDTSAVCEQQLQKSLNDMDLESIEDGYLELDTAEFEMGTVMNAVISQGMTTSREKGLQIFRETPREINTMRLLGDQIRLQQVLSDFLLNTVRFTPSPEGWVKIKVVPTRKRLGGSVHVVHLEFRVSHPGAGLPEELVLEMYDRGKGMTQEGLGLNMCRKLVRLMNGDVHYVREAMQCYFVVNVELPMAQRDDASSQCRSLYSYLLA

SEQ ID NO: 30439 - protein, 468 aa, Thermotoga maritima
MGSSHHHHHHSSGLVPRGSHMASNVKKFPEGFLWGVATASYQIEGSPLADGAGMSIWHTFSHTPGNVKNGDTGDVACDHYNRWKEDIEIIEKLGVKAYRFSISWPRILPEGTGRVNQKGLDFYNRIIDTLLEKGITPFVTIYHWDLPFALQLKGGWANREIADWFAEYSRVLFENFGDRVKNWITLNEPWVVAIVGHLYGVHAPGMRDIYVAFRAVHNLLRAHARAVKVFRETVKDGKIGIVFNNGYFEPASEKEEDIRAVRFMHQFNNYPLFLNPIYRGDYPELVLEFAREYLPENYKDDMSEIQEKIDFVGLNYYSGHLVKFDPDAPAKVSFVERDLPKTAMGWEIVPEGIYWILKKVKEEYNPPEVYITENGAAFDDVVSEDGRVHDQNRIDYLKAHIGQAWKAIQEGVPLKGYFVWSLLDNFEWAEGYSKRFGIVYVDYSTQKRIVKDSGYWYSNVVKNNGLED

SEQ ID NO: 30440 - protein, 443 aa, Photorhabdus luminescens subsp. laumondii TTO1
MSKTHYSESLNLKSHWMPFSANRSFQRDPRLIVAAEGQWLKDDKGRQIYDSLSGLWTCGAGHTRTEIQQAVAAQLSTLDYSPGFQFGHPLSFQLAEKIANLTPGDLNHVFFTSSGSESVDTAVKMVRAYWRVKGQPEKTKLIGRALGYHGVNIAGTSLGGIGGNRKMFGQLMDVDHLPHTLQTDMAFTPGMAETGGAELANEMLKLIELHDASNIAAVIVEPVSGSAGAIIPPKGYLQRLREICDQHNILLIFDEVITGFGRMGRWTGAEYFGVTPDLLNFAKQITNGAIPLGGVVASSEIYEAFMSQSLPEHSVEFSHGYTYSAHPVACAAGLATLDLLDKNHLIQRSAELAPHFETALHALRNCPNVTDIRNCGLVGAIELAARDGDTAVRPFDASMALWKAGFYVRFGGDTLQFGPMFNAERADLDRLFDAVGEVLHHID

SEQ ID NO: 30441 - protein, 151 aa, Oryza sativa (japonica cultivar-group)
MALEQTFIMIKPDGVQRGLIGEVIGRFEKKGFYLKAMKLINVEKSFAEKHYADLSSKPFFGGLVEYIVSGPVVAMVWEGKQVVSTGRKLVGATNPLAAEPGTIRGDFAVDIGRNVIHGSDSVENARKEIALWFPEGIAEWRSNQHPWIYEV

SEQ ID NO: 30442 - protein, 1148 aa, Photorhabdus luminescens subsp. laumondii TTO1
MKSEFKEGYCTLCRSRCGTVNEVRNDTLIKIQQNPKHPTGNAMCMKGKAAPELAHSPNRILHPLRRTNPKGDADPGWEKITWDEALTYVAEKLAFYKAESGAESVAFSVTSPSGTPLSDSLEWIERFIRNFGSPNVCYSTEVCNWHKDEAHKFTFGCSIPVADYRNAELIILWGHNPTNTWLAQAEALGAGRNAGAKLIVVDPRHTALAKESDNWLNINPGTDAALALGLINIIINRRGYDQAFVARWTNASLLVRNDNGLFLREKDINISAKKNRYVVWNNITQSPLPYDIHENVPCDENDHYALLGEFSINSAEDVNKKIPCKSAFQRLLNECQPYTPEYVEKITGITKEKLLYAADLIISSKRIAYHSWTGVAQHTNATQSERAIAVLYALTGCFDTQGSNRVYNKHPVNPVNARRLMPKEQQEKALGFKERPLGPPLDGWITSHDLYQAILHKRPYPIRAMMAFGTNMLSSHADTKIGIDALKQLEFHVHCDLFETPTAHYADILLPVNTPWEREGLRVGFEISAKAEELVQLRQKMISPRGESRSDNEIVFDLACRLGMNDLFFNGSVEAGWNYILEPIGLTVEALREKPAGISMPLIQHDRKYAGIDPVKNTVKGFDTETGVVEIYSEKLWRHGYPPLPIYDEPKENLNSESHFPYRLTSVKNGFYCHSQQRSLTRLRKKSPYPKLEINSRLAEKKGINNGDWVEVITRNGEARFKASLDDNIAYDTIIAEFGWWQACPDYGKEGFPAIGKNSSNYNALISDDSCDPISGASPLRSFRCDIKLAEDINPERRPWQGRKAFRVVDTKPEAKGVKTVIFESQDGTMLPDYEPGQHITVQVSIPGQDAPVIRAYSLTGTATLEGRKSYSISVRHQKSITSDGETFEGVMSSYINKTLVAGAEVNLTPPGGNFIIPLNAKQPVVMLAGGIGITPFISYLESLPANGEKPELLLLYANQNSNTHTFSKRLKEIESKIKQLKVINYYSNPLPVDIEGINYQYHGYITADAVPETLIKQQARFYMCGPAPMMKTFEEGLLTLGVPPFDIYKEMFRSLTPVKIKDGKSFAVKFEKSGVPLEWSPDKGTLLNFGEKSGIKMASGCRVGQCESCAVKLKSGEVQHLNGVEPSEQGMCLTCQCIPISDISIDA

SEQ ID NO: 30443 - protein, 202 aa, Solibacter usitatus Ellin6076
MKDLLEGYRRFRAKGWPEQRGVFETLARDGQAPKAMVVACVDSRVDPAMIFDAGPGEILTVRNVANLVPPYAPDAAYHGTSAALEFGVRVLQVRHVMVMGHGLCGGVRALLEGAPGPGHEFVAPWMSIAETARVHVMKSVPAEQRQQACEWEAIKVSLANLLTFPWIAERVGTGKLALHGTWFDIHTGELMILQADDRFVPA

SEQ ID NO: 30444 - protein, 192 aa, Glycine max
  misc_feature (38)..(38): Xaa can be any naturally occurring amino acid
  unsure (1)..(192): unsure at all Xaa locations
MIYTAIDTFYLTDEQLANSPSRKDGIDEATETTLRIYXPQAVMATGQVLFHRFYCKKSFARFNVKKVAASCVWLASKLEENPRKARQVIIVFHRMECRRESFPMEHLDLYSKKYVDLKMELSRTERHILKEMGFICHVEHPHKFISNYLATLETPPELRQEAWNLANDSLRTTLCVRFKSEVVACGVVYAAA

SEQ ID NO: 30445 - protein, 306 aa, Photorhabdus luminescens subsp. laumondii TTO1
MPLDKNVEKWLASTPEIAIGEDSPLEQLRIVLEHALIQQQGEWNDATYNSSFTVLAEDGFPIPVRMYVPYGKEKMSDKPALVYAHGGGWCLGSLDAWDRPCRKLAESMGCVIFSVDYRLAPENPFPVPLTDFYAALCYVTDNAEKFGINRQQIAVGGDSAGGNLAVAACLMSRNQEGPAICYQLLFYPALDASMETDSYDKYGEGYVLTKQMMAFFWQAYINEHNSRTNPLISPSHLTHFEGLPDATILLCEYDPLRSEGEAYAQQLRDAGVSVQIETIEGMIHGAMHMTAVTPSVEAFYKKFCFC

SEQ ID NO: 30446 - protein, 328 aa, Papaver rhoeas
IGRGAYGIVCAAINSETREEVAIKKIGNAFDNRIDAKRTLREIKLLRHMDHENIIAIKDIIRPPQRESFDDVYIVYELMDTDLHQIIRSTQQLTDDHCQYFLYQLLRGLRYVHSANVLHRDLKPSNLFLNANCDLKIGDFGLARTTSETDFMTEYVVTRWYRAPELLLNCSEYTAAIDIWFVGCILGEILTREPLFPGKDYVHQLRLITELLGSPDDSSLGFLRSDNARRYVRQLPQYPKQHFSARFSQMSQGAIDLLEKMLVFDPSKRITVEEALCHPYLKSLHDINDEPICARPFNFDFEQPSFTEVNIKEPIWRESVKFNPDPTH

SEQ ID NO: 30447 - protein, 135 aa, Prochlorococcus marinus str. NATL2A
MKSSSIEAIETKFAPKPVGPYNQAILVENYLYCSGQIALDPSTGVMVGNGNIEEETRQVLKNLMAVVEAAGGKSSAVIRTTIYLTDLNDFAKVNEIYAETFNKTVSPARACVEVSKLPKGGKIEIDCIAWLENKK

SEQ ID NO: 30448 - protein, 347 aa, Lactobacillus reuteri
MERKSLDEINGSVDVPNVYQSAFWQKFLAYSGPGALVAVGYMDPGNWLTSLAGGSQYRYQLLVVLFTAILIAMYMQSLAIKLGVTTRTDLAQAIAWRLPTPLRIALWLFNEIAMMATDLTGVVGTAVALNMLFKLPLLIGVLLTIADVLVVLFFLHFGIRRIEFIVLTAILVVGAIFAIEVCRAHPEFSAIMDGFVPRSTIFTNHSELLISLGIVGATIMPHNIYLHSSLAQSRRYDEHDPKQVKETLRFANWDSLIHLFAAFVVNALLLILGGTLFFHAASLGSLEDVFFGLKNPQIVGSLASPLMSWLFAFALLVTGLISSITSTLAGQIVMEGFINIRLPLWKR

SEQ ID NO: 30449 - protein, 366 aa, Schizosaccharomyces pombe
NTYILTTSNTIMADIPADRKKIVQEGWSRLFSDIEQPSYIQKFPSQESLYVSFFEQCAFDDFDLTLLRFLKARKFVVTDSSDMLANAIVWRQQANLRSIMVRGENGLNQNFVKASMYFIWGQDKKGRAIVFLNLHNFIPPKNTKDMEELKALILYAMENARLFLDSEQNAAKGVLGLVDLTYFSRKNIDLDFARVFAETFQNYYPEILGQALIVGSGFRMALFEGVWSIGKYFLDPEVRSKVTFCKPAQVSGYVDSKYIPLSMHGQFDETKLYERAPPETAGIGKPENYEELDKEYVDAAKEFIRLTREWIYAAGKPQEAEIEEKRKAFKYECKKLWRKGVALRPPNIYQRLGLIDANGHVDWSKA

SEQ ID NO: 30450 - protein, 499 aa, Polaromonas sp. JS666
MKNSGNDPAVKPVAERKQLRHYVDGAFVGSEVTFSNINPVDGTLIAEVCEANASTVDQAVRAAQAALKGPWGRLSVQERAAVLHKVADGILARFEEFVEAEVADTGRPVHQARTLDIARAIANFRTFADLAKTANTDLFEMATADGAGALNYTVRKPLGVIGVISPWNLPLLLFTWKVAPALACGNTVVAKPSEESPSSATLLAEVMHDAGVPPGVFNLIHGFGKDSAGEFLTRHPGISALTFTGESKTGSTIMKSVADGVKEVSFELGGKNAAVVFADTDFDAAVAGVLRSAFTNSGQVCLCSERVYVQRPIFDKFVAALKAGTERLKIGYPHDDGVDIGPLISHGHRDKVLSYYKLAVEEGATVVTGGGVPSFGDARDAGAYVQPTIWTGLTDSARCVTEEIFGPVCHIAPFDNEEEVIARVNDSVYGLACAVWTTNLSRAHRVSRQIHVGLVWVNTWYLRDLRTPFGGVKLSGLGREGGRYSLDFYSDVANICIKL

SEQ ID NO: 30451 - protein, 470 aa, Yersinia pestis biovar Microtus str. 91001
MKLHLAISSGLGRSGASRNMSFDSLGLNADILRAVEEQGYLVPTPIQRQAIPVVLEGRDLMASAQTGTGKTAGFTLPLLQLLSQDQQPIKGRRPVRALILTPTRELAAQIDENVQSYSKYLKLRSLVVFGGVSINPQMMKLRGGVDILVATPGRLLDLEHQNAVDLSKIEILVLDEADRMLDMGFIHDIRRVLAKLPAKRQNLLFSATFSDEIKGLASKLLHNPASVEVARRNTASEQIAQSVHFVDKNRKRELLSQMIGEGNWQQVLVFNRTKHGANHLAEQLNKDGITAAAIHGNKSQGARTRALADFKDGKIRVLVATDIAARGLDIDQLPHVVNYELPNVPEDYVHRIGRTGRAERTGEAISLVCVDEHKLLRDIERLLKREIPRIALDGYEPDPSIKADPIQNGRQGRGAQRPGMGRGSSAGRPQNGGGAAGRGDSRNSRPRSQADGQRRPAGPSSRGRSRNPGE

SEQ ID NO: 30452 - protein, 632 aa, Escherichia coli CFT073
MVSYFYPSLKSPHSIKPVKNYRSINKYTQKPSPFSSISNRHYVFYFSTAKSLAHRAALRHFFNKQTQHAVNTRLTEKVMCSIFGVFDIKTDAVELRKKALELSRLMRHRGPDWSGIYASDNAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDYDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFEAYLPASVAWRQKEQFSDGVGYSWIDTLKEVAAQQVSDQQLETARFRFPFNTPTSKEAYLYREIFEELFPLPSAAECVPGGPSVACSSAKAIEWDEAFKKMDDPSGRAVGVHQSAYK

SEQ ID NO: 30453 - protein, 702 aa, Thermoplasma acidophilum
MKIGYQLIINTYYAASSVCFRRNIFKSRQNSKIMTLTVCPYCGTGCQIEVDYSGDHYTVHGYTRSAVNEGKLCIKGYQGLSYASSHDRITSPMLRSGDTWVKVSWDEAIDYVVKRLKEIRDRYGPDAIAFQASAKCTNEENYLLQKIARMIGTNNVDHCARSCHSSTVAGLIRTLGTAAATGSIKSLKSTQTFFVIGSNTTEQHPIIGTTIIKQKKAGKKLIVADPRRTKLASIADVFLQFKPGSDVALLNSMMFVILKRGLIDSEFIKSRTEGFEAFAEEIEKYPPELTEQITGVPPDLVEKAAEIYASNRPSAILYGMGITQHIHGTENVMSVSNLALMTGNLGRYGSGIFPLRGQNNVQGSSDMGALSEFYPGYVPPDSPGVEKFERIWEAKLPRKVGLMLSEMFDAAIDGRVKAIYLMGENPVITEANLSDVERGLKNLELFVVQDIFMTDTARYAHVILPATSALEKEGTFTNTERRIQRVVPVKDPPGDARPDWWILSQIYSKIFDREAYRSPEDIFNEIRLAIPNYSGVRYSDLYPDGKQWPINDQHPEGAEILHVDKFARGLGRFMAIPYKSPSESPDEEYPFILTTGRNYYHWHSGTMTRRSEILERESPNPYVEISVNDAKKLSIRNGQTITIESRHGSIKLPAMVTSKIPDGIVFVPFHFKEARVNLLVGENLDPYSKIPEFKVVAVKVKA

SEQ ID NO: 30454 - protein, 398 aa, Prochlorococcus marinus str. MIT 9303
MATSRRLGRLGRGVFDRNDRRKQAYRLANAGPQSLSLLDLSLGSTDLSPPAVALEAIEVALRAPESSSYCLHASTRPFREAVAAWSQRRFGVSVDPDREVLLLVGSQEGTAHLPLAVLDPGDSALILDPAYPSHRGGLILADARIERLLLRPEQEWRPDFNALSNSQWDQLRMMVFGFPHNPTAQVGEQSWLVEAMDRGIRHQVVVAHDNPYVDLALDGEAPALLRCPGWRECGIEFFSFSKAWCLGGFRLAFAIGAEHLITALRELKGVVDFNQSLALQRGAIAALTDAQDWPQEILGVYRERRDRTLAALHALGWHAPCPSMALYLWLPIPAWAKQQNYNDETLAADLLDQTGLALTPGSGFGSGGDGWLRLALVHPVEDLEAAVARMRPWWHAHI

SEQ ID NO: 30455 - protein, 509 aa, Camptotheca acuminata
MAVLLLFLPLIFIFLAYKLYQRLRFKLPPGPRPLPFVGNLYSVKPVKFRCFAEWAQVYGPIMSVWFGSTLNVVISNSELAKEVLKENDQHLADRERNRSSNSFSRGGKDLIWADYGPHYVKVRKLCTVELFTPKRLEALRPIREDEVTAMVDSIFKDSANPDNYGKSLLVKQYIGAVAFNNITRLVFGKRFMNSEGVMDEQGKEFRGIVANGVKIGGLRFIGEHIPWLRCMFPQEEEILVKHEARRDRLTRAIMEEHTLARKHSGGAKQHFVDALLTLQKEYELSDDTVIGLLWDMITAGMDTTSISVEWAMAELIKNPRVQQKAQEELDRVIGYERIMSETDFPNLPYLQCVAKEALRLHPPTPLMLPHKANSNVKIGGYDIPKGSIVHVNVWAIARDPATWKDPHEFRPERFLEEDVDMKGHDFRLLPFGAGRRICPGAQIAINLITSMLGHLLHHFSWAPPEGVKPEEIDMTENPGLVTFMKTPVQAVAKPRLPSHLYKRVAVGAV

SEQ ID NO: 30456 - protein, 662 aa, Staphylococcus epidermidis RP62A
MFNEKDQLAIDTIRALSIDAIEKANSGHPGLPMGAAPMAYTLWTRHLNFNPQSKDFFNRDRFILSAGHGSALLYSLLHVSGSLELEELKQFRQWGSKTPGHPEYRHTDGVEVTTGPLGQGFAMSVGMALAESHLAGKFNKDQFDIVNHYTYVLASDGDLMEGISHEAASFAGHNQLDKLIVLYDSNDISLDGDLDKSFSEDTKQRFEAYGWNYILVENGNDLDEIDNAITQAKSQQGPTIIEVKTIIGFGSPNKAGSNGVHGAPLGEEERALTFKEYGLDPEKRFNVPEDVYEIFKSTMLKRANENEEAWNNMLKNYSEAYPELAEEFKLAMSGKLPNNYADALPEYDLNHSGASRADSGEIIQKLSEFVPSFFGGSADLAGSNKSNVKEAKDYNKDTPEGKNVWFGVREFAMGAAINGMAAHGGLHPYAATFFVFSDYLKPALRLSSIMGLNSTFIFTHDSIAVGEDGPTHEPIEQLAGLRAIPNMNVIRPADGNETRVAWEVALESEQTPTSLVLTRQNLPTLDVDKQTVENGVRKGAYIVFETEQQLEYLLLASGSEVNLAVEAAKELEQQGKGVRVISMPNWYAFEQQSSEYKESILPSDVTKRIAIEMASPLGWHKYVGIEGKVIGINSFGASAPGDLVVEKYGFTKENILKQVRSL

SEQ ID NO: 30457 - protein, 413 aa, Myxococcus xanthus DK 1622
MNHFAYHKGVLHAEDVPLAAIAESVGTPTYVYSTATLTRHIRVVTEAFGDRPHLICYSVKANSNLAILRLIAERGGGFDIVSGGELARVRHVGGDAGKTVFAGVGKTQEEMEAALAAGILLFNVESAEELEALDAVGRRLGRRAPFALRVNPDVDARTHRYISTGLKTSKFGVPFEEAVALYARAKKMKGLLAAGLDCHIGSQLTQTAPIRAALSKVAGLYSALKEKGHPLAYLDVGGGLGITYLDETPPSPEEYARTVLAAAGATGATLILEPGRALVGNAGVLLTRVLYRKKTPARHFVVVDAGMNDLLRPALYEAHHGLQPLVKRRGKAVEVDVVGPVCESTDVLAKARPLVLPQAGELFAFMSAGAYGMSMSSTYNSRPRPAEVLVDGAAWRVVRERERVEDLWRGERA

SEQ ID NO: 30458 - protein, 497 aa, Solibacter usitatus Ellin6076
MSIFRTKSIDALIAASEDPEKKLRRTLGPWSLTAFGIGAVIGSGIFILTGTAAAGETLNYKSILHAPVLDLIMHGTQALSMTGRQGAGPAITLSFLLTAIACSFAALCYAELASMIPIAGSAYTYAYATLGEIIAWIIGWDLILEYAVSNMAVAVGFSAYLNDVLDNVFGWHIPAKFANPPIAEGQLTGAWFNISALLVLMILTWILVKGVKESASTNNAMVAIKIAAILIFVIGAAKAVDTSNWKPFAPHGFPGVLTGAAIVFFTYIGFDSVSTAAEECKRPQRDLPLGIILTLIICAILYILVALVLTGIARYDTLNNAAPVANALKVLGYNGIRQWVSLGALVGMLSSLLVFQYGQARIWFAMSRDGLLPKMFSKVHPVYKTPHISTWIAGLVVGIPAGIWDIGTFADLANIGTLFAFIIVSVGVIVLRRTQPDRPRGFRVPGGGFLPVISIVFCLILMMALPLETWVRFFVWLLIGFAIYFPFGRKNSALARR

SEQ ID NO: 30459 - protein, 158 aa, Oryza sativa
SHRLSSRSASPIRPVAPPSLSRPAPLLSPSRQIQHRSTATPRISAAHTSAAHLGSGKSATSCSASKLDYPNTTRRKVAGRGGDMSAHYAFGPQEDDAIIKHRLLTRTTTTRGEPPLKKLQKKFMSFATEVEKDADNISDCERLYKAFLQEINTFELPL

SEQ ID NO: 30460 - protein, 402 aa, Synechococcus elongatus PCC 6301
MSKRTLASLTAADLEGKRVLVRVDFNVPLDGNGKITDDTRIRAALPTIRYLSESGAKVILVSHFGRPKGKPVESMRLTPVAERLSELLGRPVVKTTDAVGAGAEAQVAATSNGQVVLLENVRFHAEEEANDAEFAKALASLADIYVNDAFGAAHRAHAPTAGVTEYLSPCVAGYLLEKELQYLQAAIDNPQRPLAAIVGGSKVSSKIGVIETLLDKCDKLLIGGGMIFTFYKAQGLSVGGSLVEEDKLDLARSLMAKAQEKGVQLLLPVDVVVADKFAPDANAKTVAIDAIPDGWMGLDIGPESVKQFEGALADCRSVIWNGPMGVFEFDQFAVGTEAIARSLAGLTRKGATTIIGGGDSVAAVEKVGVASEMSHISTGGGASLELLEGKVLPGVAALDDAA

SEQ ID NO: 30461 - protein, 292 aa, Salmonella typhimurium LT2
MFTGSIVALVTPMDEKGNVSRSCLKKLIDYHVANGTSAIVSVGTTGESATLSHDEHGDVVMMTLELADGRIPVIAGTGANATAEAISLTQRFNDSGIVGCLTVTPYYNRPTQEGLFQHFKAIAEHTDLPQILYNVPSRTGCDMLPETVGRLAEIKNIIAIKEATGNLTRVHQIKELVSDDFILLSGDDASALDFMQLGGHGVISVTANVAAREMADMCKLAAEGQFAEARAINQRLMPLHNKLFVEPNPIPVKWACKALGLVATDTLRLPMTPITDHGRDIVKAALQHAGLL

SEQ ID NO: 30462 - protein, 907 aa, Aspergillus oryzae
MAKEGERSAPADKGKGKVDDVKDLPGAKKSPTDEKPQADGKKKDEEPKEEELNEEDQQLKNELEMLVERLKEPDTSLYGPALDAIKNFIKTSTSSMTAVPKPLKFLRPHYDELTELYENWSAGSVKDSLADMLSVLGMTYGDEEKLETLKYRLLTKSEDLGSWGHEYIRHLALEIGQEYQNRLNAEKGVQDLIDLSLSLVPYFLSHNAEADAVDLLSELEIIEEIPRFLDENTYSRVCLYMVSMVNLLTYPEDQQFLRTAHEIYVRYKEFTKAVVLAIRLNDTELIKSDINATSDRSLKKQMAFLVARQQIWLDMPDEEEDQSFMDCLNNTLIPSHFKSLGKELNILDPKMPEDIYKTHLESSRGAGLTNVDSARHNLASAFVNSFANAGFGNDKMMLVEGDKGPWVWKTKDDGMLSTTASMGMLLHRDVDVGLDKIDKFTYATEDQIKAGALLSIGILNSGVRLDSDPALALLSDPDNLEAKNVPMRVASIMGLGLAYAGSNKEELLDVLLPIVEDVSLDMQLSAMAAVSLGLIFVGSSNHQVSEAIATTLMDEDRQKQLKNKWTRFMALGLALLYFGRQEEVDVILDILKAVDHPMAKPTSVLASVCAWAGTGTVLKLQELLHICNDIIEESDENKGDELVQSYAVLGLSLIAMGEEVGQDMILRQFGHLMHYGASNIRKAVPLAMGLITPSNPQMKVYDTLSRYSHDNDNDVAINAIFAMGLCGAGTNNARLAQLLRQLASYYHRDQNSLFMVRIAQGLLHMGKGTMTLNPFHTDRQVLSRVSAAGLLTVLVSMIDAKQFILAEHHYLLYFLITAMYPRFLVTLDEDLQPLTVNVRVGQAVDVVGQAGRPKTITGWQTQSTPVLLAYGERAELEDEQYIPLSSTLEGLVILRKNPNWEGEQSTA

SEQ ID NO: 30463 - protein, 115 aa, Triticum aestivum
ALLSTVSVIVYFCCFVMGFGPIPNILCAEIFPTRVRGLCIAICAFTFWIGDIIVTYSLPVMLNAIGLAGVFSIYAVVCLISFVFVFLKVPETKGMPLEVITEFFAVGAKQAAAKA

SEQ ID NO: 30464 - protein, 373 aa, Oryza sativa (japonica cultivar-group)
MTDVELRVEALSLSDVSAIPPEYVRLEEERTDLGDALEVARAASDDADAARIPVVDISAFDGDGRRACVEAVRAAAEEWGVMHIAGHGLPGDVLDRLRAAGEAFFALPIAEKEAYANDPAAGRLQGYGSKLAANASGKREWEDYLFHLVHPDHLADHSLWPANPPEYVPVSRDFGGRVRTLASKLLAILSLGLGLPEETLERRLRRHDQHGVDDDLLLQLKINYYPRCPRPDLAVGVEAHTDVSALSFILHNGVPGLQAHHAGTWVTARSEQGTIVVHVGDALEILTNGRYTSVLHRSLVSRDAVRVSWVVFCEPPPESVLLQPLPELLANGAGKPLFAPRTFKQHVQRKLFKKLKDQQDNNAAAASNGIIPK

SEQ ID NO: 30465 - protein, 394 aa, Trichodesmium erythraeum IMS101
MSQIQTRTEPMVINMGPHHPSMHGVLRLIVTLDGEDVIDCEPVIGYLHRGMEKIAENRTNTMFVPYVSRWDYAAGMFNEAVTVNAPEQLADIAVPKRASYIRVIMLELNRIANHLLWLGPFLADVGAQTPFFYIFREREMIYDLWEAATGYRMVNNNYFRIGGVAADLPYGWVDKCEDFCDYFLPKVDEYERLITNNPIFRRRIMGLGVISREEAINWGLSGPMLRASGVKWDLRKVDHYECYDDFDWEVHWEKDGDCLARYLVRIREMRESVNIIRQAIKGLPGGPYENLEAKRMAEGPKSEWNDFDYQFLGKKIPPTFKIPKGEHYVRIESGKGEIGIYIIGDNNIFPWRFKIRAADFVNLQIFPHILQGAKVADLVAILGSIDIIMGSVDR

SEQ ID NO: 30466 - protein, 389 aa, Escherichia coli CFT073
MSVALIRDGVIRPSENDSHVLTAMLPSSCPQNHAANILPLPDGALMCVWFAGTQEGIADISVWGSRLPAGGMQWSDAVKLSHDDTRSEQNPVLFLAPDNVLWLLWTAQISGNQDTAIVRYRKSDDLGQTWGEIATLLDKPGTFIRQPITVLDNGNWLLPVFYCRTQPGEKWVGNDDISAVKISADGGHSWRDVEVPQSLGCVHMNITMLHNGTLVALFRSRWADNIYISHSADNGESWSVPQATELPNNNSSIQVTTLASGELALVYNAMSAAGAVERRASLYDEIDDGDDSRKEPTAVGRSAFWGAPRAPMTVAISADGGKSWPWRRNLDEGDGYCMTNNSLEKLNREFSYPSIKQSPDGTLHIAYTWWRQAIKYVRISPEWVKGQAS

SEQ ID NO: 30467 - protein, 477 aa, Vibrio parahaemolyticus RIMD 2210633
MQQIKNETLKEVFKQWASDDGVVVINPATEQELIRLKPSSIEELDCLIEACSAEQVRWAKLSAKERSSCLKNWHQLLMEHAEDIATIITLEQGKPLSESRGEVSYGASFVEWFAEEARRAYGEVIPAPAIDRRLSTIKQPVGVCAAITPWNFPIAMITRKAAPALAAGCGMIIKPSELTPLTALAVVELAYQAGIPKPLLPVVISEQAAEFGQVLSMDPRIKKISFTGSTRVGKILMKQASETVKAVSMELGGNAPFIVFEDADLESAADGLIASKFRNAGQTCVCTNRLYVHQNAKERFMEKVLAKMTELNVGNGLESGVTVGPVITMASKHRLEAVIDQALQEGATIANRPQKLAGRFMEPVILDNVDQGMAIVQQELFGPVLPVLTFEDDEQVLAMANDTEYGLACYFYTDSLKRIIKFTEGLEYGMVGVNEGIISTEVAPFGGIKESGVGREGAKQGLDEYLETKYICLGGLN

SEQ ID NO: 30468 - protein, 1172 aa, Oryza sativa (japonica cultivar-group)
MVCGNVSTVVPMLQHTSMAREQKLVLDADADDDGLHHTGAGGKQQKLVLDAAADGLHLTGVGGKQHNLVLDAGAGGKQQKLVLDAADDGLHLAGVGGKQHNLVLDAGTGRKQQKLVLDADDDGLHLAGVGGKQHNLVLDAADDGLHLPGVGGKQHNLVVDAGAGGKQQKLVLDDADDGLHLAGVGGKQHNLVVDAGASGKQQKLVLDAADDGLHLAGVGEKQHNLVLDAVTDGLHLAGVGGKQHNLVLDAGTGRKQQKLVLDADDDGLHHTGAGGKQQKLVLNAADDGTTWCSMPPTTGFTSPAWDAADDGLHLAGVGGKKHNLVLDAAPDGLHLAGVGGKQHNLVLDAGTGRKQQKLVLEDDGLHHTGAGRKQQKLVLDAANDGLHLAGVGGKQHNLVLDAADDGLHLAGVGGKQHNLVVDAGAGAKQQKLVLDAADDGLHLAGVGGKQHNLVLDAGAGGKQQKLVLDAADDGLHLAGVGWKQHNLVLDAGAGGKQQKLVLDTAVDVSQHTVGGAEQNLLLDSTDDGLHHTGAGGEQNLVIDDDIDGSNHTVGGAEQDDGLHTTGAGWEQNLVLCTDVDGLLHTGAGGEQNMVCDNVGTIVSGLHDTIARWERNLVFDDVGTAVPWLRHTGVDGKQNLVYHLATATVQSVWRENCMEQFKLVLEALHQPHRHLYIAVDMEFAADAATNVSHRPVTSISCYQHMRRYVNGGGIFQMGLTFAFVGEGEQAPSPLIALEINFDFNVNSPKYHGKSIDFLSSQGHDLTQHSKRGVAPEFVYEGLLRHLPFGDGSVTWVAFHGDYDLAFLLRLLQGGDHGGNCLLPPKLATFLQKVREKFPVVYDVRVLGKLVKDGFNGSLTALAEYLGIPRNGDEHHAGSDALLTLSCFFKIVSLSGHQMHRMDARRGLLAGLEEWNMAIKCARHIDNHTGSIYVVKMLPHKLDEEARRIEELVASNFNIVGVEVIHAQLGKRSYAVEAQQNYELIKTFLKDSDLYEIIVTFMNAEGMLAYSRAWKFCISSRADNACVHPQQFAKFMASCGALGDPNISWVTFHGAHGIARMIRSFLSPQDLPSQWCSYIGHRRAFFPAIYDVALLVRRSFDIITIPWIECKGGLLDVAQALNLKEIEADMEAARVLLTLRCYMRLAERPDFPGTKMAVQGLLKESCCWKCPANC

SEQ ID NO: 30469 - protein, 344 aa, Oryza sativa (indica cultivar-group)
MAEKEVGRIFVGGLSWDTTERTLERAFSEYGKVIETQMVVLERDTGRSRGFGFVTFSEPRAVDAAIRGMHNGELDGRTISVNKAQPRMNTDDGYGYGGGGGGGGTYSSGARGGYRGGGDAVPSANDDCFKCGRAGHWARECPYSSGGGGGRTGRYSPPSRYGSGTGGGRGDRFGGSDRFANRYVDDRYDVGAMLMIAMVVVDVIDMPLIAIHQLPIVLQVTDMVVLIVMHQVDLPGKEAMKEMEDGPVEVTIVMNLEALVVMTEVACAWGVVTDTGPVDLLALLGVTEIGLPHMIVPAGQQHALMMTATDGGYFGAFQKTRITNICSSSQFLLYLPSCISTSTL

SEQ ID NO: 30470 - protein, 690 aa, Oryza sativa (indica cultivar-group)
MPRRLAVWWAPSTRRRGAGGGPRRAVPQPPVRRPSGDRACTPWRGGVGAAAPAPVTPVAAAGARDELEAFLEVVPARMRRGLARHPEVRELVEVVMDLGRRPLARFPSGDWVISEQAVTADDLHQAVSKVGDFSEDNRSGINHSLHRISAIRNRKAHIIGLTCRVGRAISGSAEMIRDLVVGGGSILVIGPPGVGKTTLISLRCFQQYREIARILADEGKKRVIIVDTSNEIGGDGDVPHSGIGRSRRMQVPKVSMQHNVMIEAVENHMPEVIVIDEIGTELEAMAASTIAQRGVQLVGTAHGVTIESIIKNPCLQVLVGGIESVTLGDEEAKKRKVQKTILERKGPPTFSCAVEMISKTECRVHHKLEATVDAILAGKPPKFEARKMDYKVTESGRSLVIPEREYETEPLPSYQEHHFAKAMPSEDNFDDDFSTRRTESKSVPSNDNFNDDFGSTRKTKGKTSVPGKSPVHVYTYQISEADILQVATVMGFDDELDVTDDIGAANVILASSSEMKQNHWIRNVAKYHKLPIFVVKTNTMAQIVKAVRMIVGRDKLNAPTRKQPKVVVGEIEIEDDAPKRKPSLEEIDALEEARLAIEYIVIPGGEPVELLPRCSEIVARQLELVESYQLLAETFGTDSNSRLQILPVKITKKSSSKGSAGSMPKQGSSDLIVSDNGGGSSFSRLPFLPK

SEQ ID NO: 30471 - protein, 455 aa, Cryptococcus neoformans var. neoformans B-3501A
MPPNASKTVFVANIPYDVSEEQLANVFSEAGPVANVEIKFDANTGRSKGYAFVQFYDEATALSAVRNLQDAPVNGRNLRVELSTDEPGPRRRGPGPGAVGVGAAPGAGGPGVGGPSASLGGPRPMVPAPGPGGAPPFTSAGAGAPGYPPRAPFDPRYPQVHSQSHENTPPPAGVGARRQGGDDIDLRMAPQGIDLLPGQKAVDTISKTLAGIAPGQMGDVMTSMKSLIQTNPDQARQLLSQQPQLAYALFQAMLLLNLVDPSVLSSIQPLAASASAAASGGAASVAPGPGGAGARAPNYPPYPPPTQTQGPPGGQQAFRPPPQALYGGAPPLPNQNQNQNQNQNPPYPPYPSGPGVPGGVSGAGAGIPPPTSTPVPPTPHPAHAVPVGPPGGPAPPAPGLASLPPAAQAALSTLPPDQQQMLLQVLQLSPAQIAALDPTQKASVMQLRQQFLGTA
